United States Patent 10,760,088 (ISOLATED POLYNUCLEOTIDES AND POLYPEPTIDES AND METHODS OF USING SAME FOR INCREASING PLANT YIELD, BIOMASS, GROWTH RATE, VIGOR, OIL CONTENT, ABIOTIC STRESS TOLERANCE OF PLANTS AND NITROGEN USE EFFICIENCY) - sequence listing, part 5

SEQ ID NO: 8251 - DNA, 1743 bp, Malus domestica
ctctctcgccctctctcgttcttctctctgctctgtccgacgacatacctccaattaatcgaatttcaaaatcgattaagggtaacaagtgagaatgtttgggagagctccaaagaaaagcgataacagcaagtattatgagatccttggagtttcaaagaccgcttcgcaggacgatctaaagaaggcttatagaaaagccgccatcaagaaccaccctgataagggcggcgatcctgagaagtttaaagagttggcccaagcatatgaggttctgagtgatccagagaaacgtgagatatatgatcaatatggcgaggatgccctcaaggaaggaatgggtggtggaggtggtggccatgacccatttgatattttccaatccttctttggtggaaacccattcggtggtggtggaagcagcagaggccgaaggcagagaaggggagaggatgtgatccatccccttaaggtttctttggaagatctctacaatggaacgtccaaaaagctttctcttgcgcgcaacaaaatctgctccaagtgcaagggtaaagggtcgaagtcaggtgcttcaatgaaatgtcctggctgccaaggttctggaatgaaagtctctattagacatctcggcccctcgatgatccagcaaatgcaacatccttgcgctgagtgcaagggtactggtgagaccattaatgacaaggatcgctgcacacaatgtaagggtgagaaggttgttcaggaaaagaaagtcttagaagtaattgtggagaagggcatgcaaaatgggcagaagattactttccctggtgaagctgatgaagcgccagacaccatcacaggcgatattgtctttgtcctacaacaaaaggagcaccctaaatttaagaggaagggtgatgatctcttctttgaacataccttgtcacttgtggaatcactctgcggcttccaatttgtattgacacatttagatggaagacagctcctcattaaatcccaacctggagaagttgtaaagcctgatcaattcaaggctataaatgatgagggcatgccaatgtaccagaggccattcatgaaaggtaagttatatattcacttcacagtggagttccccgactcactgaatccagaacagtgcaaggctctggaggctgtcctcccccccaagacttcggctcagctgaccgacatggagttggatgaatgtgaggagactacgctgcatgatgttaacatagaggaggaaatgcgccgaaagcaagcacatgcacacgaggcatatgacgatgatgaggacatgcatggtggtgcccagagggttcagtgtgctcagcagtgattagataggctttatgaacgtatttgagaaaaataaaagttatctgcattgtggtatgttggatgctaagacgatggttacttatatttgtggtttggtttgtgaatcgtaagttttcgggaacaatagctactaaggagatggttacttatattctatataatgttaattgttgaaagctaagaatttatattctgctgctttaggatgttggttagatagagtaaccctttgaaaggggttatatgtctttggtccgtgggggcttgagcttataaccataatcccatttgcaatggggaccgttgctaatctgagggtttaggggcgctctttgcgcaactttaccccaagtgaacaaatcaataccaagttgcgaactgtgcacgtttgct

SEQ ID NO: 8252 - DNA, 1647 bp, Nicotiana tabacum
ctcctctttctcttttctcgattccccgactcacctgatagtcaagacgccccctccttcctcttctcgccgctactttccattgatcgaattttgacttagtaaaagcgatcgaagaagaagatgtttggaaggacaccgaagaagagcgatagcacaaagtattatgagatcttaggagttccgaagagtgcttctcaggatgatctcaaaaaggcttatcgtaaagccgccatcaaaaaccatcccgacaagggaggcgatcctgaaaagtttaaagagcttgcccaagcttatgaggttttaagtgacccggagaagcgtgatatatatgatcagtatggtgaggacgctctcaaggaaggaatgggtggtggaggtggtggacacgacccatttgacatattccaatccttcttcggcggaagcccctttggaggtggtggaagcagcagaggtagaagacaaagaaaaggagaggatgttgtccaccctctcaaggtttctttggaggatgtttacaatggaacatcaaagaagctttcactatctcgcaatgtattgtgcgcaaagtgcaagggtaaagggtctaagtcaggtgcttcaatgaagtgttctggctgtcaagggtctgggatgaaagtttctattagacagcttggtccatccatgatccagcagatgcagcacccttgcaatgagtgtaagggtactggtgagacaattaatgacaaagataggtgcccacagtgtaagggagagaaggttgtgcaggagaagaaggtgttggaagttcacgtggagaagggtatgcagaatgggcagaagataacattcccaggcgaggcagatgaagcgccggaaactattactggagacatagtttttatcttgcaacagaaggaacatcctaagttcaagcgaaagggagatgatctttttgttgagcacacattgaccttgaccgaggccctatgtggtttccagttcatcttgactcacctagacaacagacagctgctgatcaagtcccaacctggcgaagttgtcaagcctgatcagtttaaggctatcaacgatgaaggaatgccaatgtaccaaaggccttttatgagagggaaattgtacattcatttcactgttgatttccctgagtcattaaccccagagcagtgcaagaaccttgaagcggtgctgccgccaaaacccaaaatggaagtgtctgaaatggaattggatgaatgtgaggagaccactttgcatgatgtgaacattgaggaggagatgcgaaggaagcagcaagcagcccaagaggcttacgacgacgatgatgatatgcctggtggtgcacagagagtccaatgtgcacagcagtaattgggtatgcttcaagaaattaacagggcctactctcccctggtaaaaaccatgacattgtcaggaatgttgctatctgtggtaggaggtagattactagtaaaggagttgggaatctttattatgcaaactaacactataagcagaattttactgcttgacaattgcaagtgtgcttacatgttattcgcaatttgttagttattttattcaatcgaacacctggcatcttacttctatcctttttaatttcaagtccgaatgtgaaaa

SEQ ID NO: 8253 - DNA, 1634 bp, Triticum aestivum
tcctcgtctccgctcccacgcccgcgggagagaggcgaccggcggcggcgcgcgaggagggcctacccatcccacccaccaccccgccggccaagatgttcggccgcgcccccaagaagagcgacaacaccaagtactacgaggtgctcggggtgcccaagaacgccgcccaggacgacctcaagaaggcctaccgcaaggccgccatcaagaaccaccccgacaagggcggagaccccgagaagttcaaggagctggcacaagcctatgaggttttgagtgaccctgagaagcgtgagatctatgatcagtatggcgaagatgctctcaaggagggaatgggtggaggaggaggtggtggagttgatccatttgacatcttctcatcatttttcgggccctcttttggaggtggtggtggtggcagcagcaggggcagaaggcaaaggaggggagaggatgttgtccatccacttaaagcttctctagaagatctttacaatggtacttcgaagaagctctctctttcccgcagcgtcctctgctccaagtgcaagggcaagggctccaagtctggtgcttccatgaggtgcccaggttgccagggttcaggcatgaaagtgactattcgtcagctggggccttccatgatacagcagatgcagcaggcctgcaatgattgcaagggcaccggggagagtattaacgacaaggatcgctgcccaggctgcaagggtgagaaggttcttcaggagaagaaagttctggaggttcacgttgagaaggggatgcaacacaaccagaagatcaccttccctggtgaagctgatgaggcgcctgacactgttactggagacattgtatttgtcgtccagcagaaggaacacccgaagttcaagcgaaagggcgatgatctcttctatgagcataccatatctctcactgaagctctttgtgggttccaactcgtcctgacccatctggacaacaggcagctgctcattaaatcaaaccctggtgaaattgtcaagcctgattcattcaaggcaatcagcgacgagggaatgccgatgtaccagaggccgttcatgaagggcaagctctacattcatttcacagtggaattccccgactcgctggcaccggatcagtgcaaggctctcgaggctgtgcttccaccaaagcctgcatccaagctgaccgacatggagctcgacgaatgcgaggagacgacaatgcatgacgtcaacatggaggaggagatgcgcaggaaagcccatgctgctgctcaggaggcgtacgacgaggacgacgagatgcctggaggcggtgcccaaagagtgcagtgcgcacaacagtaagataggtttggcagcaagctttttggggacccaagatcaagatgcctgcccgctctttggggttttggcggtgttatcgatgaagctgatttttgcccgtatggcgccggggctgtatccatccatgtcttttgaaaaatgctacgtggctactcttaatgtagtgtgatactcgtataaaagcaatctgtttgtgaaaactaacgaacgctgtctgaatacgttgtctaagcagaaccgtggacaattttgcaaagcatgtttgtggttttt

SEQ ID NO: 8254 - DNA, 1691 bp, Triticum aestivum
tcctcgtctccgctcccacgcccgcgggcagagaggcgaccggcggcgcgcgaggagggcctacccatcccaccaccccgccggcgaagatgttcggccgcgcccccaagaagagcgacaacaccaagtactacgaggtgctcggggtgcccaagaacgccgcccaggacgacctcaagaaggcctaccgcaaggccgccatcaagaaccaccccgacaagggcggagaccccgagaagttcaaggagctggcacaagcctatgaggttttgagtgaccctgagaagcgtgagatatatgatcagtatggcgaagatgctctcaaggaaggaatgggtggaggaggtggtggtggagttgatccatttgacatattttcatcatttttcgggccctcttttggaggtggtggtggtggcagcagcaggggcagaaggcaaaggaggggagaggatgttgtccatccactaaaagcttctctagaagatctttacaatggtacctcgaagaagctctctctttcccgcagcgtcctctgctccaagtgcaagggcaagggctccaagtctggtgcttccatgaggtgcccaggttgccaggggtcaggcatgaaagtgactattcgtcagctggggccttccatgatacagcagatgcagcaggcctgcaatgattgcaagggcaccggggagagtattaacgacaaggaccgctgcccaggctgcaagggtgagaaggttcttcaggagaagaaagttctggaggttcatgttgagaaggggatgcaacacaacccagaagatcaccttccctggtgaagctgatgaggcgcctgacactgttactggagacattgtatttgtcgtccagcagaaggaacacccaaagttcaagcgaaagggcgatgatctcttctatgagcataccatatctctcactgaagctctttgtgggttccaactcgtcctgacccatctggacaacaggcagctgctcattaaatcaaaccctggtgaaattgtcaagcctgattcattcaaggcaatcagcgacgaggggatgccgatgtaccagaggccgttcatgaagggcaagctctacattcatttcacggtggagttccccgactcgctggcaccggatcagtgcaaggctctcgaggctgtgcttccaccaaagcctgcatccaagctgaccgacatggagctcgacgaatgcgaggagacgacgatgcatgatgtcaacatggaggaggagatgcgtcggaaagcccatgctgctgctcaggaggcgtacgatgaggacgacgagatgcccggaggcggtgcccaaagagtgcagtgcgcacaacagtaagctaggttgggcagcaagcatttttgggacccaagaacaagatgcctgcccgctctcttctggtgctttggtggtgttatcgatgaagctgatttttgcccgtatggcgccgggactgtatccatccatgtcttttgaaaattgctacgtggctacttctgatgtagtgtgacactcgtataaaagcaaaatctgtccgtgaaaactaacgcacgctctttgtctgtctctctgaatacgttgtctaagcaggaccgtggacagttttgcagagcatgtttgggcttttaatcaggttttcggcggcatcgtaatcattatcatcatcacgccca

SEQ ID NO: 8255 - DNA, 1447 bp, Actinidia deliciosa
tctctctctctagggttttccttatcggttaatttgatcaatcaaagatgtttgggagagcaccgaagaagagcgacaacacaaagtactatgaaattctcggagtctcgaagagcgctttgcaggatgatctgaagaaggcctaccgaaaagccgccattaagaaccaccctgacaagggcggtgatcctgagaagtttaaagagctggcacaagcttatgaggtcctgagcgacccagagaagcgcgagatttatgatcagtatggtgaggatgctctcaaggaaggaatgggtggtggaggaggtgggcatgatccatttgacatcttccaatccttcttcggtggcagcccatttggtggtggtggaagcagcagaggccgtaggcaaagaaagggtgaggatgtcattcatcctctcaaggtttctctggaggatctctacaatgggacagccaagaagctatccctatcacgcaatgtaatatgttccaagtgcaagggcaaaggatccaagtcaggtgcttccatgaagtgtgcttcatgtcaagggtctggaatgaaagtctcaatcagacatcttggtccatctatgatccagcagatgcagcacccttgtaatgagtgtaagggtactggtgaaactatcagtgacaaggatcgctgcccacagtgcaagggtgagaaggtcgtcggggagaagaaagtgttggaggttgttgcagagaagggaatgcaaaacggacagaaaatcacctttcctggagaggctgatgaagcgcctgacacggttacaggagatatagtcttcgtgctacagcagaaagagcaccctaagtttaagcggaagggtgatgatctatttgttgaacacaccttgacacttactgaggctctctgtggcttccatttcattctcacccatcttgataataggcagctcctcattaaatctcaacctggggaagttatcaaacctgattcattcaagggaataaatgatgagggtatgccaatgtaccagagacccttcatgaaagggaaaatgtatattcacttcacagtggatttcccagaatccctcacaccggagcagtccaaggctctcgaagctgtgcttcctccaaagccttcaatgcagatgagtgagatggagctggacgaatgcgaggagactaccctgcatgatgtgaacatagaagaggaaatgcgtcggaagcagcagcaacaggcgcaagaggcttatgatgaagacgaagatatgcacggtggggcccaaagggtgcagtgcgctcagcaatgatgacctaacgacaagtgtgtccttgagaagagaacatgcgttagggaagatgcttcataaacttctcaagactaacattcattggaatgtgctgtttagtcttttagaatatttagtttctgcattttggtgttttcatgttt

SEQ ID NO: 8256 - DNA, 2103 bp, Populus trichocarpa
gtggaccaaatcaatggcccagattcaccctagaacccaaaaagccttcatgagaattctagatccttctatttccgcctctaaaaccccaaaaccaaaaataggaacttctctaataaaaataaaatctgcccaccatctagccctccaaacaatcaaatctccaccgtccattccttctttcctttaagtacacagatctgaattctcttcaatccctctctctgtctcgccgtctgtcttgtggctctccgtgaccctataatctaaccctctgatttaaattgatataaaaaatgtttgggagagcaccaaagaaaagcgacaataccaagtactatgagattcttggagtctcaaagagtgcttcacaagatgatttaaaaaaggcttacaggaaagcagctatcaagaaccatcctgataagggtggtgatcctgaaaagttcaaggagttggcccaagcatacgaggttctgagtgacccagagaaacgtgagatatatgatcaatatggagaggatgccctcaaggaaggaatgggcggtggcggcggcggtggcgcccatgatccatttgatatctttcaatccttctttggtggcggcaatccatttggtggaggtggtagcagcagaggccgaaggcaaaggaggggtgaggatgtgatccaccctcttaaagtatccttggaagatatttacaatggcacatccaagaagctgtctctttcacgcaatgtaatctgctccaagtgcaagggtaaaggttccaagtctggtgcatcattgaaatgttctggttgccaaggttctggaatgaaggtctctataagacaccttggtccctctatgatccagcaaatgcagcatccttgcaatgattgtaagggcactggtgaggcaattaatgacaaggaccgttgccctcaatgcaagggtgagaaggtggtccaagagaaaaaagttttggaagtagttgttgagaagggcatgcaaaatgcacagaggattactttccctggagaggctgatgaagctcccgacaccgttacaggggacattgtttttgtcctacaacaaaaggagcaccctaagtttaagagaaagggtgatgacctatttgtcgagcacaccctctctcttgcagaggcactctgtggcttccagttcattttgacccatttggatggaaggcagctcctgataaaatctcaacctggggaagtagtcaaacctgatcaattcaaggctataaatgatgaaggaatgccaatgtaccagaggccattcatgagggggaaactgtacattcatttcactgttgatttcccagactccctgtcccttgatcagtgcaaggccttggagaccgtgcttcctccacgaacctcagctgagcttactgacatggagcttgatgaatgtgaggaaactactttacatgatgtgaacattgaggaggagatgaggaggaagcaacaacaacaggcccaagaagcatatgatgaagatgatgaaatgcatggtggtggtggccagagggtgcaatgtgctcagcaataatcaatgagcaggggatgattgtgaatcgaagagagctgaatgggatcaagatgaactgatgtgggtttgacaattatttaagtaataagattctcaacattgtgataggagatagacttctagtttcctgtatggagatttcacctatgtttgcagactcgggcaattacttagtatttgaacctttgagagatctccaagaacagcaccttggtgtttttttctgtgcaactcttacttgaattttggatttatagtttgccatgtagctgcttctttctggaacgggcacaagttgctgaatgtcacttttaagttatggttaggactagtaatcctacgacgtctcgccacagggtaccctggtgggtaaccttgtgcccctaaggaatgtttgtctggctttgcaatttgcaatgttgatgttagtattgtgaagctgttgtatgcaacatcctgattgaaattactgctttcaagcctgagggtctgcagcccataattatgagcgcatgtttcaagaacctcaatttccatc

SEQ ID NO: 8257 - DNA, 1614 bp, Cynara scolymus
  misc_feature (603)..(603): n is a, c, g, or t
cgggacctctctgtctgccgaagcagacgagtcaagtcttctcctttcgatctacttcgcagatttgtaatttaatattgaagatcggagaagaaagaacaggatgtttggaagagcaccgaagaagagcgataacactaagtactatgagatccttggggtcccgaataatgcttcccaggacgatctaaagaaggcttacaggaaagctgccattaagaatcatcctgacaagggtggagatcctgagaagtttaaagagctggctcaagcatatgaggtactgagtgacccagagaagcgtgagatatatgatcagtatggtgaggacgcgttgaaggaaggaatgggtggtggaggtgggggccatgacccctttgacatcttccaatccttctttggtggcaatccttttggaggtggtggtggtagcagcaggggacgaaggcaacgaaggggagaagatgtcattcatcctctcaaagtttctcttgaggacctctacaacggaacttctaaaaaactctctctttcacgtaatgtaatttgctccaagtgtaagggcaagggttcaaaatcggtgcttcatgaaatgtgcaggcngtcaaggttcgggaatgaaagtttccatcagacatcttggcccatctatgatccagcaaatgcagcatccttgtaatgaatgcaagggtactggagagaccatcaatgataaggatcggtgcccacagtgcaagggtgagaaagtggtgcaggagaagaaggtgctcgaagtccatgtagagaagggcatgcaaaatgggcagaagatcacattccctggagaggctgatgaagctcctgacacagttactggtgatattgtatttgtcttgcaacaaaaagagcaccctaagtttaagcgaaagggtgatgatgtatttgttgagcacacattgagcttaactgaggcactctgtgggttccagttcatcttgacccatttggatagtagacagcttctcatcaaatctcggcctggagaggttgttaagcctgatcaattcaaggccataaatgatgaaggaatgcctatgtaccagaggccattcatgagggggaagttgtacatccacttcacggtggaattccctgattcattgacgccggagcagtgcaaggcactggagggtgtgctgccagctaggccttcaatgcagatgacagacatggagctggatgaatgtgaggagacaactctgcatgatgtcaacatagaagaggagatgcgaaggaagcagcaagcagctcaagaagcttacgatgaagatgaagacatgcatggtggggcacagagggtacaatgtgcacagcaatgattgaaggaagcatggtttgctcgtctataggtggtcagtcttggcaagacaataatatcagctgtaattttcgttcttttatacgaccttctactactagtactatgttatattgtcaactgttttgggaaccttttaaagatgtatggatgatacttgctggtttgaaactggtgttagagctttacgaggcctttgctgcttgtttggtttgatgaacgacattgctttgaaattgttttaataattgatagcc

SEQ ID NO: 8258 - DNA, 1792 bp, Sorghum bicolor
gccacccgcccccgcctcctgcagcttcgagagtattcactccccaccacccgtcccgacgatataactacccccggcccccgcgctctctcctcctcacaaacttctcccggcacgacaccacgcttcccatcggatcgaacagctagggtttcggagatgtttgggcgcgcgccgaagaagagcgacaacacccggtactacgagatcctcggcgtctccaaggacgcctcccaggatgacctcaagaaggcctaccgcaaggccgccatcaagaaccaccccgataagggcggggatcccgagaagttcaaggagctagctcaggcttatgaggtcctcagtgatcctgaaaagcgagagatttatgatcagtatggtgaggatgccctcaaggagggaatgggaggcggtggagggatgcacgatccctttgacatattccagtcattctttggcggtgggagcccttttggaggtggtggcagcagtaggggcagaaggcagcgaaggggagaggatgtggttcatcctctgaaggtttctctggaggatttgtacaatggcacatcaaagaagctctctctgtcccgcaatgttctctgctccaagtgcaatggtaagggctcaaagtctggagcttcgtcgaggtgtgctggttgccaaggttctggctttaaggtccaaatcaggcagttgggacctggaatgattcagcaaatgcagcatccttgcaacgagtgcaagggttctggagagaccatcaacgacaaggacagatgcccacaatgcaagggtgataaagttgtgcaggagaagaaggttcttgaagtggtagtagagaaaggtatgcagaatgggcagaagatcacattccctggtgaagctgacgaagcgcctgacactgtcactggagatatcatctttgttctccagcagaaggagcatcccaagttcaagaggaagggcgatgacctcttctacgagcacaccctgaccttgactgaatctctgtgtggcttccagtttgttttgacacacctggataacaggcagctgctaatcaaatcaaaccctggcgaagttgtgaagcctgattctttcaaggcgatcaacgatgaaggcatgcccatgtaccagaggcccttcatgaagggcaagctgtacatccacttctcggtggatttcccggactcgttgagcctggagcagtgcaaggcgctggaggctgtgctcccacccaagccggtgtcgcagtacactgacatggagctggacgagtgcgaggagacgatgccgtatgacgtgaacatcgaggaggagatgcggaggcggcagcagcagcaccaggaggcatacgacgaggacgaggatatgccgggcggtgcgcagagggtgcagtgcgcccagcagtagttgcctgctatcagtagtagcagtgataatgtttgacggtggcggcaaatttgttgtttcgcattgtgcgactactgttgggtcaagttttccctcgcatttaatgtcacaacacttcggttacaaaaatgcagtattcatcaatccgttagcagaagttctgtgatggtttttttttaagcagaagttctgtgatgttttgcggtgcaggatctgttaagtatgccaaggagaaaagacagccacatagcttgactttagaatacaaatttagtttctaagaaattacttgtaatttcaagagttatttattttagaaggaaaaacagagaaacagccaaaaatgcttactctaggatcctttgggttccttttc

SEQ ID NO: 8259 - DNA, 1604 bp, Nicotiana tabacum
ctcttactctttttctccattcccctgactcacctgaaagtcaagacgtcccctccttcctcttctcgccgctactttccatcgatcaaattttgacttagtaaaagcgatcgaagaagaagatgtttggaaggacaccgaagaagagcgataacacaaagtattatgaaatcttaggagttccgaagagtgcttctcaggatgatctcaaaaaggcttatcgtaaagccgctattaaaaaccatcccgataagggaggcgatcctgaaaagtttaaagagcttgcccaagcttatgaggttttaagtgacccggagaagcgtgagatatatgatcagtatggtgaggacgctctcaaggaaggaatgggtggtggaggtggtggacacgacccatttgacatattccaatcattctttggtggtggaagcccctttggtggtggtggaagcagcagaggtagaagacaaagaaaaggagaggatgttgtccaccctctcaaggtttcgttggaggatgtttacaatgggacatcaaagaagctttcactatctcgcaatgtgttgtgcacaaagtgcaagggtaaagggtctaagtcaggtgtttcaatgaagtgttctggctgtcaagggtctgggatgaaagtttctattagacagcttggtccatctatgatccagcagatgcagcacccttgcaatgagtgtaagggtactggtgagacaattaatgacaaagataggtgcccacagtgtaagggagagaaggttgtgcaggagaagaaggtgttggaagttcacgtggagaaaggtatgcagaatgggcagaagataacattcccaggcgaggcagacgaagcaccggaaactattactggggacatagtttttatcttgcaacagaaggaacatcctaagttcaagcgaaagggagatgatctttttgttgagcacacgttgaccttgactgaggccctatgtggtttccagttcatcttgactcacctagacaacagacagctgctgatcaagtcccagcctggcgaagttgtcaagcctgaccagtttaaggctatcaatgatgaaggaatgccaatgtaccaaaggccttttatgagagggaaactgtacattcatttcactgttgatttccccgagtcattaaccccagagcagtgcaagaaccttgaagcggtgctgccgccaaaacccaaaatggaagtgtctgaaatggaattggatgaatgtgaggagactactttgcatgatgtgaacatcgaggaggagatgcgaaggaagcagcaagcagcccaagaggcatatgacgaagatgatgatatgcctggtggtgcacagagagtccaatgtgcacaacagtaatttggtaattggtagtgttctgtatgcttcaagaaattaacagggcctactctcccctggtaaagacctttgtcagaatattgctatccatggtaggacgtagattactagtaaaggatttgggaaattttattatgcaaactgacactataagcagaattttactgcttgacaattgcaagtgtgcttacatgttttcgcaatttgttggttattttattcaat

SEQ ID NO: 8260 - DNA, 2030 bp, Theobroma cacao
gggaatcgcctcgccgttgaagcgaaagaagcatctagaattcgaagaacatctctccatggcaaaggaaaaggaaaaaggagaagaagaagagggggggtagataattctagatccttctttttcttcacaacaaaatgaggattcctaatctcaaccgtccaatcaacaagctctcctttaaattccccctcaaaatcctctcccccacgccacttgatttattattttcttctcttgccgtgtcgccagggctttctgttatattctttcctctccaaaccaaaacaaacagagccaaagcagtttgatcgagtaactaagaaagatcgaaaaaaaatgtttggaagagcaccgaagaagagtgataacacgaggtattatgagattctgggtgtttccaagaacgcttcccaggatgatttgaagaaagcttacaagaaaaccgcctttaaaaaccatcctgacaaaggcggtgatcctgaaaagtttaaagagttagctcaagcttatgaggtattgagtgatcctgagaaacgtgagatatatgatcagtatggtgaggatgctctcaaggacggaatgggcgctactggggcccatgacccgttcgatatcttctcgtccttctttggtggtagcccctttggaggaggtagcagtcgtggaagaagacagagacggggagaggatgtgattcataatatgaaggtttctctagaggacctttaccttgggacttcaaagaagctttctctttcccgcaatatattatgctcgaagtgcaatggcaaagggtcgaaatcaggtgcttcaatgcagtgccctggttgccagggttctggtatgaaggtctcaatcaggcatcttggtccttccatgattcagcaaatgcaacatccctgcaatgaatgcaagggtactggtgagacaatcaatgacaaggaccgttgccctcagtgcaacggtgagaaggttgttcaggagaagaaggtgctggaagtcatcgtagagaagggtatgcagcatggacagaagattacattcccaggcgaagcagatgaagtgcctgataccattactggggacatagtctttgtccttcagcagaaggaacatccaaaattcaagagaaagggagaagacctgtttgtggaacataccttgtctctgactgaggctttgtgtggcttccaatttgtacttacccatctagatggccgacaacttttaatcaagtcaaactctggggagatagtgaagcctgattccttcaaggcaatcaatgatgaggggatgcccctgtaccagaggccattcatgaagggcaaattgtacattcacttcactgttgacttccctgattctctgagccctgatcaggttcaagcacttgaggctatcctgccgccaaagccaacctctcagttgactgatatggagctagatgagtgtgaggagaccacgctacatgatgtgaatattgaagaggagatgaggaggaagcaacaggcagcacaggaaactcttgatgaagaggagatgcatggtggtgcccagagggtgcaatgcgcacagcagtgatgatgaagaaaaaaatcggaagctaatttgagtagtattcatatgctgaggaatacggaagctgatctttatagtagttgaactgggagtttatggtttgttgcaagacatgtcttgcatgggtggtgggtgagtggtggtgcatgagcagaagatgtaggatactctatgaaccatgtgtttttgatcttttcttggcaaagattgccattctcatataatgtttcttgctggcaaattggaaaataagttcgccgttgatctactgttatacaatattagatatgaaagattctttggtgcctgctggtagagaaccataatgacatcatttggttacttcctttcaaaaaagaaacatcatttggttactgggtgcatgctgctagagaaccacaataacattatttggttacttggtgccataataacatcatctggttatt

SEQ ID NO: 8261 - DNA, 1629 bp, Ricinus communis
agtattcttaacaaaagaccccatggaggaaggcttcaatctcaaccgtccatccttaaacccgtcacccctatatataaagtctcgtcgtcctttgtcctgagtcatgtgaaaaaggcacaattcttcttcaatgttcattgcgtgtccagagtcttcttaaatttgggttctgtggttctgtttgttttgtgtaattgttttgatttactaaaagaaagaagaaggagatgtttgggagggcgccaaagaaaagtgataatacaaagtactatgaaatattgggagtatcaaagaatgctactcaggatgatttgaaaaaggcttacaagagagctgctatcaagaaccatcctgataagggaggtgatcctgagaagttcaaagagctagctcaggcttatgaggtcttgagtgatcctgagaaacgtgagatctatgatcaatatggtgaagatgcccttaaggaaggaatgggtggtggcggtgctggccataacccatttgacatttttgaatccttctttggtgggagtccctttggaggtggcagtagtcgaggaggaaggaggcagagacgaggagaagatgtggttcatcctttgaaggtttctttggaggatctctatcttggtacaatcaagaagctctccctgtctcgcaatatgatatgtgcaaagtgcaatggcaaggggtcaaaatctggagcttctatgaagtgttctggttgccagggcactggtatgaaggtctcaataaggcagcttggcccatcaatgatccaacagatgcagcatgcttgcaatgaatgcaaggggactggtgaatcaattagcgagaaggacagatgcacgcaatgcaagggagagaaggttgtccctgaaaagaaggtgttggaagtgattgtagagaagggcatgcagcatggtcagaaaatcacattccctggtgaagctgatgaagcgcctgacacaattactggtgatatagtttttgtccttcagcaaaaggatcatccaaagttcaagagaaaggaagatgaccttgttgtggatcacaatctttctctcacagaggctctttgtggcttccaatttgtattaactcatttggatgggcggcagcttcttatcaaatcaaccccaggggaagttgtgaagcctggctcattcaaggcaatcaatgatgagggtatgccaatgtaccagaggccattcatgaaggggaagctatacatacatttcaatgtggacttccctgattctttgactgcagatcaggttaaagcactcgaggcaattttgcctctgaggtcatcaactcaattgactgacatggagctggatgagtgtgaggaaactacacttcatgatgttaatatggaagaggagatgagaaggaagcagcagcaagctcagcaggaagcatacgatgaggatgacgacatgcctagtggcgcacagagggttcagtgtgcccagcagtgattgaactgaatctagcaggctaattttctgttaaaactaatttaggaaatcgaaatataattacacaatcaatttgtgagatgtgatgatctcgaaaactttcaggcgatgaaattaatggaacttatatttagttgtgttg

SEQ ID NO: 8262 - DNA, 1803 bp, Ricinus communis
caaggtcaaaaggctaatttaattggaaaagcgatcggtgacgaggaaccgttttctttttcccgtagcgtaagcaggtgtgacaactttcgtggaaagatctagagaactaaagccgttctagagtattcttaacaaaagaccccatggaggaaggcttcaatctcaaccgtccatccttaaacccgtcacccctatatataaagtctcgtcgtcctttgtcctgagtcatgtgaaaaaggcacaattcttcttcaatgttcattgcgtgtccagagtcttcttaaatttgggttctgtggttctgtttgttttgtgtaattgttttgatttactaaaagaaagaagaaggagatgtttgggagggcgccaaagaaaagtgataatacaaagtactatgaaatattgggagtatcaaagaatgctactcaggatgatttgaaaaaggcttacaagagagctgctatcaagaaccatcctgataagggaggtgatcctgagaagttcaaagagctagctcaggcttatgaggtcttgagtgatcctgagaaacgtgagatctatgatcaatatggtgaagatgcccttaaggaaggaatgggtggtggcggtgctggccataacccatttgacatttttgaatccttctttggtgggagtccctttggaggtggcagtagtcgaggaggaaggaggcagagacgaggagaagatgtggttcatcctttgaaggtttctttggaggatctctatcttggtacaatcaagaagctctccctgtctcgcaatatgatatgtgcaaagtgcaatggcaaggggtcaaaatctggagcttctatgaagtgttctggttgccagggcactggtatgaaggtctcaataaggcagcttggcccatcaatgatccaacagatgcagcatgcttgcaatgaatgcaaggggactggtgaatcaattagcgagaaggacagatgcacgcaatgcaagggagagaaggttgtccctgaaaagaaggtgttggaagtgattgtagagaagggcatgcagcatggtcagaaaatcacattccctggtgaagctgatgaagcgcctgacacaattactggtgatatagtttttgtccttcagcaaaaggatcatccaaagttcaagagaaaggaagatgaccttgttgtggatcacaatctttctctcacagaggctctttgtggcttccaatttgtattaactcatttggatgggcggcagcttcttatcaaatcaaccccaggggaagttgtgaagcctggctcattcaaggcaatcaatgatgagggtatgccaatgtaccagaggccattcatgaaggggaagctatacatacatttcaatgtggacttccctgattctttgactgcagatcaggttaaagcactcgaggcaattttgcctctgaggtcatcaactcaattgactgacatggagctggatgagtgtgaggaaactacacttcatgatgttaatatggaagaggagatgagaaggaagcagcagcaagctcagcaggaagcatacgatgaggatgacgacatgcctagtggcgcacagagggttcagtgtgcccagcagtgattgaactgaatctagcaggctaattttctgttaaaactaatttaggaaatcgaaatataattacacaatcaatttgtgagatgtgatgatctcgaaaactttcaggcgatgaaattaatggaacttatatttagttgtgttgcttttttgtggtggaatcgcaatgtgcttttgctctggctttttcctcaa

SEQ ID NO: 8263 - DNA, 1820 bp, Panicum virgatum
gtccgctcggccaccagctttgaccgcctcctcccgtcctccgctcccctccgctactgctcctccccatcccacttccccgcaggagaggcagcagcggcggcggcggcggcggcgacggcggctaagcgtaacccccacctcggcgagcggcaccggcggcggcaaaggcaagatgttcgggcgcgcgccgaagaagagcgacaacaccaagtactacgagatcctcggggtgcccaagtccgcatcccaggacgacctcaagaaggcctaccgcaaggccgccatcaagaaccaccccgacaagggcggcgaccccgagaagttcaaggagcttgcacaagcttatgaggttttgagtgatccagagaagcgtgagatttatgatcaatatggtgaagatgccctcaaagaaggaatgggtggaggaggagcccatgtagatccatttgacatcttctcatcattctttggaccctcttttggaggaggtggtggcagcagcagaggcagaaggcaaaggaggggagaagatgtcgtgcatccacttaaagtttctctagaagatctttacaatggtacctcaaagaagctctcgctttcacgtagtgtcatctgctccaagtgcaaaggcaagggctccaagtctggtgcttcaatgaggtgcccaggttgccagggttcaggtatgaagatcaccatccgccagctgggtccttccatgatacagcagatgcagacagcttgcaatgagtgcaaggggactggagagagcatcaatgagaaggatcgctgcccagggtgcaagggtgagaaggttgttcagaagaagaaggttctggaagttcacgttgagaaggggatgcagcacaaccagaagatcactttccctggcgaagctgatgaagcgcctgacactgtcaccggagacattgtattcgtccttcagcagaaggatcactccaaattcaagagaaagggcgatgatctcttttatgagcacaccttgtctctgactgaggctctctgtgggttccaatttgttcttacacatctggacaacaggcagcttctcatcaagtcaaaccctggtgaagttgttaagcctgaccaattcaaggcgataaatgacgaggggatgccaatgtaccagaggcctttcatgaaggggaagctctacattcacttcacagtagagttcccagactcgctggcaccagagcagtgcaaggcccttgaggcggtacttccaccaaagcttacacccaagctgacagacatggagatagatgagtgtgaggagaccactatgcatgatgtgaacaacatcgaggaagagatgcgcaggaagcaagctcatgccgcccaggaggcgtacgaggaggacgacgagatgcctggaggagcccaaagagtgcagtgtgcacaacagtaagctgagtgtatcatcaaggggcttcgcagcgctgcacacgtagtaatctgcaaggtttgcagtggacctttggacccagtgtgatctctctggttttatcgtcggagttatgaaacagaggaagctgattctgattctaccccgttgggggcggggaatgtatcctttttgctgcaactgaaaaaatgctacccaggcgtagctggctacttttaactgttttgtgagacttggtgttgttaatcgtatttgaatgttgttaatcgtataggcaacttaatgttgttgcgtgctacagtaggacgacgcgcatttgaatgcaatgactcaagtatcttgtgcaccagaatatttctatcgaactagatgctcttaatcgtttgac

SEQ ID NO: 8264 - DNA, 1632 bp, Valeriana officinalis
ggaatctgggccgtctgatagttaaataagaaataaaagcgcagatctggaaaccctcttgcgccagtcgcaacacaaactccagacgacctccatctccttcttcttctctctctagggtttcatcgactcggaggttggaaatcgaagatgtttggaagggcgcccaagaagagcgataacaccaagtactatgagatcttaggagtcaacaagaacgcttctcaggatgatctcaagaaggcctatcgcaaggctgccatcaagaatcatcccgataaagggggcgatcctgaaaagttcaaagaacttgcccaagcctatgaggtcctaagtgatccggagaaacgtgaggtttatgatcaatatggtgaggatgctctcaaggaaggaatgggttctggaggtggtggacacgatccatttgacattttccaatcatttttcggaggtagtccttttggtggtggtggtggcagcagcagaggccgaagacaaagaagaggagaggacgttgttcatcccctaaaggtctcactggaggatctttacaacggtacatctaagaagctttcactatcccgtaatgtactttgctccaagtgcaagggtaaagggtcgaagtcaggagcttcaatgaaatgtgccggatgccaagggtctggaatgaaagtgtcgattagacatttgggtccatctatgattcagcagatgcaacatccttgcaatgagtgcaagggaactggtgaggctattagcgacaaagaccgttgccctcagtgcaaaggagagaaggttgtgcaagaaaagaaggttcttgaagttgtcgttgagaagggtatgcaaaatggtcagaagattaccttcccaggagaggctgacgaagcaccggatactgtgacgggagatatagtttttgtggtgcaacaaaaggagcacccgaagttcaagaggaagggtgatgatctttttctcgaacacactctgtctctcactgaggcactctgtggcttccagttcattttgagtcatcttgataacaggcagcttctcattaaatctgaaccgggagaagtgatcaagcctgatcagttcaagggaataaacgacgaagggatgccgatgcatcagaggccgttcatgagagggaagttgtatatccacttcacagtagagtttccggattcgttgagtagcgagcagtgcaaggggttggagtcggtgttgccagccaggccatcaaaggtgataacggatatggagttggacgaatgcgaggagacgactctgcatgatgttaacatcgaggaagaaatgagaaggaaacaacaccaggccgcgcaagaggcgtacgacgaagatgacgacgatatgcatggtggcggggcccagagggtacaatgtgctcaacaatgatcgtcgcattcgcagtttctcgccagagaataacccgtccttattactgtcgtcatagtgttatgggattacatggggcaactttacggttgctgcaactttttcttaaattcgaattcaagtgtttttagtattttattatttggagtgcaagttacatttttcgagttgtttaagtactgtttggtttgttattatttcatgatatagctatta

SEQ ID NO: 8265 - DNA, 1535 bp, Carthamus tinctorius
  misc_feature (909)..(909): n is a, c, g, or t
  misc_feature (923)..(923): n is a, c, g, or t
  misc_feature (955)..(955): n is a, c, g, or t
  misc_feature (1003)..(1003): n is a, c, g, or t
  misc_feature (1037)..(1037): n is a, c, g, or t
  misc_feature (1086)..(1086): n is a, c, g, or t
  misc_feature (1088)..(1088): n is a, c, g, or t
  misc_feature (1100)..(1100): n is a, c, g, or t
  misc_feature (1105)..(1105): n is a, c, g, or t
  misc_feature (1107)..(1107): n is a, c, g, or t
cggggctcttctctcccgaaacagccgagtcaagtcttcccctttcgatctacttcgcagatttgtaatttaatattgaagatcgaagaagaagaagaagaagaggatgtttggaagggcaccgaagaagagcgataacactaagtactatgagatcctcggggtcccgaagaatgcgtcccaggacgatctaaagaaggcttataggaaggccgccattaagaatcatccggataagggtggagatcctgagaagtttaaagagctggcccaagcatatgaggtgctgagtgatacagagaagcgtgagatatatgatcagtatggtgaggatgccttaaaggaaggaatgggtggtggaggaggtggccatgacccctttgacatcttccaatccttctttggtggcaatccatttggaggtggtggcggtagcagcaggggccgaaggcaacgaaggggagaagatgtcattcatcctctaaaagtttctctcgaggatctatataatggaacttccaaaaaactgtctctttcacggaatgtaatatgctccaagtgtaagggcaaggggtcgaagtcaggtgcttcaatgaaatgtgctggctgtcaaggttctgggatgaaagtctctatcaggcatcttgggccatctatgatccagcaaatgcagcatccttgcaatgaatgcaaaggtactggggaaaccatcaatgataaggatcgctgcccacaatgcaagggtgagaaagtggtgcaagagaagaaggtgcttgaagttcatgtagagaagggcatgcagaatgggcagaagatcacattccctggagaggctgatgaagctcctgacacagttacaggtgatattgtatttgtcttgcaacaaaaggagcaccctaagtttaagcnaaagggtgacgacntatttgttgaacacacattgagcttaactgangcactgtgtgggttccagtttattttaacccatttggatagtagacancttctgatcaaatctcaacctggagaagttgttnagcctgatcaattcaaggccataaacgatgaagaatgcccatgtatcanangccatttatganggggnanttgtacatccacttcactgtggaattccctgactcattgtcaccggagcagtgcaaggcactggagactgtgctgccagctaggccttcaatgcagatgacagacatggagctggatgaatgcgaagagacaaccctgcatgatgtcaacattgaagaggagatgcgaaggaagcagcaagcagcccgagaagcctacgatgaagatgaagacatgcatggtggagcacaaagggtacaatgtgcacaacaatgattgaaggaagcatgtgttgctcgtctataggtggtcttggcaagacaataatatgatatatcagctgtaattttctttccttatactatctacttctactactagtactatgtgaaatggtcccttctgttttatgatgaaccttttgaagatgtatggatgatatttactcg

SEQ ID NO: 8266 - DNA, 1277 bp, Manihot esculenta
aatatgtttggcagagcacctaagaagagtgataacaccaggtactatgaaattttaggagtgtcgaagaacgcttcccaagatgatttgaagaaggcttacaagaaagccgctatcaagaatcatcctgataagggtggcgatcctgaaaagttcaaagagttggcccaggcttacgaagttttgagcgatccagagaaacgtgagatctacgataattatggtgaggatgcacttaaggaaggaatgggtggtggcggtggtggccataacccttttgacatatttgaatccttctttggtgggaacccatttggcggtggcagtagtcgaggaaggaggcagagacggggagacgatgtggttcatcccttgaaggtctctttggaagatctatatctcggtacaactaaaaagctttctctatcccgcaatgttatatgctcgaagtgcaatggtaaaggttcgaaatctggagcttcaatgaagtgccctggttgtcggggaactggtatgaaggtctcaataaggcagctgggcccttcaatgatccagcagatgcagcatccttgcaatgaatgtaagggtactggtgaatcaattagtgagaaggacaaatgcacgcaatgcaagggggagaaggttgttccagggaagaaagtgttggaagtcatagtagagaagggcatgcaacatgggcagaaaattacattccccggcgaagctgatgaagcgcctgataccatcacgggagatatagtttttgtccttcagcaaaaggaacatccaaaattcaagagaaagggggatgaccttattgtggagcagagtctatccctcactgaagctctttgtggctttcagtttgtattgacacacttggatgggaggcatcttcttataaaatcaaacactggggaagttgtcaagccagactcattcaaggcaattaatgatgagggtatgcccatgtaccaaaggccattcatgaaggggaagctgtacatccattttattgtggaattccctgattctttgaccccagatcaggttaaggcacttgaggcaattttgcctccaaggcccttcagtcagctgatggatatagacctggatgagtgcgaggagactaccctgcacgatgttaatatggaggaggaaatgagaaggaagcaacaggggcaggctcaacgggaggcatatgacgaggatgaggagatgcatggtggcgcacaaagggttcaatgtgcccagcagtgattgaactaacttcttct

SEQ ID NO: 8267 - DNA, 1519 bp, Curcuma longa
tgccgatccttctactataggggcctcgtttcgtgagaggagagacgggatccggtgattccgccttgcatctgtgggctatcgatcgatcgggcaaggttccgccgcggagatgttcgggagagcgccgaagaagagcgataatactcgatactacgaggtcttaggggtgcccaagagcgcatctcaggatgatctgaagaaggcgtaccggaaggctgccatcaagaaccaccccgacaagggcggcgaccccgagaagttcaaggaattggcccaggcttatgaagttttgagtgatcctgagaaacgtgagatctatgatcaatatggtgaagatgctttaaaggagggaatgagtggtggaggcggagggcatgatccatttgatatattccagtccttcttcggtggcagtccatttggaggaggaagcagcagaggacgaaggcagagaagaggggaggatgtcgtccatcctctcaaggtatccttagaagatctttacaatggaacttcgaagaaattgtcactctcacggaatgtgatctgccggaagtgcaatggcaagggttcgaaatctggtgcttccatgacatgccctgggtgtcatggctcaggtatgaaggtcagtattcgccaactggggcctggcatgattcagcaaatgcagcatccatgcagtgaatgcaagggaactggtgagaggatcaatgagaaggatcgctgctcagactgcaagggcgagaaagttgttcctgagaagaaagtgctggaggttgtagttgagaaaggaatgcaaaatggccagaagatttccttccacggcgaggccgacgaagcccctgatacgctcacaggagacattgtgtttgttctccaacaaaaggaacatcccaaattcatgcgaaagggcgaagatctcttttacgaacattcgttgtcgctgaccgaggctctttgtggtttccagtttgttttgaatcaccttgacggtagacagctacttatcaaatcaaacccaggggaagtcgtcaagcccgatcaaaacaaggcaataaatgatgagggcatgccgatccaccagaggcccttcatgaagggaaaactctacatccacttcactgtcgacttccctgattcactggcaccagctcagtcgaaagctctcgaggcggttctccctcctaagcctgcgtctcagttgatggacatggaactcgacgaatgcgaggagacaatattgcatgatgttaacatgaaggaggagatgcgacggaagcaagcgcaagcgcaagaagcttacgaagaggatgaggatgatctccatggaggcggccagagagtccagtgtgcccagcaataaacttgattagctatataacttttatcgacgtttggttgtgtgcccagtagtagtatcatggtcatccttttgaagtagttaaaggaaaacttatcgatcgaacaaatttcatatttcaataaagagtcattatcttgcctgccgatgccagtt

SEQ ID NO: 8268 - DNA, 1841 bp, Setaria italica
cttccagagcattcactccccaccacccgttcccacgctataactacccccgccgcctcctctctctcctcctcacaaaccgctcccgacccgcgaccacgcttcccgtcggatcaaacagctagggtttcggagggattctcctctctcgtcggcggcgagatgttcgggcgcgcgccgaagaagagcgacaacacgcggtactacgagatccttggcgtgcccaaggacgcgtcccaggatgacctcaagaaggcctaccgcaaggccgccatcaagaaccaccccgacaagggcggcgaccctgagaagttcaaggagctagctcaggcttatgaggtcctcagtgaccctgaaaagcgagagatttatgatcagtatggtgaggatgctctcaaggagggaatgggaggtggaggagggatgcatgatccattcgatatcttccaatccttctttggtggtggaagcccctttggaggtggtggtagcagtaggggcagaaggcagcgtaagggtgaggatgttgttcaccctctgaaggtttctctggatgaattgtacaacggcacctcaaagaagctctcactgtctcgcaatgtactctgctccaagtgcaatggcaagggctcaaagtctggagcttcatcgagatgtgctggttgccaaggctctggctataaggtccaaatccggcagctgggaccaggaatgatccagcaaatgcagcatccttgcaatgagtgcaagggtactggggagaccatcaacgacaaggacagatgcccacaatgcaagggtgagaaggtggtgcaggagaagaaggttctcgaggtggtggtcgagaagggcatgcagaatggccagaagattacattccctggtgaagctgatgaggcgccggatactgtcaccggagacatcatctttgtcctccagcagaaggagcatcccaagttcaagagaaagggcgatgacctcttctacgagcacactctgaccctgactgaatctctgtgtggcttccagtttgttctgacccacttggataacaggcagctgctcatcaaatcaaaccctggtgaagttgtcaagcctgattctttcaaggccatcaatgatgagggcatgcccatgtaccagaggcccttcatgaagggcaagctttacatccacttctctgtggagttccccgactctttgaacccggagcagtgcaaggccctggaggccgtcctccctcccaagccgacgtcgcagtacacggacatggagctggacgagtgtgaggagacgatgccgtatgacgtgaacatcgaggaggagctgcggaggcggcagcagcagcaccaggaggcctacgacgaggatgaggacatgcccggcggcgcgcagagggtgcaatgcgcccagcagtaggcgctgtagcaagatttggttgacggtggcggcaaatttgttgtttcgctatgtgcgagtatgcgagtagtactgttggggtcctaagttttcccgcgtattatgtggtactttcggttataaaaatacaatattttatccgtggagcgggagttttgctggttctgttgcaaatagttggctggcgaggcgatggtttgccctttcctttttttcgcccccttgtggagaatagccagccatggcctggctgaacaataagaaacaagacccttgtcgagtcgacggggtttgtgagtggggtttgggcgtttggtgtatttttagttcggtgacgtgactgaccaacggggtttacactgaactaacctgttgagctgaaaatcaacaggttagaatagggcttcgctatatttcgattt

SEQ ID NO: 8269 - DNA, 1742 bp, Zea mays
caccctcctgcagcttccagagcattcactctccaccacccgtcccgacgatataaactagcccccgctctctctcctcacaaacttcccctgtcacgagagtacgagaccacgccttccgtgggatcaatcggctagggtttcggagatgttcggccgcgcgccgaagaagagcgacaacacccggtactacgagatcctgggggtttccaaggacgcgtcacaggatgacctcaagaaggcctaccgcaaggccgccatcaagaaccaccccgacaagggcggcgaccccgagaagttcaaggagctagctcaggcttatgaggtcctcagcgaccctgaaaagagagagatctatgaccagtatggcgaggatgccctcaaggagggaatgggaggcggtggtgggatgcatgatccctttgacatattccagtcattctttggtggtggaagcccttttggaggtggcagcagtaggggcagaaggcaacgacggggagatgatgtggttcatcctctgaaggtttctctggaggatttgtacaatggcacatcaaagaagctctctctgtcccgcaatgtcctctgctccaagtgcaatggtaagggttccaagtctggagcttcgtcgaggtgtgctggttgtcaaggttctggcttcaaggtccaaatccggcagttgggacctggaatgattcagcaaatgcagcatccttgcaatgagtgcaagggttctggagagaccatcagcgataaggatagatgcccacaatgcaaaggtgataaagttgtgccggagaagaaagttcttgaagtggtagttgagaaaggtatgcagaacgggcagaagatcacattccctggcgaagctgatgaagcgcctgatactgccactggagatatcatctttgttctccagcagaaggagcatcccaagttcaagagaaagggcgatgacctcttctacgagcacacactgatcttgactgaatctctgtgtggcttccagtttgttctgactcacttggataacaggcagctgctgatcaaatcgaaccctggcgaagttgtgaagcctgattctttcaaggcaatcaacgatgaaggcatgcccatgtatcagaggcccttcatgaagggcaagctgtacatccacttctcggtggagttcccggactcgttgagcccggagcagtgcaaggccctggaggctgttctcccgcccaagccagtatcacagtacactgacatggagctggacgagtgcgaggagacaatgacgtacgacgtgaacatcgaagaggagatgcggaggcggcagcagcagcaccaggaggcctacgacgaggatgatgatgtgccaggcggtgggcagagggtgcagtgcgcccagcagtaggcagcttgcggcaagtctacccgcttgtattggcctgatgatacttcggttacaagagtgcagtattcgatctgttagttcaagttctgcgtttggggtgttagatccaccagaattagatttgttcggcaagctacgctcgaatacacgtcatgtttggagtatctttatgggtgctctaaagacgcgtatctcatagaagatatactctaaagttgtatcttatagaagaaattttttgggtgtttggtatagctccagaggctagaactaatatttgctatatgaacttcgggtctaaacttggcctgtgaagatgtccatgtagcttggggaaaaa

SEQ ID NO: 8270 - DNA, 1542 bp, Zea mays
agccactcgcccccgcctcttgcagcttccagcgcattcactcccgaccaccagtcccgatgctataactaccctcgttgttctatctcctcctcacaaacctctcctggcacgagatcacgcttctcgttggatcgaacagctagggtttccaagatgttcgggcgcgcgccgaagaagagcgacaacacacggtactacgagatcctcggggtctccaaggacgcgtcccaggatgacctcaagaaagcctaccgcaaggccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctaaaggtttctctggaggatttgtacaatggcacatcaaagaagctctctctgtcccgcagtgtcctctgctccaagtgcaatggtaagggttcaaagtctggagcttcatcgaggtgtgctggttgccaaggttctggctttaaggtccaaatccggcagttggggcctggaatgatccagcaaatgcagcatccttgcaacgagtgcaagggttctggagagacaatcagcgacaaggatagatgcccacagtgcaagggtgataaagttgtgcaggagaagaaggttcttgaagtgtttgtggagaaaggcatgcagaatgggcagaagatcacattccctggtgaagctgatgaagcgcctgacactgtcactggagatatcatttttgttctccagcagaaggagcatcccaagttcaagagaaagggcgatgacctcttctacgagcacaccctgaccttgactgaatctctgtgtggcttccagtttgttgtgactcacttggataacaggcagctgctgatcaaatcaaatccgggcgaagttgtgaagcctgattctttcaaggcgatcaacgacgaaggcatgcccatgtaccagaggccgttcatgaagggcaagctgtacatccacttctcggtggagttcccggactcgctgagcccggagcagtgcaaggccctggaggctgtgctcccgcccaagccggtgtcgcagtacaccgacatggagctggacgagtgcgaggagacgatgccctatgacgtgaacatcgaagcggagatgcggaggcggcagcagcagcaccaggaggcctacgacgaggatgaggacatgccgggcggcgcgcagagggtgcagtgcgcccagcagtaggcagcagcttggtagcagtgataaaatatttgacggcggcggaaaaatttgtgcgactactgttaggtccaaccgtccaattttacacgcgcgtattaatgttatgatcatacttgtctttgtttatta

SEQ ID NO: 8271 - DNA, 1690 bp, Momordica charantia
tctctacctcgccgtctcgagcgtacccttttggttctctgctctcaggtcaccgatctctaccggatcctttcaatcttcaagatctcccttttcgttcttcccagggtttctcagatccgatcggtgagggaaacatgtttggaaggcccaagaagagcgataacaccaagtactatgagattctcggagtctcgaagaacgcgtcgcaagacgatctaaagaaggcttatagaaaggccgctatcaagaatcatcctgataagggtggcgaccccgaaaaattcaaggagttggcccaagcatatgaagtgctgagtgatccagagaaacgtgagatatatgaccaatatggcgaggatgccctcaaggaaggaatgggtggtggcggtggtcacgatccattcgacatattccagtctttctttggtggaagcccatttggcggtggtggaagcagcagaggccgaaggcaaagaaggggagaggatgtcatccatcccctcaaggtctcgttggaagatctttacaatggaacttcaaagaagctctctctttcccgcaatgtaatttgctcgaagtgcaagggtaagggctctaaatctggtgcttcaatgaaatgtcctggctgtcaaggatctggtatgaaagtctccattagacaccttggcccgtctatgatccaacaaatgcagcatccttgcaatgactgcaaggggactggcgagaccatcaatgataaagatcgttgctcacagtgcaagggtgaaaaggttgttcaggagaagaaagttttggaagtaattgtggagaagggtatgcaaaatggacaaaaaattacatttcctggggaagcagacgaagtgcccgacactcttactggggatatcgttttcgtcctacaacaaaaagagaacgccaaatttaagagaaagggtgatgacctctttgtggagcataccttgtctctcgtggagtcgctttgtggtttccaattcattctgactcatttggatagccgtcagctactcatcaaatcccttcccggtgaagtagtaaagcctgaccaattcaaggccataaatgatgagggcatgccaatgtaccagaggccattcatgaagggcaaactttacatccatttcagtgtggacttcccagactccttgaaccccgatcagtgcaaggcgctggagggtgtgctgcccccgaggacttcggtgcagctgtcggatatggagttggatgaatgcgaggaaaccactatccacgacgtgaacatcgaagaggagatgcgcaggaagcaagtacaagaggcatatgatgaagacgatgacatgcacggcggagcccagagagtgcagtgtgctcaacaatgatcttgaatggggctccacagcagtgcaatggtttggacatgagaattttcagagagaagaccccatatggagatcagatcagcacccaccaagccaagccagtcgtccaaattttctcaaaataaatagatgaattttattatgttaattcagtcggtagggttacgaagtaagttttccggattattatttttaaaaatgtttttgctgttctatgtgtttgctgctagctaagcttaccaagaattcaaagatttatgtattggagttgccagataaaataggattgggaaacagaaagatctctgctt

SEQ ID NO: 8272 - DNA, 1544 bp, Solanum lycopersicum
cacccttctcctcctcattctccttcttctctaacacctaaagacctaatcttctcgacgaagattcctatctgttgaaagatgtttgggagagcaccgaagaagagtgataacactaagtactatgagatcttgggagtgcctaatactgcttcaccagatgatttgaagaaagcttatcgtaaagctgctattaagaatcatcctgataagggtggtgatcctgaaaaattcaaggagattgcccaagcctatgaggtcttgaatgaccctgagaaacgtgagatctatgatcagtatggtgaagatgctctcaaggaaggaatgggtggtggaggtggtggacacgacccgtttgacatattccagtcattctttggtggaggcgggtttggtggtggtggaagcagcagaggaagaaggcaaaggagaggggaggatgttgtccaccctctcaaggtctctttggaggatctttacaatggaatatcaaagaagctatcactatctcgcaatgtgttgtgctcaaagtgcaagggggtagggtctaaatcaggtgcttcattgaaatgtcctggatgtcaagggaaaggaatgaaagtttcaatcagacaacttggccccatgatccagcagatgcagcacccatgtaatgagtgtaggggtactggtgagaaaataaacgataaagacaggtgtccacagtgcaagggcgagaaagttgtgcaggagaagaaggtgttggaagttgttgtggataagggtatgcaaaatggacaaaagataacatttccaggagaggctgatgaggagcctgatactgtcactggagacattgtttttatcttgcaacagaaggaacatcccaagtttaagcgaaagggagatgatctctttgtagaacacaccttgaccttgactgaggctctctgtggttttcagtttgtcttgactcacctagataatagacagctgataatcaagtcccaacctggagaagttgtcaagcctgatcaatttaaggccataaatgatgaaggcatgccaatgtaccaaaggccattcatgaaaggtaaactgtacattcacttcaccgtggacttccccaacacattaaccccagagttgtgcaagaatcttgaagcagtgctgccagcaaggcctaaaacacaagcgtccgatatggaattggacgagtgcgaggaaaccaccttgcatgacgtgaacattgatgaggagatgcgtaggaagcagcagcaacaggcccaagaggcatatgacgaagatgacgacgatatgcatggtggtgcacagagagtgcaatgtgcacaacagtaatttgatactctctttttcggtagatagcagtacttaatttcgtcaagtatatcaatctccctgttcttgggtttgataatagggctgatataagaattgacagtcaggaacaacattgctctagtaggagatatagattattactattgactttgaaattttatttatgcataaaactgtgagcaaaattttgtgacctgggatta

SEQ ID NO: 8273 - DNA, 1636 bp, Hevea brasiliensis
gtttctgggggctctctgtagacaaacctaacaatcggatcttttactgataaaggcaaggagagaagatgtttggaagagcacccaaaaaaagcgataacaccaagtactatgagattcttggggtctcaaagaacgcttcacaggatgatctaaagaaggcttatagaaaagctgccatcaagaaccatcctgacaagggtggtgatcctgaaaagtttaaagagttggcccaagcttatgaggttttgagtgatccagagaaacgtgagatatatgatcaatatggagaggacgccctcaaggagggaatgggcagtggaggtggtgctcatgacccatttgacattttccaatccttctttggtggcaacccatttggtggtggtggtagcagcagaggccgtaggcagaggaggggagaggatgttatccatcctctcaaggtttctttggaagatctctacaatggcacctcaaagaagctgtctctttcccgtaatgttatctgctcaaagtgcaaaggtaaagggtccaaatcaggtgcatcaatgaaatgttcgggttgccaaggttctggaatgaaggtctccataagacaacttggtccctctatgatccagcaaatgcagcatccttgtaatgaatgtaagggtactggtgagaccattaatgataaggatcgttgccctcaatgtaaaggtgaaaaggttgttcaggagaagaaagtgctggaagttattgttgagaagggtatgcaaaatggacagaggattactttccctggagaagctgatgaagctcctgatactattacaggggacattgtttttgtccttcagcaaaaggagcatcctaagttcaagcgaaagggtgatgacctaattgttgatcacactttatctcttacagaggcactttgtggcttccagtttatattaacccatttagatggaagacaactcctcataaaatcccaacctggggaggtagtgaagcctgatcaattcaaggccataaatgatgaagggatgccaatgtatcagaggccattcatgagggggaaactgtacctattcatttcagtgttgatttcccagactctctgccccctgatcagtgcaaagccctagaggcagttcttccctcaagaacatcagtccagctgtctgacatggagctggatgaatgtgaggagacaactttacacgatgtgaactttgacgaggagatgcgaaggaagcaacaacaggcccaagaggcatatgatgaagatgatgatatgcatggtggtggccagagggtgcaatgtgctcagcaataaattaacaaaacgagatcatctgaattagcaccaggatcgattgatgttggtttgactgatggtttgcgagtataagattctgaaacattcattgtcttctgttataggattttagacttttagctgttatgggatttcacttttgtttgcaaagataatgtatgcaagatctagtatctggaacttaaaagattgccatgttcaagaatgtttctacgtggttttttattattttttttggtataatctggattgtttgtttgcggtgtagttctttggtatgtttgcatttctgcactgactcctgaacct

SEQ ID NO: 8274 - DNA, 1625 bp, Avena sativa
gccccacccacccacgcaggtgaggccagcggcggcgcgcgaggagggtagcggctagccccaccaccgccggcgaagatgttcggccgcgcgcccaagaagagcgacaacaccaagtactacgagatcctcggggtgcccaagaccgccgccccggacgagctcaagaaggcctaccgcaaggccgccatcaagaaccaccccgacaagggcggcgaccccgagaagttcaaggagcttgcacaagcttatgaggttttgagtgaccctgagaagcgtgagatctatgatcagtatggtgaagatgctctcaaggaaggaatgggagggggaggaggtggagttgatccatttgacatcttctcatcattctttgggccctcttttggaggtggtggtggtggcagcagcaggggcagaaggcaaaggaggggagaggatgttgttcatccactgaaagcttctctagaagatctttacaatggtacctcaaagaagctctctctttcccgtagtgtcctctgctccaagtgcaagggcaagggctccaagtctggtgcttccatgaggtgcccaggttgccagggttcaggcatgaaagtcactatccgccagctggggccttccatgatacagcagatgcagcagccttgcaatgagtgcaggggcactggagagagtattaatgacaaggatcgctgcccaggctgcaagggtgagaaggttcttcaggagaagaaggttctggaggttcatgttgagaaggggatgcaacacaaccagaagatcaccttccctggagaagctgatgaagcgcctgatactgttactggagacattgtattcgtcgtccagcagaaggaacacccaaagttcaagcggaagggcgatgatctcttctatgagcacaccatatctctcactgaagctctctgtgggttccaacttgttctgacccatctggacaacaggcagctgctcatcaagtcgaaccctggtgaagttgttaagcctgattcattcaaggcaatcagtgacgagggaatgccgatgtaccagaggcctttcatgaagggcaagctctacattcatttcaccgtagacttccccgactcgctggcacctgaccagtgcaaggctctcgaggccgtgcttccaccaaagcccgcgtccaagctgactgacatggagcttgatgaatgcgaggagacaacaatgcatgatgtgaacaacatcgaggaggagatgcgcaggaaagctgcccatgctgctcaggaggcgtacgacgaggacgatgagatgcctggaggtggtgggcaaagagtgcagtgcgcacagcagtaagcaagcgcgagtacattgtctaggaactcgtcattgctgcgcataatcatatgatggcagcaaggttttttggacctaagaatgcccgatctcttgctttgggggtggtgttgatgaagctgatttaggggcgtatggcgccaggactgtatcttccttgccttttgctgtagtatggtactcgtagtaagagtgcttcctataatggtaatatgtttgtggaaactacaatctacgctgtctgaatatgtttgtctaaacgatacgtttgtggttttttt

SEQ ID NO: 8275 - DNA, 1770 bp, Panicum virgatum
gctcggccaccagctttgaccgcctcctccgctcccctccgctcctgctcctccccatcccactcccccgcaggagcggcggcggcggcggcggctaggcgtaccccccacctcggcgagcggcaccggcggcggcaaaggcaagatgttcgggcgcgcgccgaagaagagcgacaacaccaagtactacgagatcctcggggtgcccaagtccgcgtcccaggacgacctcaagaaggcctaccgcaaggccgccatcaagaaccaccccgacaagggcggcgaccccgagaagttcaaggagcttgcacaagcttatgaggttttgagtgacccagagaagcgtgagatttatgatcagtatggtgaagatgccctcaaggaaggaatgggtggaggaggagcccatgtagatccatttgacatcttctcatcattctttgggccctctttcggaggaggtggtggcagcagcagaggcagaaggcaaaggaggggagaagatgttgtgcacccacttaaagtttctctagaggatctttacaatggtacctcaaagaagctctcgctttcgcgtagtgtcatctgctcgaagtgcaagggcaagggctccaagtctggtgcttcaatgaggtgcccaggttgccagggttcaggtatgaaggtcaccatccgccagctgggtccttccatgatacagcagatgcagacggcttgcaatgagtgcaaggggactggagagagcatcaatgagaaggatcgctgcccagggtgcaagggtgagaaggttgttcaggagaagaaggttctggaagttcacgttgagaaggggatgcagcacaaccagaagatcactttccctggtgaagctgatgaagcgcctgatactgtcactggagacattgtattcgtcctccagcagaaggatcactccaaattcaagagaaagggcgatgatctcttttatgagcacaccttgtctctgactgaggctctctgtgggttccaatttgttcttacacatctggacaacaggcaacttctcatcaagtcaaaccctggtgaagttgttaagcctgaccaattcaaggcgataaatgacgaggggatgccaatgtaccagaggcctttcatgaaggggaaactctacattcacttcacggtagagttcccagactcgctggcgccagagcagtgcaaggctcttgaggcgttacttccaccgaagcctacatccaagctgacagacatggagatagacgagtgcgaggagactactatgcatgacgtgaacaacatcgaggaagagatgcgcaggaggcaagctcattctgcccaggaggcgtacgaggaggatgacgagatgcctggaggagcccaaagagtgcaatgtgcacaacagtaagcagagcacattatcatcaagtgacttcgcacacgtgtagtaatctgcaaggtttgtggtggactttttggacccagggtgatctctctggttttgtcgtcggagttatgaaacagaggaagctgattctgattctaccccgctggggggcggggaatgtatcctttttgctgcaactgaaaaatgctacccaggcgtagctggtggctacttttaactgttttgtgagacttggtagggtgcttttctatataggcaacttaatgcttgttgcgtgctacagtatgatggcgcccattcgaaagcaatgactctcaagtatcttatatcgaactagatgctctttaatcgtgtgacaaagctac

SEQ ID NO: 8276 - DNA, 1861 bp, Valeriana officinalis
aaccgtacgcgacgctcggctcgcgatcggctctccaactacaaacctagttgctgatggtacgtaagaagatgtagagagggaaaatagaagatgaatatccgttttgttgggggtattattctagcctggtttgtgcaatatattgcaagtaaggaggaggaacattaaggatgctttctcaaactacaaatctctaccatccactaatttctcttcacaaacaaaccacacggatctcagatcaatcttcaattttccatcacttctcttaattctgattgagcaattgaagatcgaacaagatgtttggaagagcaccaaagaagagcgataataccaagtattatgagatcttgggagtttctaagaacgcttctcaggatgatctgaaaaaagcttatcgtaaagctgctattaaaaaccatcctgataaaggcggtgatcctgagaagttcaaagagcttgctcaagcttacgaagttctaagcgatcctgagaaacgtgaagtctatgatacctacggtgaggatgctcttaaggaaggaatgggcggcggcggaggtggccatgacccatttgatattttccaatccttctttggcggtggcaacccatttggcggtggtagtggtggtggcagcagcagaggaagaaggcagagaaggggtgaggatgtcgttcatcctctgaaagtttctctcgaggatctctacaatggaacttccaagaagctttcgctttctcgtaacgtcctctgctccaagtgcaaaggaaagggatcaaaatctggtgcctcaatgaaatgtgccggttgtcaaggatctggtatgaaagtatcgattagacacttgggaccgtctatgatccaacagatgcaacatccttgtaacgactgtaagggtaccggtgagactattaacgacaaggatcgttgtccacaatgcaagggtgaaaaagtcgttcaagagaaaaaggttttggaagtccatgttgaaaagggtatgcagaatggacagaagatcactttccccggcgaggctgatgaagctccggatacggtgacaggggacatagtgtttgtcttgcaacagaaagagcacccgaaattcaagcgaaagggagaagacctatttgtcgagtacactctgactctgacggaagctctctgcggcttccagtttatcttgactcatctcgacaacaggcagcttcttatcaaatctcaacccggagaagttatcaagccagatcaattcaaggcaataaacgatgaagggatgccgctatacaacaggccgttcatgagaggcaagctatacatacacttcagcgtagatttcccagattctttaaccccggagcagtgcaaggccttggaagctgttcttccagctaaaccgtcgacgcagatgactgacatggagctggacgaatgcgaagagacaactcttcacgatgtcaacatagaagaagagatgcgccgtaagcaacaggctgctcaagaagcttacgatgaggatgatgacatgcatggtgcaggaggccagagagtccagtgtgctcaacagtaatcgatattttgtcagacctgacaataaattgtcgttttatatctctctatatatttagtgtccttctaggtaattgttgttagttttgggtcttttcttaatgtttttgaaacattttggtcctccttgttgacaattcaaactatttgatgagggcttatcccggttatatataagatgcatttgctttgcttttgtgtgttattcaaacttgcttcttgtgaaatctgctgtattaatgtggctgtttaaaagttcttaacatcaaaagtctgaagttgttaaag

SEQ ID NO: 8277 - DNA, 1507 bp, Cichorium intybus
gggcgacacacccgagtcagtcttccgatttcgatctcttttctgatctgcttcttcgctgatttgtaattagatattaaggatcgaagaagagaacaggatgtttggaagagcgccgaagaagagcgataatacgaagtactatgagatcctcggggtccccaaaaatgcttcccaggacgatctcaagaaagcttacaggaaagccgccattaagaatcatcctgacaagggtggagatcctgagaagttcaaagagcttgcccaagcatacgaggtactgagtgacccagagaagcgtgagatatatgatcagtatggtgaggatgcgttgaaggaaggaatgggcggtggaggtggtggtcatgatccttttgacatcttccaatctttctttggtggtggtaatccttttggaggtggtggtggtagcagcaggggacgtaggcaacgaaggggcgaagatgtcattcatcctcttaaagtttctctcgaagacctctacaatggaacatccaaaaaactatctctttcccgtaatgtcctctgctccaagtgtaagggtaagggttcaaagtcaggtgcttcaatgaagtgtgcgggctgtcaaggttccggaatgaaagtatccatcagacatctgggcccgtctatgatccaacaaatgcaacatccttgtaacgagtgcaagggcactggtgaaaccatcaacgataaagaccgttgcccacagtgcaagggtgagaaagttgttcaagaaaagaaggttctagaagtccacgtggaaaagggcatgcagaattcccaaaagatcaccttccctggtgaagccgatgaagctcctgacacggttactggagatattgtgtttgtgttacaacaaaaggaacaccctaagtttaaacgaaagggtgatgacttgtttgttgaacacacattgagtttaaccgaagctctgtgtgggttccagtttattttaactcatttggacaacagacagcttctgattaaatctcaacctggggaggttgtcaagcctgatcaatttaaggcgataaatgatgaagggatgccgatgtatcagaggccgtttatgaaggggaagttgtacattcactttactgttgagtttccagaatctttgtctcctgaacagtgtaaggcattggagggagtgctgccagctaggccagcaatgcagatgacggatatggagttggatgaatgtgaggagacaactcttcatgatgtcaacattgaagaggaaatgaggaggaaacagcagcaacaagctcaagaagcttatgatgaagatgatgacatgccaggtggagcacagagggtgcaatgtgctcacaatgaggtggatgtttggctatatctatgatgacaataatgtcagctggattttcttttttatatacttgctaaatttgtctgtttgtatggagaccctttgagatgtatggatgataagtttaactcatctgcaaaactggtgggggct

SEQ ID NO: 8278 - DNA, 1812 bp, Euonymus alatus
gacctacctcgtgtggctgaagtcaacaaataaacgcttctacctcaggcgactcgctgacattcaatctccaccgtccataccctccaataaatactcagatctcagacatagttatccctctttcagatcattcgccgtctcgtggtggtgttctctttctgtggctctctgcaaccaaacaaagatcgtaattttaatcgaagagagagaaagatgtttgggagacagcctaagaagagcgacaacaccaagtactatgaggtccttggggtctcgaagaacgcatccccagatgatctcaagaaagcttatcgtaaagcagctatcaagaaccatcccgacaagggtggtgatcctgagaagtttaaggagctggcacaagcatatgaagttctgagcgacccagagaaacgtgacatatatgatcaatatggagaggatgctctcaaggaaggaatggggggtggtggcggaggccatgatccatttgacatcttttcttcgttctttggtggcagcccatttggcggtggtggaagcagtagaggaagaagacagaggaggggtgaggacgttacacatcccctaaaggtgtccttggaagatctttacaatgggacatcaaagaagttgtccctctctcgcaatgtcatctgctctaagtgcaagggcaaagggtctaagtcaggtgcgtcaatgaagtgttctggctgtcatggttctgggatgaaggtctccatcagacagcttggtccttcaatgattcagcagatgcaacatccttgcaacgaatgtaagggtaccggtgagatgatcaatgataaggatcgttgccctcagtgcaaaggtgagaaggtcatgcaagagaagaaagtgttggaagtcgtcgtggaaaagggtatgcaaaatgggcagaagattacattccctggagaagctgatgaggcgccggacactgtcactggggacattgtttttgtcctacaacagaaggtgcatccaaaattcaagcgaaagggtgatgatctatttgttgaacatacattgtctctcacagaggcgctatgtggcttccaattcattatcactcatttggatggaaggcagcttatcatcaaaacccaacctggtgaagttgtaaagcctgaccaattcaaggccataaatgatgaaggaatgccaatgtaccaaagaccattcatgaagggcaaattgtacattcatttcactgttgaattccctgacacactcaccgtggagcagtgcaaggctctggagactgttcttcctccaaggacctcgacgcagttgactgacatggagcttgaagaatgtgaggaaactacactgcatcatgtgaacatcgaggaggagatgcggaggaaagagcagcaacgtgcacaagaggcttatgatgaggatgaagagatgcctggtggtgcacagagagtccaatgtgctcagcaataatgggaactcaagagtggaagtgacttggatacatgatgtttaagataataagcttcttaactttgattgcttttcattgtaggatatggtgtgctagttcatggttttggactaaggggtttgaaactcgtaaacgcgcgaaaagatttaattaacagtttggactgttagcacaagtttataattgtgtcattgattcttgcattctattatttgaagttgaggaaatgttctttctttgtctttcagtgggatgcctgattagttatcaactccttttggaggtgataccaaaaaatttgtatattgcttgtatggtttatgaagattgagttcttt

SEQ ID NO: 8279 - DNA, 1768 bp, Euonymus alatus
aatcgtgtcgctgaaggcaataaaaataaatgtttttccctctgacgagtcactgacagccaatctcaaccgtccattgtctcccttaaatatcaagatctgaaatcttattgcccctctttcgatcactcgtcctctcgcgttgctctgtctctttctctctctgtggttctctgcaaccgaaccaagggatctgatagttgattggttagtaattgtaatcggagggagacaaagatgtttgggagagcgcctaagaagagcgacaacaccaagtactatgagatccttggggtctcgaagaacgcatcccaagatgatctcaagaaggcttatcggaaagcagctatcaagaaccatccggacaagggtggtgatcctgagaagtttaaggagctggcacaagcatatgaggttttgagcgacccagagaaacgtgatatatatgatcaatatggcgaggatgctctcaaagaaggaatgggtggtggtggtggtgcccatgacccatttgacatattctcttcattctttggtggcagcccatttggtggtggtggaagcagtaggggaagaaggcagaggagaggtgaggatgttatccatcccctaaaggtgtcgttggaagatctttacaatgggacttcaaagaagttgtccctctctcgcaatgttatctgctctaagtgcaaaggcaaagggtctaagtcaggtgcatcaatgaaatgttctggctgtcaaggttctgggatgaaggtctccattagacaccttggtccttcaatgattcagcagatgcaacatgcttgcaatgaatgtaagggtaccggtgaaatgatcaatgataaggatcgttgccctcagtgcaagggtgagaaggtcatgcaggagaagaaagtgttggaagttgttgtggaaaagggtatgcaaaatgggcaaaagattacattccctggagaagctgatgaggcacccgataccgtcactggggacattgtttttgtcctacaacagaaggagcatccaaaattcaagcgaaagggtgatgatctatttgttgaacatacattgtctctcacagaggcactgtgtggcttccacttcattattacccatttggatggaagacagcttatcattaaatcccaatccggtgaagttgttaagcctgaccaattcaaggccataaacgatgaaggaatgccaatgtaccaaagacctttcatgaagggcaaattatacattcatttcactgttgacttcccggacacacttgccccagagcagtgcaaggctctggaggctgttcttcctccaaggacctcaacattgttgactgatatggagctagaagaatgtgaagaaactacaatgcaagatgtgaacattgaggaggagatgcggaggaaagagcagcaacgtgcacaagaggcatatgatgaggatgaagacatgcatggtggtgcacaaaaagtccaatgtgctcagcaatagtgggaactcaactactcaagagtggaagtgactcgcatctgagagggatgaagcaccctggactcctcgctgtttaagagaataatcttctgaactttcattgtaggatataatatgtggtgtgctagttgataattttggactttcgattgttttgaactcgtaaatgtatgtcaagatttaattgacatttattcttggtggttctatacttctatatgaagtggaggcacagctcccacataaggtttgcgtataatttgttaagtggagg

SEQ ID NO: 8280 - DNA, 1685 bp, Euonymus alatus
ctctttcagatcatttgccgtctcgtggtggtgttctctttctgtggctctctgcaaccaaacaaagatcgtaattttaatcgaagagagagaaagatgtttgggagacagcctaagaagagcgacaacaccaagtactatgaggtccttggggtctcgaagaacgcatccccagatgatctcaagaaagcttatcgtaaagcagctatcaagaaccatcccgacaagggtggtgatcctgagaagtttaaggagctggcacaagcatatgaagttctgagcgacccagagaaacgtgacatatatgatcaatatggcgaggatgctctcaaggaaggaatggggggtggtggcggaggccatgatccatttgacatcttttcttcattctttggtggcagcccatttggcggtggtggaagcagtagaggaagaagacagaggaggggtgaggatgttacacatcccctaaaggtgtccttggaagatctttacaatgggacatcaaagaagttgtccctctctcgcaatatcatctgctctaagtgcaagggcaaagggtctaagtcaggtgcgtcaatgaagtgttctggctgtcatggttctgggatgaaggtctccatcagacagcttggtccttcaatgattcagcagatgcaacatccttgcaacgaatgtaagggtaccggtgagatgatcaatgataaggatcgttgccctcagtgcaaaggtgagaaggtcatgcaagagaagaaagtgttggaagtcgtcgtggaaaagggtatgcaaaatgggcagaagattacattccctggagaagctgatgaggcgccggacactgtcactggggacattgtttttgtcctacaacagaaggtgcatccaaaattcaagcgaaagggtgatgatctatttgttgaacatacattgtctctcacagaggcgctatgtggcttccaattcattatcactcatttggatggaaggcagcttatcatcaaaacccaacctggtgaagttgtaaagcctgaccaattcaaggccataaatgatgaaggaatgccaatgtaccaaagaccattcatgaagggcaaattgtacattcatttcactgttgaattccctgacacactcaccgtggagcagtgcaaggctctggagactgttcttcctccaaggacctcgacgcagttgactgacatggagctagaagaatgtgaggaaactacactgcatcatgtgaacatcgaggaggagatgcggaggaaagagcagcaacgtgcacaagaggcttatgatgaggatgaagagatgcctggtggtgcacagagagtccaatgtgctcagcaataatgggaactcaagagtggaagtgacttggatccttgctgtttaagataataagcttcttaactttgattgcttttcattgtaggatatggtgttctagttcatggttttggactaaggggtttgaaactcgtaaacgcgcgaaaagatttaattaacagtttggactgttagaacaagtttataattgtgtcattgattcttgcattctattatttgaagttgaggaaatgttctttctctgtctttcagtgggatgcctgattagttatcaactccttttggaggtgatatcaaaaaatttgtatattgcttgtatggtttatgaagattga

SEQ ID NO: 8281 - DNA, 1544 bp, Actinidia deliciosa
  misc_feature (886)..(886): n is a, c, g, or t
  misc_feature (1000)..(1000): n is a, c, g, or t
  misc_feature (1024)..(1024): n is a, c, g, or t
  misc_feature (1048)..(1048): n is a, c, g, or t
  misc_feature (1102)..(1102): n is a, c, g, or t
  misc_feature (1114)..(1114): n is a, c, g, or t
  misc_feature (1439)..(1439): n is a, c, g, or t
  misc_feature (1456)..(1456): n is a, c, g, or t
ctctctcctctctatccgagttccatctctctctctctagctacgaacattttctctgcgcaagtagtgatttgtatagattagggttgtgatcggtacaaattttgggtgagagaagggattgaagaacatgtttagaagaggagcgaagaagagcgacaatacgaagtactatgacgtgttgggggtgtcgaaggacgcgactcaggaggatctgaagaaggcgtatcggaaagccgccatcaagaaccatcctgacaagggtggtgaccctgagaagtttaaggagcttgctcaggcatacgaggtgctgagtgaccctgagaagcgtgagatctatgatcaatatggcgaggatgcactcaaggaaggaatgggcggtggtggtggcatgcacgacccattcgacatcttccaatccttctttggcggtgggaatccatttggaggtggtggcagtagcagaggacgaaggcagaggaggggagaagatgtagtccatcccttgaaggtctctcttgaggacttgtacattgggatctcgaagaagctctctctgtctcgaaatgtcatttgttcgaaatgcaatgggaaaggttcaaaatctggaaattcaatgaaatgtactggctgccaaggaagtggaatgaaggtcacgattaggcaactcggacccggaatgatccagcagatgcagcacccttgcaatgaatgcaagggaactggagagagcatcaatgaaaaggatcgatgccctctgtgcaaaggtgagaaagttgttcaggagaagaaggtgcttgaagtcattgtggaaaagggcatgcagaatgggcagaaaatcacattccccggcgaggctgatgaagcgcctgatacaatcactggngacatagtgtttgtcctccaacaaaaagaacatccgaagttcaagagaaagggtgatgacctcttcatggagcacaccttgtctctggttgaggctctatgcggtttccggttnattttgactcacttggatggcagncagctccttataaaatcggacccnggggaagttgtcaagcctgatcaatttaaggcaataaacgatgagggtatgccngtgtaccagagngcattcatgaaggggaagctgtacattcatttcactgtggatttcccggattctcttgacccagatcaaattaaagcactgcaggctgtgttaccgccaaggccatcaatgcaactgtcggacatggagctagacgagtgtgaggagaccacattgcatgatgtcaacatggaggaggagatgcgaaggaagcaagcacaagctcaggaggcttatgatgaggatgaggatatgcgtggtggaggtcagagagtgcaatgtgctcagcagtgatgacctgaatgtttttagcataacttgtatgaagttgtctatgcatggaggncttgagagagatcaatncttccaagtgttcgtttaacattttgttacaagattactactttgtttgcttgaagtctatgcttttccctcttttaaaaaaaaaaaa

SEQ ID NO: 8282 - DNA, 1521 bp, Panicum virgatum
aaaccgctcccgacccgcgagctcgccccctgccggatcgaacagctagggtttcggaggaggaagaagcgcgcggcgacgagatgttcgggcgcgcgccgaagaagagcgacaacacgcggtactacgagatcctcggcgtgcccaaggacgcgtcccaggatgacctcaagaaggcctaccgcaaggccgccatcaagaaccaccccgacaagggcggggaccctgagaagttcaaggagctagctcaggcttatgaggtcctcagtgatcctgaaaagcgcgagatttatgatcagtatggtgaggatgccctcaaggagggaatgggaggtggaggagggatgcatgacccatttgatatcttccaatccttctttggtggtggaagcccctttggaggtggtggtagcagtaggggcaggaggcagcgtaggggtgaagatgttgttcaccctctgaaggtttctctggaggaattgtacaatggcacctcgaagaagctctcactgtcgcgcaatgtactctgctccaagtgcaatggcaagggctcaaagtctggagcttcatcaaggtgtgctggttgccaaggctctgggtataaggtccaaatccggcagctgggaccaggaatgattcagcaaatgcagcatccttgcaatgagtgcaagggtactggggagactatcagcgataaggacagatgcccacaatgcaagggtgagaaggtggttcaggagaagaaggttcttgaggtggtggtcgagaagggtatgcagaatggccagaagattacattccctggtgaagctgatgaggcaccggatactgtcaccggagacatcatctttgtcctccagcagaaggagcatcccaagttcaagagaaagggcgatgacctcttttatgagcacactctgaccctgactgaatctctctgcggcttccagtttgttctgacccacttggataacaggcagctgctaatcaaatcaaagcccggtgaagttgtcaagcctgactcgttcaaggcgatcaacgatgagggcatgcccatgtaccagaggcccttcatgaagggcaaactgtacatccacttctcggtggagttccccgactctttgaacccggagcagtgcaaggccctggaggctgtcctcccggccaagccagcatcgcagtacacggacatggagctagatgagtgtgaggagacgatgccgtacgatgtgaacatcgaggaggagctgcggaggcggcagcaacagcaccaggaggcctacgacgaggacgaggacatgccgggcggcgcgcagagggtgcagtgcgcccagcagtaggcgctgtaggcagatttgtttgacggtggcggcaaatttgttgtttcgctctatgcgagtactgttgggtcccaaagttttctcgcgtattatgtgatgatactttcggttctaaaaatactacaatattcgctcagtggagcagaaggttttgcgtgttttccgttactgctctgtttgc

SEQ ID NO: 8283 - DNA, 1493 bp, Panicum virgatum
ccggcccgcgagctcgctccccgtcggatcaaacagctagggtttcgaaggaagagacgtgtgcggcgacgagatgttcgggcgcgcgccgaagaagagcgacaacacgcggtactacgagatcctcggcgtgcccaaggacgcgtcccaggatgacctcaagaaggcctaccgcaaggccgccatcaagaaccaccccgacaagggcggggaccctgagaagttcaaggagctagctcaggcttatgaggtcctcagtgatcctgaaaaacgagagatttatgatcagtatggtgaggatgccctcaaggagggaatgggaggtggaggagggatgcatgacccatttgatatcttccaatccttctttggtggtggaagcccctttggaggtggtggtagcagtaggggcaggaggcagcgtaggggtgaagatgttgttcaccctctgaaggtttctttagaggaattgtataatggcacctcaaagaagctctcactgtcacgcaatgtactttgctccaagtgcaatggcaagggctcaaagtctggagcttcatcgaggtgtgctggttgccaaggctctgggtataaggtccaaatcaggcagctgggaccaggaatgattcagcaaatgcagcatccttgcaatgagtgcaagggtactggggagaccatcagtgataaggatagatgcccacaatgcaagggtgagaaggtggttcaggagaagaaggttcttgaggtggtggtcgagaagggtatgcagaatggccagaaggttacattccctggtgaagctgatgaggcgccggatactgtcacgggagacatcatctttgtcctccagcagaaggagcatcccaagttcaaaagaaagggcgatgacctcttctatgagcacactctgaccctgactgaatctctctgtggcttccagtttgttctgacccacttggataacaggcagctgctaatcaaatcaaaccccggtgaagttgtcaagcctgattcgttcaaggcgatcaacgatgagggcatgcccatgtaccagaggcccttcatgaagggcaagctgtacatccacttctcggtggagttcccggactctttgaacccggagcagtgcaaggccctggaggctgtcctcccgcccaagccggcatcgcagtacacggacatggagctagatgagtgcgaggagacgatgccgtacgatgtgaacatcgaggaggagctgcggaggcggcagcaacagcaccaggaggcatacgacgaggacgatgagatgcctggtggtgcgcagagggtgcagtgcgcccagcagtaggcgctgtaggcagatttgtttgacggtggcggcaaatttgttgctttgctatgtgcgagtactgttgggtcgcaagttttcccgcgtattatgtgatgatactttcggttatgaaatactacaatatcccctccgtggagggggaaattttgcgtgttttccg

SEQ ID NO: 8284 - DNA, 1600 bp, Vinca minor
gattctccttccttcgctctaccaactccaaatccctaatcgatctagggttttcacagattttgctcaaagagttgcaaaaaaccagtagtagatcgaatctaagatgtttggaagagcgccaaaaaagagcgataattcgaagtactatgaggtcttgggagtatcgaagaacgcttcgcaagatgatctgaagaaggcttatcgtaaagccgccattaaaaatcatcctgataaaggaggcgatcctgaaaagtttaaggagcttgctcaggcttatgaggttctaagtgaccctgagaagcgtgagatttatgatcagtatggagaggatgctctaaaggaaggaatgggcagtggaggtggtggccatgacccatttgacatcttttcgtccttctttggtggtggtagcccctttggaggtggaggaagcagtagaggccggagacagaggaggggtgaggatgtcattcatccgctcaaggtttctctggaggatctctataatggaacctctaagaagctctccctctctcgtaatgtgctatgtcaaaagtgcaagggtaaagggtcaaaatctggagcttccatgacatgttctggatgccaagggtctggaatgaaggtttctattagacatcttggcccatctatgatccagcagatgcaacatccttgcaatgagtgcaagggtactggagaaaccataaatgataaggatcgctgcccacagtgcaagggtgaaaaggttgtgcaggagaagaaggtcctggacgtgattgtggagaagggcatgcaaaatggacagaagattacattccctggcgaggccgatgaagctcctgatactgttactggagacatagtgtttgtcttacaacagaaagtgcaccctaagttcaagcgaaagggtgatgacctcttcgtcgaacacacattgtctctgactgaggctctttgtggcttccagtttatcttgacccacctggacaacaggcagcttcttattaaatcccaacctggggaagtaatcaagcctgaccaattcaaggcaataaatgatgaaggaatggtgatataccagaggccattcatgagaggcaaattgtacattcatttcaatgtggaattcccagactccctgaaccccgagcaatgcaaggctcttgaagctgtcttgcctccaagacctacaacgcaaattaccgagatggagttggatgaatgtgaagagaccacacttcacgatgtcaacattgaggaggaaatgcgaaggaagagtcagcagtccgctcaagaagcatatgatgaggacgaagatatgcacggtggtgctcagagggtgcagtgtgctcaacaataagttgaccgtgacaggcgagggaagtagccggagctgcatctgggaggtgagaggcctcattattattgaaattttaataggtttgttgaagaaactatgtcctctgttctattcggacaatatagatgtgggtagtttaattatttggaatatttgttgttctctacgaaaaatctgatattgtacccccaagattgatagcttgactattttgagggcgcacaacgtataata

SEQ ID NO: 8285 - DNA, 1510 bp, Vinca minor
ggactccaatccctaaccgttctaggggtttcactgatctagattttgctaaaatcgaatcgaagatgtttggaaggggaccaaaaaagagcgataattcgaagtactatgaggtattgggagttccgaaggacgcttcgcaagatgatctgaagaaagcttaccgtaaagccgctattaaaaatcatcctgataagggaggcgatcctgaaaagtttaaagagcttgctcaggcttatgaagttctgagtgaccctgagaagcgtgagatttatgatcagtatggagaggatgctctcaaggaaggaatgggtagtggaggtggtggccatgacccatttgacatcttttcatccttctttggtggtggtagcccctttggaggcggcggaagcagtagaggccggagacagaggagaggtgaggatgtaatccatccgctcaaggtttctctggaggatctctataatggaacgtctaagaagctctccctctctcgtaatgtgttatgtcaaaagtgcaagggtaaagggtcaaaatctggtgcttccatgaaatgttctggttgtcaaggttctggaatgaaagtttctattagacaccttggcccatctatgatccagcagatgcaacacccttgcaatgagtgcaagggtactggggaaaccataaatgataaggatcgctgcccacagtgcaagggtgaaaaggttgcgcagcagaagaaggtcctggaagtgatcgtggagaagggcatgcaaaatggacagaagattacgttccctggcgaggccgatgaggctcctgatactgttactggagacatagtttttgtcttacaacagaaagtacaccctaagttcaagcgaaagggtgatgacctctttgtggaacacacattgtccctgactgaggctctttgtggctttcagtttatcttgacccacctagataatagacagcttctaatcaaatcccagcctggagaagtaatcaagcctgatcaattcaaggtaattaatgatgaaggaatggtgatgtaccagaggccattcatgagaggcaaattgtacatccacttcaatgtggaattcccagaatccctgagcctcgagcagtgcaaggcactcgaagctgtattgcctccaagacctacaaagcaaattactgaaatggagttggatgagtgtgaggagaccacacttcatgatgtcaacattgaggaggaaatgcgaaggaagactcagcaggctgcccaagaagcatatgatgaggacgaagatatgcatggtggtgctcagagagtgcagtgtgctcaacaataagttgatcttgacaggcgggaaggcagtaagagccacatctgggaggtgagggctcagtatcattaaaattttaataggtttgttgaagaaaagacgttctctgcgatgttgtcctgtgttctattaggacttatagttgggtagtttgattattttgaatatttgttgttctctcctaaaagctg

SEQ ID NO: 8286 - DNA, 1704 bp, Fragaria vesca
caccatacgacggtctagaatctgcaaccaataaaaacctagcaagtcgaaagcgttctagatccttctaactaaaacccggaaaactgtccgcatatctttattagctcgtggaatcagcactcctcgtcaatctcatcttctcataccaatttgaagaatttttaatcgaaatcgaagatgttcggaggaggcagggcgcccaagaagagcgacaattcaaaatactatgagattctgggagtctccaagactgcttcgcctgaagatgtgaagaaggcttacaagaaagccgccatcaagaaccatcctgataagggcggagatcctgaaaaatttaaggagttggctcaggcttacgaggttctaagtgaccccgagaagcgtgaaatatatgatcgatatggtgaggacggactcaaggaagaaatgcaatccggtggccatgacccatttgatatcttttcgtctttctttggtggtggcggcagcccttttggaggcatgccgggtggtagtagtagaggacggagacagagacgtggagaagatgtggttcacccattgaaggtctctttggaagacctatatcttggaacctcaaagaaactttccctatctcgcaatgtgttgtgctccaagtgcaaaggcaaggggtcaaaatctggagcctcgaccaagtgtggtgggtgccaaggaactggtatgaaggtcactattaggcatcttggaccctctatgattcaacaaatgcagcatgcttgcaatgaatgcaagggtactggagagaccatcagtgacaaagaccgctgtggacagtgcaagggagagaaggttgttcatgagaagaaggttttggaagtacatgtggagaagggtatgcagaatggacagaaaatcacatttcctggtgaagctgatgaagctcctgacacagtcactggtgatatagttttcatcattcagcaaaaggaacatccaaagttcaagagaaagatggacgacctttttgtggagcactctttgtcactcacagatgctctatgtggttttcagtttgtgctgaaccatttggatggcaggcagcttcttattaaatcaaaccctggtgaagttgtgaagcctgattcgtttaaggctgtcaatgatgagggtatgccaatgtaccagaggccattcatgaaaggcaagctgtacattcatttctcagtggatttccctgaaactctgagccctgagcaggtcaaggctttggaagctgctcttccatcaagggcatcatctcagcagctgacagatatggagttggatgagtgtgaggagacaaccctgcatgatgtgaacatggaagaggagatgaggaggaaacagcaccaggctcattcagaggcctatgatgaggacgatgacatgcctggtggtgcacagagggtgcagtgcgcacagcagtgattgtactcataacccataaaagatgttatgtgtattgtggattggttatctcaagcataacatgctgtggctctgccgtttgttataaatctcttggtggatgctattgtctgccctttttgcactggaaattttcatgctaaatgtagtagaaaatgatgcatcggaggattttgctgttttggcctcttcagaaaacgtcaccattattcatgaaatgtgataatccattatctcactttattagacaaa

SEQ ID NO: 8287 - DNA, 1670 bp, Amsonia hubrichtii
acctccaaataaatccccttttctctctcgtcctaaccctctcttctccttccttcgctcgcctgcccgctctccaagtccaagtcaacatcggacttccatctctagctggtctagggtttttaccgaatttgctagagttgtgaaactagtagatcgaagatgtttgggagggcaccgaaaaagagcgacaacaccaagtactatgagattttgggggtgtcgaagaatgcttcgcaagatgatctgaagaaggcctatcgtaaagctgccattaaaaaccatcctgataaaggaggtgatccagaaaagtttaaagagcttgctcaggcttatgaggtattaagtgaccctgagaagcgtgagatctatgatcagtatggtgaggatgcactgaaggaaggaatgggtggtggaggtggtgtccatgacccatttgacatcttccagtccttcttcggtggtagcccatttggaggtggcggaagcagcagaggtcggaggcagagaaggggtgaggatgtcattcatccactcaaggtttctctggaggatctctataatgggacctctaagaagctctcactctctcgtaatgtgttatgccaaaaatgcaagggtaaagggtcaaaatctggtgcttccatgagatgttctggatgtcaaggatctggaatgaaagtttctattagacatcttggcccgtctatgatccagcagatgcaacacccatgcaatgagtgcaagggtactggtgaaaccataaatgataaagatcgctgcccaacatgcaagggtgaaaaggttgtgcaggagaagaaggtcttagaagttattgtggagaagggcatgcaaaatggacagaagattacattccctggcgaggccgatgaagcacctgatactgttactggagacatagtttttatcttacaacagaaggagcaccctaagttcaagcgcaagggtgatgacctctttgttgaacacacattgtctctgactgaggctctctgtggcttccagtttatcttgactcacctagataacaggcagcttcttattaaatcccaaccgggagaagtaatcaagcctgatcaatttaaggcaataaatgatgaaggaatggtgatataccagaggccattcatgagaggcaaattgtacattcatttccatgtggaatttccagagtccctgactcctgagcagtgcaaggcacttgaaactgtgttgcctcctagacccacaaaacaaattactgaaatggagttggatgagtgtgaggagactacacttcatgatgttaacattgaggaggagatgcgaaggaagaatcagcaggcccaggaagcatatgatgaggatgaagatatgcatggaggtgctcagagagtgcagtgtgctcagcaatgagttgttcgtgatagatgagatataggagccacatctaggaggtgaggactcggtattattgaagtttgatgggtttgttgaagaaaggacgcgcactgcaatgttgtcctcttttctattaggatatatagatgggtagtttaatgattttaaaatatttgtcttctctgaaaaactgatattgtaccccaagattcacagtttgacaattttgagagtacacagtataatatgcaatttatgtgcttgatttt

SEQ ID NO: 8288 - DNA, 1719 bp, Euphorbia peplus
gccgtcttgcgtctctttctgcagctctctgaatctctcaatctctggtctttgattgattagggttagggtttggtcatctgagagcagaagagatgtttggaagagccccgaagaaaagcgataacaccaagtattatgagattctcggagtctccaagaacgctggccctgatgatgtaaagaaggcttatcgaaaagctgccatcaagaatcatcctgacaagggtggtgatcctgaaaagttcaaggagatatctcaggcttatgaagttttaagtgaccctgaaaaacgtgagctatatgatcagtatggtgaggatgctcttaaggaaggaatgggtggcggtggcggtggtcatgatccatttgacatattccaatccttctttggtggcagtccatttggtggtggtggtagcagcagaggccgtaggcagaggaggggtgaggatgtgactcatcctctcaaggtttccctggaagatctctacaatggcacctccaagaagctatctttatcacgaaatgtaatctgcgtaaagtgtaaaggtaagggctccaagtcaggtgcatccatgaaatgttcaggttgccaaggctctggtatgaaggtttctattagacaccttggtccctctatgatccagcaaatgcagcatccttgcaatgaatgtaagggtactggggagaccattaatgacaaggatcggtgcccccagtgcaagggtgaaaaggttagtcaagagaagaaagtcttggaagtccatgttgagaagggtatgcaaaatggacagaagatcacattccccggagaagctgatgaagctcctgatactgttacaggagatatagtttttatcctgcagcagagggagcatcccaagtttaaacgaaggggagatgatctagttgtggagcacaccttgtctctaactgaggctctctgtggtttccagttcatattgagccatttagacggaaggcaacttctcatcaagtcccagcctggggaagttgtgaagcctgatcaattcaaggctataaatgatgaggggatgccaatgtaccagcggccatttatgaggggcaagttgtacattcatttcaatgttgaattcccagattctcttcctgtggatcagtccaaagctctagaggctgtgcttccatcgagaacatcagttcaattatcggacatggaggtggatgagtgcgaagagaccactttgcacgatgtcaattttgaggaagagatgaggagaaagcaacaacagagtgcagaggcatatgatgaagatgacgatatgccaggtggtgcccaaagagtacaatgtgcccagcagtaagccaagaaaaccagagtgagtaatcagtgccaatatagttgttatgtgagaacagtaagattctcagacattcattggcttagagactgctggtccgagtatgggatatcgcttaagagtttgcagaatgtatggaagggattctcaggaacaaaccaaaaaaccatgctcctattttagtttctttattaaataatatttttatttttgcggtgtttatggtgtaattttggatcggtagcttgccatatagtaattgttctgcgtgctaaattggtgatattttcttatggtattaagttggttattttctgctgatgttagttttgaacttttatattttataggaatatcaaggccctgaatttta

SEQ ID NO: 8289 - DNA, 1564 bp, Nicotiana tabacum
ctcttctccatacccaattacgcccacaacactcttcttctcgccgcgcttttcatcgtttaattttgagtagtaaagcgaatcgaagatgtttgggagggcaacgaagaagagcgacaacacaaagtactatgagatcttaggtgttcctaagaccgcttcacctgaagatctcaaaaaagcttaccgtaaagctgctattaagaatcatcctgataagggaggtgatccggaaaagtttaaagagcttgcacaagcttatgaggttttgagtgatcccgagaagcgtgagatatatgaccagtacggtgaagatgctctcaaggaaggaatgggtggtggaggtggtggccacgacccatttgacattttctcgtctttctttggtggcagcccgtttggtggtggtatgggtggtggaagcagcagaggaagaagacagaaaagaggagaggatgttgtccaccctctcaaagtttctctggatgatctgtacaatgggacgtcaaagaagctgtcactatctcgcaatgtattgtgccccaagtgcaaggggaaaggatctaagtcaggtgtttcaatgaaatgttctggctgtcaagggtccgggatgaaagtcactatcagacaccttggcccatccatgatccagcagatgcaacacgcttgcaacgagtgtaagggtagtggtgagacaatcagtgataaagataggtgtggacagtgtaaaggtgagaaggttgtgcaggagaagaaggtgttggaagttgttgttgagaagggtatgcagaatggacagaagattacgttcccgggcgaggctgatgaagcgcctgatactatcactggggacatagtttttatcttgcaacagaaggaacatcccaagttcaagcgaaagggagatgatctttttgtagagcacactttgagtttgactgaggccctatgtggtttccagttcatcttgactcacttggacaatagacagctactcattaagtcccaacctggagaagttgtcaagcctgatcaatttaaggccataaatgatgaaggaatgccaatgtaccaaaggccgtttatgagaggaaaactgtacattcactttactgtagatttcccagagacattatccctcgagcagtgcaagaaccttgaagcggtgctgccaccaaaacccaaaacgcaaatgactgacatggaattggatgagtgtgaggagaccactttgcatgatgttaacattgaagaggagatgcgtaggaagcagcaacaagcccaagaggcatacaacgaagacgaagacatgcatggtggcgcccagagagttcaatgtgcacaacagtaatttgacactgttttggaaaccaaagctgcatcaaggaattaacagcatgagcctatctttggtttttaagtatttgtatgacaagataatgacattgccaggaatattgcttctacagtaagatatagtttactagcttatgatttggaattttacgtttgctaattgatactgtcaagcaaaatttaattctacaattggtgggtgcggcag

SEQ ID NO: 8290 - DNA, 1511 bp, Zingiber officinale
  misc_feature (18)..(18): n is a, c, g, or t
  misc_feature (47)..(47): n is a, c, g, or t
  misc_feature (539)..(539): n is a, c, g, or t
  misc_feature (626)..(626): n is a, c, g, or t
  misc_feature (812)..(812): n is a, c, g, or t
  misc_feature (1490)..(1490): n is a, c, g, or t
ctttctagggcttttcgncttcggatccctcttcgatcggggcctcntttcgtgagaggagagacgggatctggtgattccgccttgcatctgtgggctaccgatcgattgggtaaagttccgccgcggagatgttcgggagggcgccgaagaagagcgacaacactcgctactacgagaccttgggggtgcccaagaccgcatctcaggatgatctgaagaaggcctaccggaaggctgccatcaagaaccaccccgacaagggcggcgaccccgagaagttcaaggaattggcccaggcttatgaagttttgagtgatcctgagaaacgtgagatctatgatcaatatggtgaagatgctttaaaggagggaatgagtggtggaggcggggggcatgatccatttgatatattccagtccttctttggtggcagtccctttggaggaggaagcagcagaggacgaaggcagagaagaggggaggatgtcatccatccgctcaaggtatccttagaagatctttacaatggaacctcnaagaaattgtcactctcacggaatgtgatctgccggaagtgcaacggcaagggttcgaaatctggcgcttccatgacatgctctggntgtcgtggctcaggtatgaaggtcagtattcgccaactggggcctggcatgattcagcaaatgcagcatccatgcagtgaatgcaagggaactggtgagaggatcaatgagaaggatcgctgctcagactgcaaaggcgagaaggttgtccctgagaagaaagtgctggaggttgtagttgagaanggaatgcaaaatggccagaagatttccttccacggcgaggctgacgaagctcctgatacgctcacaggagacattgtgtttgttctccaacaaaaggaacatcccaaattcatgcgaaagggcgaagatctcttttacgaacattcgttgtcgctgaccgaggctctttgtggtttccagtttgttttgaatcaccttgacggtagacagctacttatcaaatcaaacccaggggaagtcgtcaagcccgatcaaaacaaggcaataaatgatgagggcatgccgatccaccagaggcccttcatgaagggaaagctctacatccacttcactgtcgacttccctgattcactggcaccagctcagtcgaaagctctcgaggcggttctccctcctaagcctgcgtctcagttgatggacatggagctcgacgaatgcgaggagacaatattgcatgatgttaacatgaaggaggagatgcgacggaagcaagcgcaagcgcaagaagcttacgaagaggatgaggatgatctccatggaggcggccagagagtccagtgtgcccagcaataaacttgattagctatataacttttatcgacgtttggttgtgtgcccagtagtagtatcatggtcatccttttgaagtagtttaacaataaacttatcgatcgaacnaatttcatatttgaattttta

SEQ ID NO: 8291 - DNA, 1627 bp, Oryza sativa
ccagagcattcactcctccgccacccgtttcttcctccgctataactacacccctcctctctcctcctcacaaaccgcttccaacccgagaccacgctccccgccggatcgagcagctagggtttcgacctttttttttcccaccaggagggcgacgagatgttcgggcgcgcgccgaagaagagcgacaacacgcggtactacgaggtgcttggggtgcccaaggatgcgtcccaggatgacctcaagaaggcgtaccgcaaggccgccatcaagaaccaccccgacaagggcggagaccccgagaagttcaaggaattggctcaggcttatgaagtcctgagtgaccctgagaagcgtgaaatctatgatcagtacggtgaagatgctctcaaggaggggatgggtcctggtggtgggatgcatgacccatttgacattttttcctcattctttggaggtggctttggaggtggtagcagtaggggcaggagacagcgtaggggagaggatgtggttcaccctctgaaggtttctctggaggaattgtacaatggcacatcaaagaagctctccctttctcgcaatgtgctctgctccaagtgcaatggcaagggctcgaaatctggtgcttccatgaagtgctctggttgtcaaggttctggtatgaaggtccaaattcgccagttggggccaggaatgattcagcaaatgcaacatccctgcaatgagtgcaagggaactggtgagaccatcagcgacaaggatagatgcccaggctgcaagggtgagaaggtggcgcaggagaagaaggttcttgaggtggtggtcgagaagggcatgcagaatggacagaagatcaccttccctggtgaggctgatgaagcgcccgatactgtcactggagacattatcttcgtcctccagcagaaggagcatcccaagttcaagagaaagggagatgacctcttctacgagcacaccctgaacctcactgaggccctttgtggcttccagtttgttctcactcacttggacaacaggcagctgcttatcaagtccaagcccggtgaagttgtcaagcctgattcattcaaggctgtcaacgacgagggcatgccgatgtaccagcggccattcatgaaggggaagctctacatccacttctccgtggaattccccgactctttgaaccctgaccagtgcaaggccctggagaccgtcctcccgccaaggccggtgtcgcagtacaccgacatggagctcgacgagtgcgaggagaccatgccgtacgacgtgaacatcgaggaggagatgaggaggcggcagcaacagcagcagcaggaggcatacgacgaggacgaggacatgcacggcggcggcgcccagcgcgtgcagtgcgcgcagcagtaagcagcaagcagcgccgtgcatacatatctgcacggctttgacggcggcgacaaattgtttctttccgctctaggggcgataatactatcaagttttccatgttaggcatatgatgatgtgatactacttttggtcttttatactgcgtattaatgacgtacatcaaccggacctactggtccatgaaacaaaatctctactgcttctccttcct

SEQ ID NO: 8292 - DNA, 1658 bp, Plantago ovata
cggccgggggtaaaatcttttctcatctctaagttttactttctctctagaagattctccccaattttgtttaatcgtcactgtaaattccattggagattggtttgtgatccaacatgtttggaagagcaccgaaaaagagcgataacaccaagtactatgacatcctcggcgtgccgaagacggcgtcgcccgatgacctgaagaaggcttacaagaaagctgcgattaaaaaccatccggataagggcggtgatcctgagaagtttaaggagcttgctcatgcttatgaggttctgagtgatcctgagaaacgtgagatatatgatcagtatggtgaggatgcactcaaggaaggaatgcctaatggcggaatgcacgacccatttgacatcttctcatccttctttggcggaggaagtccatttggaggtggtggcagcagtaggggaagaaggcaaaggaggggagaggatgtggtgcatccattgaaggtgtctctcgaggatctttatcttgggactaccaagaagctctccttgtcacgcaatgttatctgttcaaaatgtagtggtaagggttccaagtctggagcttcgatgaagtgctcaggctgtcaaggatccggcatgaaagtcacaatcaggcagcttggtcctggaatgattcagcaaatgcagcatccttgcaatgaatgcaaaggtacaggggagactattagtgacaaagataggtgctcacaatgcaagggtgagaaggttgttcagcaaaagaaagtgttggaagttcatgttgagaagggtatgcagaatggacagaagattacattccctggagaagccgatgaggcgcctgatacggtcactggagacatagtatttgttctccagcagaaggagcatccaaggtttaagagaaagggagaggacctatttgtggaacattctctgtcacttacagaggcattgtgtggtttccagtttatattgactcatctagatggcaggcagctcctgatcaaatcacaacttggagaagttgtcaagcccaattcattcaaggctatcaatgacgaaggaatgcccatgtatggaagacctttcatgaagggcaggatgtacatccacttcagcgtggaattccctgattctttggccccagagcaagttgaggcacttgcaaaaattcttccaccaaagcctggaactcaaattacagacatggagctggatgagtgtgaggagactactctttatgatgtgaacaacattgaggaagagatgaggaggaaagcccaacaggaagcatatgaggaggaagacgaggacatgcaaggtggtcagagggtccagtgtgctcagcagtgatagatggttgagcatacagatgggatttgaataggctgtcttagggtgatatgataacctaggggaagatgtgttgcttctggttattgagtgcccaagtgttatcttctatgatcacgataaattttggaacagttggggccattgagtcatactggtttcagctttttttacttgtatgaacgggtttgtcacatatatttcggttaccgtcatccagtttgccttttattagaaatgaatctgtttcttttgcttattatgcttccgtcatccagtttgcccaaaaaa

SEQ ID NO: 8293 - DNA, 1630 bp, Amorphophallus konjac
cgcaagaaggaagaagggttgggtgattcgatcggtcccgaggttggggggagcgtgaggagcttggatttctggtgctactccggcgatcgtcgttgggtgttgatttgatcggatacgaagatgttcggaagggcgccgaagaagagcgacaacacgcggtactatgagatcttgggcgtgtccaagaacggctcgcaggaggacctgaagcgcgcctaccgcaaggccgccatcaagaaccaccccgacaagggcggcgaccccgagaagttcaaggaattggctcaggcttatgaagttctcagtgaccccgagaaacgtgagatttacgaccaatatggagaggatgccctcaaggagggaatgggtggaggcggtgcccatgtcgacccgtttgacatattctcctcgttcttcggtggcaatccattcggaggcggcggtagcagccgagggcggaggcagaagagaggggaggacgtcatacatcccctcaaggtttccctcgaggacctgtacagtgggacctcgaagaagctctccctctcacggaatattatctgttctaaatgcaagggcaagggttcgaagtctggtgcatccatgaggtgtgctggctgccaggggtcaggtatgaaggtttctatccggcagttgggtccgggcatgatccagcagctgcagcatccctgcaacgagtgcaaggggaccggagaggccatcaacgagaaggacaggtgcccacagtgcaagggcgagaaggtggtgccggagaagaaggttttggaggtccatgtcgagaaggggatgcagaacggccagaggatcaccttccctggagaagcggatgaagcgcctgacactgtcacgggtgacattgtgttcgtcttgcaacaaaaggaacaccccaagttcaagagaaagggcgatgatctgtttgtagagcataccctgtccttgacagaggcgttgtgcggcttccaatatgtgctgacacatttggatggcaggcagctgctcatcaagacgaaccccggcgaggtggtcaagcctgaccaattcaaggcgataaacgatgaggggatgcccatgtaccagcggccgttcatgaggggcaagctgtacatccacttcacggtggagttcccggactcgctgacgctggagcagtgcaaggcgctggacgccgtcctgccgtcgaggccgtcggcgcagctgacggacatggagctggatgactgcgaggagaccacgatgcacgacgtgaacatagaggaagagatgcggaggaagcagcaggctgctcaggaggcctacgacgaggacgaggagatgcacggcggtgctcagagggtgcagtgcgcgcagcaatagattataatatagtctatctataatattatatatagcatgtgatgggatggggggtggacgtgaagttgtcaccgttggaaatcatggtctctgttgggttgccgcgccgtgccatgttttgatatatctcattttgccttgtcctcctctaattacttggccatatactttaccctcgaaagaaactggactgggattttcccccagtattttgatataatctcattttgccttgtcccccctctaattactt

SEQ ID NO: 8294 - DNA, 1604 bp, Centaurea maculosa
  misc_feature (18)..(18): n is a, c, g, or t
  misc_feature (20)..(20): n is a, c, g, or t
  misc_feature (23)..(23): n is a, c, g, or t
  misc_feature (26)..(26): n is a, c, g, or t
  misc_feature (29)..(30): n is a, c, g, or t
  misc_feature (43)..(43): n is a, c, g, or t
  misc_feature (45)..(45): n is a, c, g, or t
  misc_feature (47)..(48): n is a, c, g, or t
  misc_feature (53)..(53): n is a, c, g, or t
  misc_feature (55)..(55): n is a, c, g, or t
  misc_feature (58)..(58): n is a, c, g, or t
  misc_feature (107)..(107): n is a, c, g, or t
  misc_feature (124)..(125): n is a, c, g, or t
  misc_feature (233)..(233): n is a, c, g, or t
  misc_feature (242)..(242): n is a, c, g, or t
  misc_feature (263)..(263): n is a, c, g, or t
  misc_feature (269)..(269): n is a, c, g, or t
  misc_feature (281)..(281): n is a, c, g, or t
  misc_feature (308)..(308): n is a, c, g, or t
  misc_feature (332)..(332): n is a, c, g, or t
  misc_feature (380)..(380): n is a, c, g, or t
  misc_feature (470)..(470): n is a, c, g, or t
  misc_feature (477)..(477): n is a, c, g, or t
  misc_feature (500)..(500): n is a, c, g, or t
  misc_feature (668)..(668): n is a, c, g, or t
  misc_feature (740)..(740): n is a, c, g, or t
  misc_feature (1106)..(1106): n is a, c, g, or t
  misc_feature (1112)..(1112): n is a, c, g, or t
  misc_feature (1115)..(1115): n is a, c, g, or t
  misc_feature (1124)..(1124): n is a, c, g, or t
  misc_feature (1142)..(1142): n is a, c, g, or t
  misc_feature (1159)..(1159): n is a, c, g, or t
  misc_feature (1182)..(1182): n is a, c, g, or t
  misc_feature (1192)..(1193): n is a, c, g, or t
  misc_feature (1196)..(1196): n is a, c, g, or t
  misc_feature (1214)..(1214): n is a, c, g, or t
  misc_feature (1485)..(1485): n is a, c, g, or t
atccattaattggaagantnctntgnatnntgattgaattctntntnnatttntntcntagattttgatcgaatttgtgaagatcgaggatgtttggaagagccccnaagaagagcgataatannaagtactatgagatcctaggggttccgagtaccgcatctcaggatgatctcaagaaggcttatcggaaagccgccattaagaatcatcctgataaaggtggagatccngagaagttnaaagagcttgcccaagcatangaggtnctgagtgacccngagaagcgtcagatatacgatgaatanggagaggatgctttgaaggaaggnatgggcggtggaggtggtggacatgatccattcgacatcttccagtcnttctttgggggtactccttttggtggtggtggtagcagcagcaggggacgtagacaaagaaggggagaagacgttatccaccctctcaangtttctntggaggatctttacaacggaacntccaagaaactctctctttcacgtaacgtaatctgctccaagtgcacaggcaaagggtcaaagtcgggtgcttcaatgaaatgttcaggctgtcaaggttcaggcatgaaagtttccatcagacatcttggcccatctatgattcagcaaatgcaacagccttgtaangagtgcaagggtactggagaaacaattgacgataaggatcgctgcccacagtgcaagggtgaaaaggtggtnccggagaagaaagtcctcgaagttcatgtcgagaagggcatgcagaacggacagaagatcacattccctggagaggctgatgaagctcctgataccgtcactggtgatattgtgttcgtcttgcaacaaaaagagcatcccaagtttaagcggaagggtgatgatatattctatgaacacactttgaatctgacagaagcgctctgtggcttccagttcatcttgacccatctagataacaggcaacttttgatcaagtctctacccggggaggttgtgaaacctgatcaattcaaggcaataaatgatgaaggaatgccaatgtaccagaggccgttcatgaaggggaagctgtacattcacttnagcgtnganttccctgantcaataagccctgatcantgcaaggttctggaggnggttcttccagccaggccttcgncccagattannganatggagctggacgaatgngaggagacaactctgcacgatgtcaacattgaagaagagatgagaaggaagcagcagcaagcagctcaagaagcttacgatgaagatgatgatgacgacatgcatggtggagcccagaaggtacaatgcgcgcaacaatgatgtgagcgagcaagcgagcaaaggtatgggttatttttataggtattggcaagacactttgtgggttgtcacattagaaacataaaaaatgtaatgtatgcaacttttttattcgtttgattcggctganataggagaaagaagaacttttcgagtcctagggtttgttgtgtggtttggttgatgaatatagtggcaattgtttcttaatgacaatgtgattgaagatgctaatatgttgattgcata

SEQ ID NO: 8295 - DNA, 1484 bp, Ipomoea batatas
ggatcaaacttacaatctctccgtctactctccctgcgattctcatcgggttcgcagattcgtaaaagatgtttgcgagggcgccgaagaagagcgataacaccaagtattatgagatcttgggagtttccaagaacgcttctcaggatgatctcaagaaggcctaccgtaaatccgccataaagaatcaccccgataagggtggcgatcccgagaagtttaaagagcttgctcaagcttatgaggttctgagcgacccagagaaacgggagatttatgatcagtatggtgaagatgcattaaaggaaggaatgggtggtggtggtggtatgcatgatccatttgacatcttccaatccttctttggtggcaatccatttggtggaggaggaagtagccgaggccgcatgcaaagaagaggggaggatgttgttcacccccttaaggtgtctttagaggacctctacaatggaacatcgaaaaagctgtctttatcccgaaatgtgctctgcccaaaatgcaagggcaaggggtcaaagtctggtgcatcaatgaaatgttctggctgccagggctctgggatgaaagtttccatccgacaacttgggccatctatgatacagcagatgcagcatccttgcggcgagtgcaagggtactggtgagacaattaatgagaaagataggtgcggacagtgtaagggtgagaaggttgtgcaagagaagaaggtgttggaagtccttgttgagaaaggaatgcagaatggtcaaaagattacattccccggagaggctgatgaagctccggacactgtcactggagacatagtgtttgtcctgcaacaaagggaacatgccaaattcaagcgaaagggggatgaccttttcctggagcacaccttaaccctaacagaagccctttgcggtttccagtttatcttaacacacctagataataggcagctccttatcaaatcacaacctggagaagttgttaagcctgatcaattcaaggccataaatgacgaaggaatgcccatgtatcaaaggccattcatgagaggaaagctgtacattcatttcacagttgattttccggagtcattatcccctgatcaatgcaaggctcttgagactgtgctgccgcctaggcccacaacaggaatcactgagatggaactcgatgagtgcgaggaaaccaccttgcacgatgtcaacatcgaagaggaaatgcgtaggaagcagcagcagcaagcacaggaagcatacgaggaagacgacgatatgcatggaggggcacagagagtacaatgtgcccaacagtgaggtctaaaacaaggtggagacaactcatggagattttaggggtgacctttccttatcacaactaggattttacagattgatagttaattcctgaatttgttctgaatttttgtgtgtaatgcaagacctagttataaaaatattaaacttcatggttta

SEQ ID NO: 8296 - DNA, 1658 bp, Actinidia deliciosa
aatccccaccgtccaaaatcccttcctaataaaaacccatttccgataccaaaccaactcgtctctcgaactcaaagtctccgacctctctctcgctctctaacttcaacgttcaatcatcgattgattgattgttgaagatgtttgggagggcgccgaagaagagcgacaacaccaagtactatgaaattctgggggtctcgaagagcgcatcgcaggatgatttgaagaaggcgtatcgtaaagccgccatcaagaaccatcccgacaaggggggtgatcccgagaagtttaaagagctagcccaagcttatgaggttctgagtgacccagagaagcgtgatatttatgatcaatatggggaggatgctctcaaggaaggaatgggtggtggaggaggtggacacgatccgtttgacatcttccaatccttctttggtggtggcggaagcagcagaggccgcaggcaaagaaggggagaggatgtgattcatcccctcaaggtttctctggaggatctgtacaatgggacatccaaaaagctatccctctctcgcaacgtaatttgctccaagtgcaaaggtaaaggatccaagtcgggtgcttccatgaaatgtggcgggtgtcaagggtccggaatgaaagtgtctatcaggcatcttggcccatctatgatccagcagatgcagcatccgtgcaatgagtgtaaaggtactggtgaaaccatcaatgacaaagatcgctgcctgcagtgcaagggcgataaggttgtaggggagaagaaagtgttggaagtcattgtggagaagggaatgcaaaatgggcagaagatcacattccctggagaagcggatgaggcgcctgacacggttacaggggatatagtctttgttctacaacagaaagagcacctcaagtttaagcggaagggtgatgatctgtttgtggaacacaccttggcacttaccgaggcactttgtggcttccagtttattcttacccatcttgataataggcagctcctcattaaatctcaacctggagaagtaatcaagccggaccaattcaaggcaataaatgatgagggaatgccgatgtatcagaggccgttcatgagagggaaattatacattcacttcaccgtggacttccccgagtccctcaatgaggaccagtgcaaggctcttgaagctgtgctgcctccaaggccgtcactgcagatgagtgaaatggagctggacgaatgcgaggagactacattgcacgacgttaatatcgaggaggagatgcgtcggaagcagcaacagtcccaagaggcatatgatgaagatgaagagatgcacggtggtgctcagagggtgcaatgtgctcagcaatgatagcctcacgacaaagcctttgtttgatgagggccgaaagaggttggaggccagagttttatttgttgcatagatttatcaagacaataacattcctcggaatgttatattatagcatttaaattgtttagtttctggatttgaaatctgcatatgtgagcaaaatgataacaaatgcaaattggtcattgaccaattgtgaaacgcattaagaaaatcattgctattggcaatgtgtagtgctgttgtgctttgacataaattatgttatttcgtttt

SEQ ID NO: 8297 - DNA, 1631 bp, Actinidia deliciosa
aactcaaagtctgcgaccgctctcgcgctctctatcttcactgtttcatcatcgattgattgattgtcgaagatgtttgggagagcgccgaagaaaagcgacaacaccaagtactatggaattctgggggtctcgaagaacgcatcgcaggatgatctgaagaaggcctaccgaaaagccgccatcaagaaccatcccgataagggcggtgatcctgagaagtttaaagagctagcccaagcttatgaggttctgagcgacccagagaaacgtgaaatttatgatcaatacggtgaggatgctctcaaggaaggaatgggtggcggaggaggtggacatgatccgtttgacatcttccaatccttctttggtggtaatccctttggcggtggtggaagcagcagaggccgcaggcaaagaaggggagaggatgtgatgcatcccctcaaggtttctctggaggatctgtacaatgggacatccaaaaagctatccctctctcgcaatgtaatttgctccaagtgcaagggtaaaggatccaagtcaggtgcttccatgaaatgtgctgggtgtcaagggtcgggaatgaaagtgtctatcagacatcttggcccatctatgatccagcagatgcagcatccgtgcaatgaatgtaaaggtactggtgaatccatcaatgacaaagatcgctgcccgcagtgcaaaggcgataaggttgtaggggagaagaaagtgttggaagtcattgtggagaagggaatgcaaaatgggcagagaatcacattccctggagaggctgatgaggcgcctgatacggttacaggagatatagtctttgttctccaacagaaagagcacctcaagtttaaacggaagggtgatgatctgtttgtcgaacacacattgacacttaccgaggcactttgtggcttccaatttattcttacccatcttgataataggcagctcctcattaaatctcaacctggagaagtaatcaagccggaccaattcaaggcaataaatgatgagggaatgccgatgtatcagaggcccttcatgagagggaaattatacattcacttcactgtggatttccccgagtccctcacagtggagcagtgcaaggctcttgaagctgtgctacctccaaggccgtcgctgcagatgagtgaaatggagctagatgaatgcgaggagactacattgcacgacgttaatattgaggaggagatgcgtcggaagcagcaacaggctcaagaggcatatgatgaagatgaagagatgcccggtggtgctcagagggtgcaatgtgctcagcaatgatagcctcgcgacaaagcctttgtttgattagggccgaaaaaggttggagatcagagttctatatattacatagatttatcaagacaatatcattcctcggaatgttctattatatagcctttaaattgtttagtttctggatttgaaatctgcatatgtgagcgaactgataacaaatgcaaattggtggttgaccaattgcggaatacgctactaagaaaatcattgctgttggcaatgtgtattgctgttgtgctttgacataaattatgttatttcgttttcgtaatgctatcaaccccttt

SEQ ID NO: 8298 - DNA, 1671 bp, Actinidia deliciosa
  misc_feature (77)..(77): n is a, c, g, or t
  misc_feature (1371)..(1371): n is a, c, g, or t
  misc_feature (1429)..(1429): n is a, c, g, or t
agctaatctccaccgtccaaatccttctccaacaaagtcgagaactcacaccaaagcaagtcctcttcggaacacgntccttctctctcttcacggatttcctcatcggttaatttgattaatcgaagatgtttgggagaccaccgaagaagagcaacaacaccaagtactatgaagttctcggagtctcaaagagcgcttcgcaggatgatctgaagaaggcctaccgaaaagcagccattaagaaccacccagacaagggcggtgatcctgagaagtttaaagagttggcacaagcatatgaggtcctgagcgacccagagaagcgtgagatttatgatcagtatggtgaggatgctctcaaggaaggaatgggtggtggaggaggtgggcatgatccatttgacatcttccaatccttctttggtggcagcccatttggtggtggtggaagcagcaggggccgtaggcaaagaaagggagaggatgtcattcatcctctcaaggtttctctggaggatctctacaatgggacagccaagaagctatccctctcacgcaatgtaatatgtttcaagtgcaagggcaaaggatccaagtctggggcttccatgacgtgtacttcgtgtcaagggtctggaatgaaagtctctatcaggcatcttggtccgtctatgatccagcagatgcaacacccttgtaatgagtgtaagggtactggtgaaactatcagtgacaaggatcgctgcccacagtgcaagggtgagaaggtcgtcggggagaagaaagtgttggaagttgttgtggagaagggaatgcaaaacggacagagaatcacatttcctggagaggccgatgaagcgcctgacacggttacaggagatatagtcttcgtgctacagcagaaagagcacccaaagtttaagcggaagggtgatgatctatttgtcgaacacaccttgacactcactgaggctctctgtggcttccagttcattctcacccatcttgataataggcagctcctcattaaatctcaacctggggaagttatcaaacctgattcattcaagggaataaatgatgagggaatgccaatgtaccagagacccttcatgaaagggaaaatgtatattcacttcacagtggatttcccagaatccctcacaccagagcagtccaaggctctcgaagctgtgcttcccctaaagccttcaatacagatgagtgagatggagctggacgaatgtgaggagactacactgcatgatgtgaacatagaagaggaaatgcgtcggaagcagcagcaacaggcgcaagaggcatatgatgaagacgaagacatgcacggtggggcccagagggtgcagngcgctcagcaatgatgacctaatgacaagtgtgtccttgagaagagaacatgcattanggaatacgttggaggccaaagttgtgtgtttcataaacttctcaagactaacattaatggaatgtgctttttattcttttagaatatttagtttctgtattttggtatttttcatgtttgagcaaactgataatgaatgcaaggaattatccttgaccagttgcaaaaaatggttttagaaatcattggcattggcaatgtgtagccttctatgagcacttgcatatttactgctaatgatc

SEQ ID NO: 8299 - DNA, 1526 bp, Solanum phureja
ctcctcctcattctccttcttctcaaacacctaaagacctaatcttctcgacgaagatccctatcttttgaaagatgtttgggagagcaccgaagaagagtgataacaccaagtactatgagatcttgggagtgcctaatactgcttcaccagatgatctaaagaaagcttatcgtaaagccgctattaagaatcatcctgataagggtggtgatcctgaaaaatttaaggagattgcccaagcgtatgaggttttgaatgacccagagaaacgtgagatctatgatcagtatggtgaagatgctctcaaggaaggaatgggtggtggaggtggtggacacgatccgtttgacatattccagtcattctttggtggaggcgggtttggtggtggtggaagcagcagaggaagaaggcaaaggagaggggaggatgttgtccaccctctcaaggtttctttggaggatctttacaatgggatatcaaagaagctatcactatctcgcaatgtgttgtgcacaaagtgcaagggggcagggtctaaatcaggtgcttcattgaaatgtcctggatgccaaggtaaaggaatgaaagtttcgatcagacaacttggccctatgatccagcagatgcagcacccatgtaatgattgtaggggtactggtgagaaaatcaacgagaaagacaggtgtccacagtgcaagggtgagaaagttgtgcaggagaagaaggtgttggaagttgttgtggataagggtatgcaaaatggacaaaagataacatttccaggagaggctgatgaagagcctgatactgtcactggagacatagtttttatcttgcaacagaaggaacatcccaagtttaagcgaaagggagatgacctctttgtagaacacaccttgaccttgactgaggctctctgtggttttcagtttgtcttgactcacctagataatagacagctgataatcaagtcccaacctggagaagttgtcaagcctgatcaatttaaggccataaatgatgaaggaatgccaatgtaccaaaggccattcatgaaagggaaactgtacattcacttcactgtggacttccccaacatattaaccccagagttgtgcaagaatcttgaagcagtgctgccagcaaggcctaaaacacaagcgtccgatatggaattggacgagtgtgaggaaaccaccttgcatgatgtgaacattgacgaggagatgcgtaggaagcagcagcaacaggcccaagaggcatacgatgaagatgatgacgatatgcatggtggcggtgcacagagagtgcaatgtgcacaacagtaatttgatactctttttcagtagataacagtacttaatttcgtcaagtatcaagtcttgttcttgggtttgataatagggctgataagaattgacagtcaggaacaacattgcttctagtaggagatatagattattactatgactttgaaattttatttatgcataaaactataagcaaaattttgtgacctg

SEQ ID NO: 8300 - DNA, 1536 bp, Avena sativa
gaccggcgacctcgattccacacgatcaaagcagctagggtttcttctaccttccgctcggcgcagctcggaacttttcaggcgacaagatgttcgggcgcggggcgccgaagaagagcgacaacacgcggtactacgagatcctcggagtgcccaaggacgcggccccggaggacctcaagaaggcctaccgcaaggccgccatcaagaaccaccccgacaagggcggtgacccagagaagttcaaggagctagctcaggcatatgaagttctgagtgatcccgagaagcgggagatctatgatcagtatggtgaggatgccctcaaggaggggatgggaggtggtggaggaatgcacgatccatttgacatcttccagtcattcttcggtggtggtggtggagggccctttggaggtggtggtagcagcagaggcaggaggcaacgcaggggtgaggatgtggttcatcctctgaaggtttccctcgaggaattgtacaatggcacatcaaagaagctttctctttcgcgcaatgtgctctgctcaaagtgcaatggcaagggctcaaaatctggggcttcgatgaagtgtgctggttgccagggagctggttataaggtccaaatacgccagttgggaccaggaatgattcagcaaatgcagcaaccttgcaatgagtgcaggggaactggtgagaccatcagcgacaaggatagatgtgggcagtgcaagggcgagaaggttgtgcaagagaagaaggttctggaggtagtggtcgagaagggtatgcagcacagccagaagatcacattccctggcgaggccgatgaagcgcctgataccgttactggggacataatcttcgtcctgcagcagaaggagcatcccaagttcaagcggaagggcgatgacctcttctacgagcacactcttaccctcactgaagccctgtgtggcttccaatatgttcttactcatttggacggcaggcagctgctcatcaagtccaaccctggcgaagtcgtcaagcctgactcgttcaaggcgatcaatgacgagggcatgcccatgtaccagaggccattcatgaagggcaagctctacatccacttcacggtggacttcccagactcgctgaacccagaccagtgcaaggccctagagaccgtcctcccgcccaagcccgtgtcgcagtacacagacatggagctggacgaatgcgaggagaccatggcatatgacattgacatcgaggaggagatgaggaggcggcagcaacagcaggcacaggaggcctatgacgaggacgaggacatgccaggtggtggtggccagcgtgtgcagtgtgcccagcagtaggaagatgtttgtgaccgtcgaccgatcagtttgtttccatcgcttcatcgcgatgctgttctcaagttttccaagttaggcgccttacgatgtgaactttggtgctagtatatgatattacctactctactaaacaatgtctcacgtcgttcagtaatattatctgtgttctcgt

SEQ ID NO: 8301 - DNA, 1633 bp, Avena sativa
cgaccggcgacctcgattccacacgatcaaagcagctagggtttcttctaccttccgctcggcgcagctcggaacttttcaggcgacaagatgttcgggcgcggggcgccgaagaagagcgacaacacgcggtactacgagatcctcggagtgcccaaggacgcggccccggaggacctcaagaaggcctaccgcaaggccgccatcaagaaccaccccgacaagggcggcgacccagagaagttcaaggagcttgcccaagcatatgaagttttgagtgatcctgagaagcgggagatctatgaccagtatggtgaggatgccctcaaggaggggatgggaggtggtggaggaatgcatgatccatttgacatcttccagtcattcttcggtggtggtggtggagggccctttggaggtggtggtagcagcagaggcaggaggcagcgcaggggtgaggatgtggttcatcctctgaaggtttccctcgaggaattgtataatggcacatcaaagaagctttctctttcgcgcaatgtgctctgctcaaagtgcaatggcaagggctcaaaatctggggcttcgatgaagtgtgccggttgccagggagctggttataaggtccaaatccgccagttgggaccaggaatgattcagcaaatgcagcaaccttgcaatgagtgcaggggaactggtgagaccatcagcgacaaggatagatgtgggcagtgcaagggcgagaaggttgtgcaagagaagaaggttctggaggtagtggtcgagaagggtatgcagcacagccagaagatcacattccctggcgaggctgatgaagcgcctgataccgttactggggacataatcttcgtcctacagcagaaggagcatcccaagttcaagcggaagggcgacgacctcttctatgagcacactctgaccctcaccgaagctctgtgtggcttccaatatgttcttactcatttggacggcaggcagctgctcatcaagtccaaccctggcgaagttgtcaagcctgactcattcaaggcgatcaacgacgagggcatgcctatgtaccagaggccattcatgaagggcaagctctacatccacttcacggtggacttccccgactcgctgaacccggaccagtgcaaggccctagagactgtcctgccgcccaagcctgtgtcgcagtacactgatatggagttggatgagtgcgaggagaccatggcgtacgacatcgacatcgaggaggagatgaggaggcggcagcaacagcaggcccaggaggcctatgacgaggacgaggacatgccaggtggtggtggccagcgtgtgcagtgtgcccagcagtaggaagatgtttgtgaccgtcgaccgatcagtttgtttccatcgcttcatcgcgatgctgttctcaagttttccaagttaggcgccttacgatgtgaactttggtgctagtatatgatattacctactctactaaacaatgtctcacgtcgttcagtaatattatctgtgttctcgtttgaattgccgttagcccgtgacatgtttattgcttgttcgctgttgacgaggtggcatcatgttgacgtaatcaattgttgcaaagatttgggtg

SEQ ID NO: 8302 - DNA, 1707 bp, Manihot esculenta
agcgtctagaagaccaagactccctcgaatccacaagccacaagcaatacagaacatgctaattctagactcttctgaatccatcacaccaggattcaatatccaccgtccattatctttccagcacacttcacccatcctcatataaatatctctctccctcaattcttctacgctattcattctctgaattttaccttgcgtgtccagagccttctcaaggtgaagaagcgaaatccaaagtttttgatttttgggttcgtggttttttttttcagtgtgttcgattttgtatagagaggagacgagatgtttgggagagcacctaagaagagtgataataccaggtattatgagattctgggagtgtccaagaacgctagccaggacgatttgaagaaggcttacaggaaagcagcaatcaaaaaccatcctgacaagggtggcgatcctgagaagttcaaagagctggcccaggcttatgaagttttgagtgatccagagaagcgtgagatctatgatcaatatggtgaggatgcacttaaggaaggaatgggtggtggtggtggtgtccacaacccttttgacatttttgaatccttctttggtgggagcccatttggaggtggcagcagtcggggaaggaggcagaggcaaggagaggacgtggttcatccattgaaggtctctttggaggatctatatctgggtacaactaagaagctctctctctcccgtaatgtgatatgctccaagtgtaacggaaagggatcaaagtctggagcttccatgaaatgtcctggttgccagggcactggtgtgaagatctcagtgaggcagcttggcccatcaatgattcagcagatgcagcattcttgtaatgaatgtaagggaactggagagtctattagtgagaaggacaaatgcacgcaatgcaagggggagaaggttgttcctgagaagaaggtgttggaggtcatagtggagaagggcatgcatcatggacagaaaattacattccctggtgaagctgatgaagcgcctgatacaatcactggagatatagtttttgtacttcagcaaaaggaacatccaaaattcaagagaaagggcgatgaccttattgtggagcacactctggccctcactgaagctctttgcgggtttcagtttgtattgacacacctggatggcagacagcttcttataaaatcaaaccccggggatgttgtcaaacctgactcatacaagggaatcaatgacgagggtatgcccatgtaccaaaggccattcatgaaggggaagctatacattcatttcaatgtggagttccctgattatttggccgcagatcaggttaaggcgcttgaggtgattttgcctgcaaggccatcgagtcagttgacagatatggagctagatgtgtgtgaggagactacactgcatgatgttaatatggaggaggagatgagaaggaagcagcaacaggctcgacaggaggcatatgaagaggatgaagatacgcctagcggcgcacagagggttcaatgtgcccagcagtgatttaattcaatttagtgctgtaggttgggctacttgtggagcttgaaacatgaatacatgtaatggacttgtaaaccaagtggttttgtgatgataatcttgaaaattttaaagaaaatgacaggattttcttaaatgttaatt

SEQ ID NO: 8303 - DNA, 1490 bp, Phalaenopsis aphrodite
ctgagaataggagcaagatgttcgggagggcgccgaagaagagcgacaacacgaggtattatgagattctaggcgtgtcgaagaacgcgtcgcaggatgatttgaagaaggcgtatcgcaaggcggccatcaagaaccatccggataagggaggcgatccggagaagtttaaagagttggcccaagcttatgaagtgctgagcgaccctgagaagagggatatatatgatcagtacggcgaagacgcactcaaggaaggaatgggtggtgccgcccatgatccctttgatattttccaatctttcttcggtggaaacccctttggtgatcgtggcggtggccgtggacgcaggcagaggagaggagaagatgtgattcatccattgaaagtctccttggaagaactctacagcggaacttcgaaaaaactctcactttctcgcaatgctctttgctcaaaatgcaaagggaagggatctaaatccggcgcatcaatgaaatgctctggttgtcagggttcgggtatgaaggtctctattcgccagttggggccatccatgattcaacagatgcagcatccctgtaatgagtgtaaagggactggtgagaccattagtgacaaggaccggtgtccccagtgcaaaggagagaaagttgtgccggaaaagaaggtccttgaggtccatgttgagaagggtatgcagaatgggcagaaaatcaccttccccggggaggctgatgaagcgccggactgtctcaccggcgacattgtgtttgtgctacaacaaaaagaccactctaagttcaaaagaaaaggcgatgatctcttcgtcgagcacacgctatccctaactgaagccctctgtggcttccacttcatattaacccatctggatggccggcagcttctcatcaaatcaaatcccggcgaagtcgtcaagcccgatcaattcaaggccataaacgacgagggcatgccgatgtaccagaggccgttcatgagaggcaagctttacatccatttcaccgtggagttcccagactcactgagcccggaacagtgcaaatctctggagtcgatcctccccgcgagggctcggactcagctgacggacatggagattgatgagtgcgaggagacgacactgcacgatgtgaacattgaggaggagatgaggaggaagcagcagagccaagctcaggaggcctatgatgaggatgaggagatgcatggcggtgctcagcgagtgcagtgtgctcagcaatgagagaggacatggaagcgagctagctgcctctgttcttatctatgttttgaatacttagttttgttgttaagaaccgtgtagccatttgtggagctttggctgaactctataaaatgaagtttatgtttcctacgtactctgttactattgtttagttcatcattttagttgtgtttctgcagattaataatgggaaaactattctctctggtttactaaaaa

SEQ ID NO: 8304 - DNA, 1390 bp, Phalaenopsis aphrodite
agaataggagcaagatgttcgggagggcgccgaagaagagcgacaacacgaggtattatgagattctaggcgtgtcgaagaacgcgtcgcaggatgatttgaagaaggcgtatcgcaaggcggccatcaagaaccatccggataagggaggcgatccggagaagtttaaagagttggcccaagcttatgaagtgctgagcgaccctgagaagagggatatatatgatcagtacggcgaagacgcactcaaggaaggaatgggtggtgccgcccatgatccctttgatattttccaatctttcttcggtggaaacccctttggtgatcgtggcggtggccgtggacgcaggcagaggagaggagaagatgtgattcatccattgaaagtctccttggaagaactctacagcggaacttcgaaaaaactctcactttctcgcaatgctctttgctcaaaatgcaaagggaagggatctaaatccggcgcatcaatgaaatgctctggttgtcagggttcgggtatgaaggtctctattcgccagttggggccatccatgattcaacagatgcagcatccctgtaatgagtgtaaagggactggtgagaccattagtgacaaggaccggtgtccccagtgcaaaggagagaaagttgtgccggaaaagaaggtccttgaggtccatgttgagaagggtatgcagaatgggcagaaaatcaccttccccggggaggctgatgaagcgccggactgtctcaccggcgacattgtgtttgtgctacaacaaaaagaccactctaagttcaaaagaaaaggcgacgatctcttcgtcgagcacacgctatccctaaccgaagccctctgtggcttccacttcatattaacccatctggatggccggcagcttctcatcaaatcaaatcccggcgaagtcgtcaagcccgatcaattcaaggccatcaacgacgagggcatgccgatgtaccagaggccgttcatgagaggcaagctttacatccatttcacagtggagttcccagactcactgagcccggaacagtgcaaatctctggagtcgatcctccccgcgagggctcggactcagctgacggacatggagattgatgagtgtgaggagacgacgctgcacgatgtgaacattgaggaggagatgaggaggaagcagcagagccaggctcaagaggcctatgatgaggatgaggagatgcatggcggtgctcagcgagtgcagtgtgctcagcaatgagagaggacatggaagcgagctagctgcctctgttcttatctatgttttgaatacttagttttgttgttaagaaccgtgtagccatttgtggagctttggctgaactctataaaatgaagttttat

SEQ ID NO: 8305 - DNA, 1497 bp, Lippia dulcis
ctctctacctcaagcttgctaccgcctctccctctctctatcccttccctactcgaactcgaagactcatctgtagagatcgggagagatgtttggtagagcgccgaagaaaagtgacaacaccaagtactatgagatcttgggagtatcgaagaacgcttcgcaggatgacctgaagaaggcttatcgtaaatctgccattaaaaaccaccccgataaaggcggagatccggaaaagtttaaggagattgctcaagcatatgaagtcttgagtgatccagagaagcgggagatatacgaccagtatggtgaggatgctctcaaggaaggaatgggtggtggaggtggtgcaggccacaacccatttgacatcttcgaatccttttttggtggtagtccttttggaggtggtggaagtagcagaggcaggaggcaaagaaggggagaggatgttattcatcctctcaaggtttccctggaagacttgtacaatgggatatctaagaaactatccctctcgcgcaatgtgctctgccccaaatgcaaagggaaagggtcaaagtctggagcttcaatgaaatgtcctggttgtcaaggatctggtatgaaagtatctattagacatctcggcccatccatgatccagcagatgcagcacccttgcaatgaatgtaagggtactggtgaaactattaatgataaggaccgctgcacccagtgcaagggtgagaaggttgtgcaggagaagaaggtgctggaagtgatagttgagaagggtatgcagcatggacagaaagtcactttcccaggcgaggctgatgaagcgcccgacactgtcacgggagatattgtctttgtactacaactgaaggagcacccgaaattcaagagaaagggtgatgatctatttgtggagcactccttgactctgactgaagcactatgtggtttccaatttatcttgactcatttggatagtcgtcaactacttattaaatccgaacctggcgaagttatcaagcctgatcagttcaaggccattaatgatgaagggatgcccatgtatcagaggccgttcatgaaagggaaattgtatatacaattttccgttgattttcctgaatctctgagccctgagcaaagcaaagccttggcggcggtgctgccagcaaagccagcatctaaactgactgatatggagatagatgagtgtgaggagactacattgcatgacgtaaatatggaagaggagatgcgtagaaagcagcaacaacgtgcccaagaggcctacgaggaagatgatgacgacatgcacggtggggcccagcgcgtgcagtgtgctcagcaataatgtgtgaaggaaggagcctagttgagggtgggctgtgactggtatcttggtttggcaagtttaggtgagatgatgatagtgtcctatgctatatttaatatttgttatagtttcttgttgtttgcgacggtactgggaatatattc

SEQ ID NO: 8306 - DNA, 1681 bp, Tripterygium wilfordii
cgactgactgacattccaatctcccaccgtccatcctctccattaaataaccttgtcgtccctctcgatcactcgccgtctcgcgttgttctctctttgactctttgtggttctctgcaaccgaacgaagatcgggagagaaagatgtttgggaggccgcctaagaagagcgacaacaccaagtactatgggatccttggggtctcgaagaacgcatcccaagatgatctgaagaaagcttaccgtaaagcagctatcaagaaccatcctgacaagggtggtgatcctgagaagtttaaggagctggcacaagcatatgaggttctgagtgatccagagaaacgtgagctatatgatcagtatggtgaggatgctctcaaggaaggaatgggtggtggcggtggtggccatgatccgtttgacatattttcttcattctttggtggcagcccatttggtggtggtggaagcagtagagggagaaggcagaggaggggtgaggatgttatccatcccctaaaggtgtccttggaagatctctataatgggacatcgaagaagttatccctctctcgcaatgtcatctgctctaagtgcaagggcacagggtctaagtcaggtgcatccatgaaatgttctggctgtcaaggttctgggatgaaggtctccattagacaccttggtccttcaatgattcaacagatgcaacatccttgcaacgaatgtaagggtactggtgagatgatcaacgataaggatcgttgccctcagtgcaaaggtgagaaggtcacgcaagagaagaaagtgttggaagtcgtcgtggaaaagggtatgcaaaatgggcagaagattacattccctggagaagcggacgaggcgccggacactctcactggggacattgtttttgtcctacaagagaaggggcatccaaaattcaagcgaaagggtgatgatctatttgttgaacgcacattgtctctcacagaggcgctgtgtggcttccatttcattattagtcatttggatggaaggcagcttatcattaaattccaacctggtgaagttgttaagcctgaccaattcaaggccataaacgatgagggaatgccaatgtaccaaagacctttcatgaagggcaaattgtacattcatttcactgttgaattccctgacacactcaccccggagcaaagcaaggctctggagtctgttcttcctccaaggacctcgacacagttgactgacatggagctagaagaatgtgaggaaactacgctgcatgatgtgaacatcgaagaggagatgcggcggaaagagcagcaacgtgcacaagaggcttatgatgaggatgaagacatgcatggtggtgcacagagagtccaatgtgctcagcaatagtgggaacgcaagagtggaagtgacttgcatctgagagggatgtagcgccctggactccttgctgtttaagagtataagcttctcaactttattgcttttcattgtaggatttggtgtgctatgtatggaaagatttgattaacattttggattgtctagaacaaattaagaattatgtcattgattcttgcagattatttattattatgaagtgaaggcaatgatctttctctctttcagtgggatgcctgattatgtatcaactcttttaggtatcagc

SEQ ID NO: 8307 - DNA, 1269 bp, Raphanus sativus
  misc_feature (485)..(485): n is a, c, g, or t
  misc_feature (503)..(503): n is a, c, g, or t
  misc_feature (680)..(680): n is a, c, g, or t
  misc_feature (773)..(773): n is a, c, g, or t
  misc_feature (911)..(911): n is a, c, g, or t
  misc_feature (1118)..(1118): n is a, c, g, or t
tgagcgacccagagaagagagagatatacgatgagtacggagaggatgcactcaaggaaggaatgggtggtggaggaggaggtgggcatgacccttttgatatcttctcatccttctttggaggtggcagcccctttggaggtggtggtagcagcagagggaggaggcagaggcgtggtgaagatgttgttcatcctttgaaagtttcccttgaggatctctaccttgatactaccaagaagctctctctttctaggaacgctctctgctctaagtgcaacggaaagggttcgaaatctggagcctcgatgaagtgcggtgggtgtcaggggacgggtatgaaggtgacgatcaggcagcttggacctgggatgatacagcagatgcagcatgcttgtaacgagtgcaaaggcacgggggagactatcaacgatcgtgacaggtgtccgcagtgcaaaggagacaaggtcgtccccgagaagaangttcttgaagtgaatgtngagaaagggatgcagcacagtcagaagatcacttttgaaggacaagcagatgaagcgcctgacacagtcactggagatatagtgtttgtcattcagcagaaagagcacccaaagttcaagagaaaaggagaagacctctttgtagaacacacactctctctcaccgaagctctatgnggcttctccttcgtcctcacccacttggatggcaggaatcttctcatcaaatctcatcccggggacgtcgttaaacctgattcatacaaggcnataagcgatgaagggatgccgatataccagaggccattcatgaagggtaagctctacatccacttcacagtggatttcccggactcgctaacccctgaccagaccaaagcatttgaagctattctgcccaagccttcnactactcagctgagcgacatggagatagatgagtgcgaggagacaacgctgcacgatgtcgacattgaggatgagatgagaaggaaagcacaagctcagagagaggcttatgatgatgacgaaggcgatgatgaccatcctggaggtgcgcagagggtgcaatgtgcccagcagtaagtaaagtaacccgttagagaaaggacgtgntgagggggatttggctccaacatttgcctcttccttttctttattttcagtgtatttggaagtcttatggagtttgctatggtttaagacttggaaaaccaacttgtttcgttctctcactcttaaattaatgacagtattgaaattttgt

SEQ ID NO: 8308 - DNA, 1582 bp, Tripterygium wilfordii
tctctgtggttctctgcaaccgaatcaagatcgggatctgatagttgattggttagtaattgtaatcgaaaggagataaaagatgtttgggagagcgcctaagaagagcgacaacaccaagtactatgagatccttggggtctcgaagaacgcatcacaagatgacctcaaaaaggcttatcgtaaagcagctatcaagaaccatcctgacaagggtggtgatcctgagaagtttaaggagctggcacaagcatatgaggttctgagtgacccagagaaacgtgagctatatgatcaatatggtgaggatgctctcaaggaaggaagtggggggtggtggtggtggccatgatccatttgacatattctcttcattctttggtggcagcccatttggtggtggtggaagcagtaggggaagaaggcaaaggaggggtgaggatgttatccatcccctgaaggtgtccctggaagatctttacaatgggacgtcaaagaagttgtccctctctcgcaatgttatctgctctaagtgcaaaggcaaagggtctaagtcaggtgcatcaatgaaatgttctggctgtcaaggttctgggatgaaggtctccattagacaccttggtccttcaatgattcagcagatgcaacatccttgcaacgaatgtaagggtactggtgaaatgatcaatgacaaggatcgttgccctcagtgcaagggtgaaaaggtgattcaggagaagaaagtgttggaagttgttgtggaaaagggtatgcaaaacgggcaaaggattacattccctggagaagctgatgaggcacccgatactctcaccggggacattgtttttgtcctacaacagaaggagcatccaaaattcaagcgaaagggtgatgatctttttgttgagcatacattgtctctcacagaggcactgtgtggcttccacttcattattacccatttggatggaagacagcttatcatcaaatcccaacctggtgaagttgttaagcctgaccaattcaaggcggtaaacgatgaaggaatgccaatgtaccaaagacctttcatgaagggcaaattgtacattcatttcagtgttgacttccctgacacacttgccccagagcagtgcaaggctctggagactgttcttcctccaaggacctcaacatcgttgactgatatggagctagaagaatgtgaggaaactacactgcatgatgtgaacatcgaggaggagatgcggaggaaagagcagcaacgtgcacaagaggcttacgatgaggatgaagacatgcatggtggtgcacagaaagtgcaatgtgctcagcaatagcgggggaacgctacgcaagagtggaagtgacttgcatctgagagggttgaagcaccctggacactccttgctgttttaagagaataagattataaaactttattgctttttattgtaggatatagtgtgctagttgatgcttttggatttaaactcgtaaatgtatggaaagatttagttaatatcgattcttggtttatgtaattcattcttgcatatttttatatgaaatggattcaatg

SEQ ID NO: 8309 - DNA, 1518 bp, Avena sativa
ggcgacctcgattccacacgatcaaagcagctagggtttcttctaccttccgctcggcgcagctcggaacttttcaggcgacaagatgttcgggcgcggggcgccgaagaagagcgacaacacgcggtactacgagatcctcggagtgcccaaggacgcggccccggaggacctcaagaaggcctaccgcaaggccgccatcaagaatcaccccgacaagggcggcgacccagagaagttcaaggagcttgcccaagcatatgaagttttgagtgatcctgagaagcgggagatctatgaccagtatggtgaggatgccctcaaggaggggatgggaggtggtggaggaatgcatgatccatttgacatcttccagtcattcttcggtggtggtggtggagggccctttggaggtggtggtagcagcagaggcaggaggcagcgcaggggtgaggatgtggttcatcctctgaaggtttccctcgaggaattgtataatggcacatcaaagaagctttctctttcgcgcaatgtgctctgctcaaagtgcaatggcaagggctcaaaatctggggcttcaatgaagtgtgccggttgccagggagctggttataaggtccaaatacgccagttgggaccaggaatgattcagcaaatgcagcaaccttgcaatgagtgcaggggaactggtgagaccatcagcgacaaggatagatgtgggcagtgcaagggcgagaaggttgtacaagagaagaaggttctggaggtagtggttgagaagggtatgcagcacagccagaagatcaccttccctggcgaggctgatgaagcgcctgatactgttacgggggacataatcttcgtcctacagcagaaggatcatcccaagttcaagcggaagggcgacgacctcttctatgagcacactctgaccctcaccgaagccctgtgtggcttccaatatgttcttactcatttggacggcaggcagctgctcatcaagtccaaccctggcgaagttgtcaagcctgactcattcaaggcgatcaacgacgagggcatgcccatgtaccagaggccattcatgaagggcaagctctacatccacttcacggtggacttccccgactcgctgaaccccgatcagtgcaaggccctagagactgtcctgccgcccaagcctgtgtcgcagtacacggacatggagctagacgaatgcgaggagaccatggcgtacgacattgacatcgaggaggagatgcggaggcggcagcaacagcaggcccaggaggcctatgacgaggacgaggacatgccaggtggtggcggccagcgtgtgcagtgtgcccagcagtaggaagatgtttgtgaccgtcgaccgatcagtttgtttccatcgcttcatcgcgatgctgttctcaagttttccaagataggcgccttacgatgtgaactttggtgctagtatatgatattactactctactaaacaatctgtcaggtcgttcagtaatatta

SEQ ID NO: 8310 - DNA, 1565 bp, Brachypodium distachyon
ctcctcacaaaccgatcccgaccgcgcgacctcgcttccccaccggatcaaacagctagggtttcctcggaattttcgttctcttcccccagcaggcgagatgttcgggcgcgggccgccgaagaagagcgacaacacgcgctactacgagatcctgggcgtgcccaaggaagcgtcccaggacgacctcaagaaggcctaccgcaagtccgccatcaagaaccaccccgacaagggcggcgaccccgagaagttcaaggagatagctcaggcttatgaggtactcagtgatcctgagaagcgagagatctatgatcagtatggtgaggatgccctcaaggagggaatgggaggtggaggaggaatgcacgacccttttgacatattccagtcattctttggaggcagtccctttggaggcggtggcagcagtaggggcaggcggcagcgcaggggtgaggatgttgttcatcctctaaaagtttcccttgaggaattgtacaatggaacatcaaagaaactctctctttcacgcaatgtgctctgctccaagtgcaatggcaaggggtcaaagtctggcgcttcaatgaagtgtgctggttgccaaggagctggttataagatgcaaatccgccagttgggaccaggaatgattcaacaaatgcagcagccttgcaacgactgcaggggaactggggagaccatcagtgacaaggatagatgcccgcagtgcaagggggagaaggtttcacaagagaagaaggttcttgaggtggtggttgagaaggggatgcagcatggccagaagatcactttccccggagaggctgatgaagcgcctgataccctcactggagacataatctttgtcctccagcagaaggagcaccccaagttcaagagaaagagcgacgacctcttctatgagcacaccctgaccctcaccgaagcactgtgcggcttccagtatgttctgactcatttggatggcaggcagcttctcatcaagtccaaccctggcgaagtagtcaagcctgattcattcaaggcgatcaacgacgagggcatgcccatgtaccagaggccattcatgaagggcaagctctacatccacttcacggtggatttcccagactcgctgaacccggaccagtgcaaggcccttgaggcggtcctcccgcccaagccggcttcccagtacacggatatggagctggatgagtgtgaggagacgatggcatatgacatcgacatcgaggaggagatgaggaggcggcagcaacagcagcagcaggaggcctatgatgaagacgaggacatgcccggcggtggcggccagcgggtgcagtgtgcccagcagtagggggttctgatgttgttggcggcaatttgttctggtcgcttgtttgcgatgcttttctcaagttttcccctgttattagaggtgccttacgtggaaccttttggtgctagttatatgatatgagcatttgactctatacaatggcagtttcgctcagaaaatatttgtgttgtcgtctggctggcacaagacgtttactcgt

SEQ ID NO: 8311 - DNA, 1489 bp, Capsicum annuum
ggcgacgaggataatagaatcttgaaaaaaattaggaagaaaagatgtttggaagaggaggtaaaaagcagagtgataatacaaggtattatgaaatattgggtgttccaaagaatgcaacagaagatgaaatcaagaaagcttatagaaaagctgctatgaaaaatcaccctgataagggtggtgatcctgaaaagtttaaggagctagctcaagcttatgaggttttgagtgactcacagaagcgtgaaatttacgatcaatatggagaagatgcactgaaagaaggaatgggtggtggtggtggcatgcacgatccattcgatatctttgaatccttctttggtggaaatccatttggaggtggtggtagtggtagagggcgaagacagaggagaggtgaagatgttgtgcatccattgaaggtctctcttgaggacctttacagtgggataaccaagaaactctccctttcgcgcaatgtcatttgctccaagtgtagtggcaaggggtcaaagtctggtgcttcaactaagtgttctggttgtaaaggtactggtatgaaggtttcaatcaggcaacttggtcctggaatgattcagcaaatgcaacatccttgtaatgaatgcaagggcaccggagagacgatagatgataaggaccgttgccctcaatgcaaaggtgaaaaggtagtcccggaaaagaaagtccttgaagttcatgttgaaaaaggaatgcaaaatggagagaaaattacattccccggagaggctgatgaagcgcctgatacagtcactggagatatagtttgtgtgctccagcagaaagaacatccgaggttcaagcgtaagggtgaagatttgtttgtagatcacacattgagcctaactgaagcatcgtgtggtttccacttcatattgacacacttggatggcagacaactcctcataaaatcaaatcctggagaagttgttaaacctgatcaattcaaggcgattaacgatgaaggaatgccggtgtaccaaagaccattcatgaagggtaaattgtatattcatttcatcgttgaattccccgattcattgagcctggaacaagtgcaggctctagaggcaatcttaccagcaagacctaagtcacagtactcggacatggagctggatgaatgtgaagaaactacattacatgatgtgaatatggaggaggaaatgagaaggaaacaagctgcacaacaggaagcatatgatgaggatgaagagatgcctggtggtggagcacagagagtacaatgtgcacaacagtaaacatcaaagaggttttggtgcagtagcaagatcagataatggggagggcaagaagtatccatcttgaatttgcttctagtttggtttttactactaccattctcgttgttttggtaatgccatgtactgggaagtcaaaacagctgcttaatctagtgaaacagtaatataattttcttttcccc

SEQ ID NO: 8312 - DNA, 1451 bp, Phalaenopsis aphrodite
ctttctgaaactaggaagctgatctgagaataggagcaagatgttcgggagggcgccgaagaagagcgacaacacgaggtattatgagattctcggtgtgtcgaagaacgcgtcgcaggatgatttgaagaaggcgtatcgcaaggcggccatcaagaaccatccggataagggaggcgatccggagaagtttaaagagttggcccaagcttatgaagtgctgagcgaccctgagaagagggatatatatgatcagtacggcgaagacgcactcaaggaaggaatgggcggtgctgcccatgatccctttgatattttccaatctttcttcggtggaaacccctttggtgatcgtggcggcggccgtggacgtaggcagaggagaggagaagatgtgattcacccattgaaagtctccttggaagaactctacagcggaacttcgaaaaaactctcactttctcgcaatgctctttgctcaaaatgcaaagggaagggatctaaatccggcgcatcaatgaaatgctctggttgtcagggttcgggtatgaaggtctctattcgccagttggggccatctatgattcaacagatgcagcatccctgtaatgagtgtaaagggactggtgagaccattagtgacaaagacaggtgtcagcagtgcaaaggagagaaagttgtgccggaaaagaaggtccttgaggtccatgttgagaagggtatgcagaatgggcagaagatcaccttcccaggggaagccgatgaagcgccggactgtctcaccggcgacatcgtgtttgtcctacaacaaaaggaccactctaagttcaaaagaaaaggcgacgatctcttcgtcgagcacactctatccctaactgaagccctctgtggcttccacttcatactaacccatctcgatggccggcagcttctcatcaaatcaaaccccggcgaagtcgtcaagcccgatcaattcaaggccatcaacgatgagggtatgccgatgtaccagaggccattcatgagaggcaagctttacatccatttcaccgtggagttcccagactcactgagcccggaacagtgcaaatctctggagtcgatcctccccgcgagggctcggactcagctgacggacatggagattgatgagtgcgaggagacgacgctgcatgatgtgaacattgaggaggagatgaggaggaagcagcagagccaggctcaagaggcctatgatgaggatgaggagatgcatggtggtgctcagcgagtgcagtgtgctcagcaataagagaggacatggaagtgagctagctgcctctgttcttatgtatgttttgaatacttagttttgttgttaagaaccgtgtagccatttgtggagctttggctgaactctataaaatgaagtttatgtttcctacgtactctgttattattgtttagttcat

SEQ ID NO: 8313 - DNA, 1651 bp, Elaeis guineensis
ccttcggtcgcgacgcatttggagttcttggctctcgctttttgatcgagatcggtctaggttttcgtcggcggagttgggggttcttggtctccgtttctgcggctttggatcgagatattcgtgaggatttttgggtgatagaagatgttcggaagggcgccgaagaaaagcgacaacacgaggtactatgagatcctcggggtgtcgaagaacgcgtcgcaggaggacctgaagaaagcctaccggaaagccgcgatcaagaaccatcccgacaagggaggtgaccccgagaagttcaaggagttggcccaggcttatgaggttctgagtgatcctgagaagcgtgagatctatgatcaatatggtgaggatgccctcaaggaaggaatgggtggtggcggcggccacgacccatttgatatcttccagtctttctttggtggaaacccctttggaggtggaagcagccggggccgaagacagaggaggggagaagatgtgatccatcctctcaaggtttccttggaagacctgtacaatggcacatcaaagaagctttctctttcccgaaatgtcatctgccagaagtgcaaaggtaagggctcaaaatctggtgcttcgatgacatgccctggctgtcaggttcaggtatgaaggtctcaattcgtcagctgggaccttccatgattcacaatgcagcatccatgcatgagtgcaaggaactggagagaccatcaatgagaaggataggtgcccacagtgcaaaggtgagaaggttgtgcaggagaaaaaagtcctggaggttgtggtcgagaagggtatgcagaatggccagaagataactttccctggagaggcggatgaagcgcctgatacagttacaggagacattgtgtttgtgctccaacagaaggatcatcccaagttcaaaagaaagggtgatgatctctttttcgagcacacgctgtctctcactgaggccctatgtggcttccaatttgtcttgactcatttggataacaggcagttgcttatcaagtcgaaccctggtgaagttgttaagcctgatcaattcaaggccataaatgatgaaggcatgccgatgtatcagaggccgttcatgaggggaaaactctacatccattttacagttgatttcccagattcactgacgcttgagcagtgcaaagctcttgaagctgtgcttcctccaaagcctgtttctcagctgacggacatggagctggatgagtgtgaggagactactcttcatgatgttaacattgaagaggagatgaggaggaagcaggcccaggctcaggaggcatacgaggaggatgaggatgttcatggtggtgcccagagggtgcagtgcgctcaacaatgagtgggagtaggctttctagttcgacatcaagatcacagtctaatttcggtggctataattgtaggcactgctctctatttgctgatgtggtggtattcatcttgctgtggtaattatacagtcaactggtgtatccagcttacgtgtttaatgctttcatcgttactcttttcttcgaatgctttttaaatactgtgggtctgttttcaaaattatctgcattttgatgactacgaaagttgtgatgaatcccttttatca

SEQ ID NO: 8314 - DNA, 1792 bp, Beta vulgaris
  misc_feature (936)..(937): n is a, c, g, or t
gtgctcttctctctctccctcttgtttctctttcctcttcttgcctcacaaatcgaacgaagattgagagaagaaatttagagtgagaagaagatgtttgggaggccaccaaagaagagtgatagtacgaggtactatgagatcttgggagtaccaaaaaatgcttcacctgaagatctaaagaaagcttataagaaagctgccattaagaatcatcctgacaagggtggtgatccagagaagttcaaggaactggctcatgcatatgaagttctaagtgatccagagaagcgtgagatatacgatcagtatggtgaggatgctctcaaggaagggatgggtggtggcggtggggctcatgacccatttgatatcttctcctcattctttgggggtagtccgtttggtggtggtggtgggagtagcagaggccgaaggcaaagaaggggagaggatgttattcatccgctaaaggtctctttggaggacatctacaatggtacatcaaagaaactatcactttcccgcaacgttatctgctccaaatgcaaaggaaaagggtcaaaatctggtgcttcaatgaagtgtcctggatgccaaggatctggagtgaaaatctctatcaggcatcttggtccttctatgatccagcagatgcagcatgcttgtaatgagtgcaagggtactggtgagaccatcaatgacagggatcgttgcctacaatgtaaaggtgagaaggctgtgcaggagaagaaagttctggaagttcatgttgagaagggaatgcaaaatggacaaaagattacatttcctggagaagctgatgaagcgcctgacactgtcactggcgacatagtgtttatactacagcagaaggagcactcaaagtacaagcgaaagggtgatgatcttttttatgagcatacctttccttanngagccctcgtggttttcagttgtatgacccatttggacatagacagtgttaatcaaatctcagcctggagaagttgtaaagccagactccttcaaagcaataaatgatgaaggaatgcctatgtatcagagacccttcatgaaaggcaaactgtatatccacttcacagttgaattccccgactcattggcagtggaccagtgcaagtctctggaggctgtgcttcctcctaggtctgcagcccagctaactgatatggagttggatgaatgtgaggagacaaccctgcatgatgtcaatattgaggaagaaatgcgtcggaaggaggctcgagcccagcaggaggcctacgacgaagatgaggacatgcatggtggtgctcaaagggttcagtgcgctcagcaataatctgacttggacgtgatttcattgatcatgggatggtctactgaaggggataagacatgcccttagcaagttgtacgcgctaaagattaatggctaacgacaagaataagtttatttcgctgttctagtattagcctatcaattcatagatgccttgaaaaattcttgtcgaacgaagtggcattttttctagttgttgaaacaggattttctatctcaattagagatggcgttacttataatggttaggtttgtgtagaacattttttttttgcttcctgacaacgatgatatcataattgttgctaaagccgtggcttgatttgtatggttcaagaaagaattaagtaggccctctctagtggctaaaaattcccaattccctttggtttgtagttttgggtttttaacttctacttttgtcattatccatttattttttgccca

SEQ ID NO: 8315 - DNA, 1633 bp, Platanus occidentalis
gaagtggagaagttgtggtgtgggttctctgatttcgaagccacgtcgattcatcgttgatctctttctagggtttcctcgaaatttggctgatcgattgattccttggacgatttcgtgcaaggttacgatcggattggggtttcggggtgtttaaatttatgcttcttttgccggatctgcttgatttcttgaggtggaaagaggattgaaaggtcggaattgggggttgatctcaaggaatttggttgtgatttattgaatctgactggtttttgaggttccttgctgttgaggaaagatgtttggccgagcgcctaagaaaagcgataatactaggtactatgagatccttggagtctcaaatagtgcgtcgcaggaagatttgaagaaggcttacagaaaggcggccatcaagaatcatccggacaagggaggagatcctgagaagttcaaggagttggcccaggcttatgaggttctgagtgacccagagaaacgtgaaatctatgatcagtatggagaggatgcgctcaaggaaggaatgggtggtggagcaggtggccatgacccgtttgacatattccagtcgttctttggtggaggcggcagcccctttggaggtggtggaagcagcagaggcagaaggcaaagaaagggagaggatgtgatccatcctctgaaagtctctctggaggatttgtacagtggaacatcaaagaagctttctctctccagaaatgtactctgttccaagtgtaagggtaaaggatcgaagtctggtgcttccatgacgtgtgccagttgccaaggatctggcatgaaggtttcaataaggcaccttggcccctctatgatccagcagatgcagcatccttgcaatgagtgtaagggcactggagagactatcaatgacaaggaccgctgcccgcaatgcaaaggtgagaaggttctaccggagaagaaggtgctggaggttattgtcgagaagggcatgcagaatggacagaggataaccttccctggggaagctgatcaagcgcctgacacagccactggggacatagtctttgtcctccagcagaaggagcaccccaagttcaagagaaagggggatgatctcttttatgagcacactttgtccctcactgaagctctctgtggattccaattcataatcacccacttggataacaggcagcttctaatcaaatctaacccgtggggaagtcatcaaacctgaacaatttaaggcgattaatgacgaaggtatgccaatgtaccagaggccattcatgaagggaaagctatatattcacttcacggtggagtttcccgattccttgaccatggagcagtgcaaggcactcgaggcagtgctaccgcctaggacatcaatggagctgacagatatggagctggacgagtgcgaggagactacgatgcatgatgtaaacatcgaggaggagatgcgaaggaagcaggcgcaggctcaagaggcttatgaagaagatgatgactctcacggtggacagagggtgcaatgtgcccagcaatgatggacgatggtaagaatgggtaaaaaggaagcaaagaggcgatttcaatagaaaagagggagaaggagaaggaa

SEQ ID NO: 8316 - DNA, 1496 bp, Cenchrus ciliaris
  misc_feature (73)..(73): n is a, c, g, or t
  misc_feature (84)..(84): n is a, c, g, or t
  misc_feature (96)..(96): n is a, c, g, or t
  misc_feature (99)..(99): n is a, c, g, or t
  misc_feature (101)..(101): n is a, c, g, or t
  misc_feature (210)..(210): n is a, c, g, or t
  misc_feature (288)..(288): n is a, c, g, or t
  misc_feature (312)..(312): n is a, c, g, or t
  misc_feature (351)..(351): n is a, c, g, or t
  misc_feature (363)..(363): n is a, c, g, or t
  misc_feature (379)..(380): n is a, c, g, or t
  misc_feature (388)..(388): n is a, c, g, or t
  misc_feature (390)..(391): n is a, c, g, or t
  misc_feature (393)..(394): n is a, c, g, or t
  misc_feature (426)..(426): n is a, c, g, or t
  misc_feature (531)..(531): n is a, c, g, or t
  misc_feature (543)..(543): n is a, c, g, or t
  misc_feature (564)..(564): n is a, c, g, or t
ccgcgacatcgctccccgtcggatcgaacagctagggtttcggagggattctcctcccctctcgtcggcggcnagatgttcggncgcgcgccgaanaanancaacaacacgcggtactacgagatccttggcgtgcccaaggacgcgtcccaggatgacctcaagaaggcctaccgcaaggccgccatcaagaaccaccccgacaagggnggcgaccctgagaagttcaaggagctagctcaggcttatgaggtcctcagtgaccctgaaaagcgcgagatttatgancagtatggtgaggatgctctcaangagggaatgggaggcggaggagggatgcatgatccattngatatcttccantccttctttggtggtnnaagccccntnngnngtggtggtagcagtaggggcagaaggcagcgnaggggtgaggatgttgttcaccctctgaaggtttctctggacgaattgtacaatggcacatcaaagaagctctccctgtctcgcaatgtactctgctccaagtgnaatggcaagggntcaaagtctggtgcttcatcnagatgtgctggctgccaaggctctggctacaaggtacagatccggcagctgggaccaggaatgatccagcaaatgcaacatccttgcaatgagtgcaagggtactggggagaccatcaatgataaggacagatgcccacaatgcaagggtgagaaggtggtgcaggagaagaaggtcctcgaggtagtggtcgagaagggcatgcagaatggccagaagattacattccctggtgaagctgatgaggcgccggatactgtcactggagacatcatctttgtcctccagcagaaggagcatcccaagttcaagagaaagggcgatgacctcttctacgagcacacactgaccctgactgaatctctgtgtggtttccagtttgttcttacccacttggataacaggcagctgctcatcaaatcaaaccccggtgaagtcgtcaagcctgattctttcaaggctatcaatgatgagggcatgccgatgtaccagaggcccttcatgaagggcaagctttacatccacttctccgtggaatttccggacttcttgaacccggaacagtgcaaggctctcgaagcagtcctcccgcccaagccaacatcacagtacacagacatggagctggatgaatgcgaggagacgatgccttatgacgtgaacattgaggaggagatgaggaggcggcagcagcagcaccaggaagcctacgatgaggacgaggacatgcccggcggtgcgcagagggtgcagtgtgcccagcagtagccagtaggtgctgtagcaagatgacgggggcggcaaatttgttgtttcgcaatgtgcgagtagtactgttgggtctcaagttttcccgcgtattatgtgatatactttcagttataaaatacgatatttgatccgtggagcgggagttttgctggttctgatca

SEQ ID NO: 8317 - DNA, 1310 bp, Silene vulgaris
gaggtattatgagatattgggtgtttcgcagaatgctacgcctgatgaattgaagaaagcttataagaaagctgctattaagaatcatcctgataagggtggtgatcctgagaagtttaaggagttggctcatgcttatgaggtattgagcgatccagagaaacgcgaaatttacgatcagtatggtgaagatgcgctcaaagaaggaatgggtggaggtggcggaatgcatgatcctttcgatatcttcagttcattctttggaggaaatccatttggtggtggtggtagcagtcgcggcagaagacagaggagaggtgaagatgtgatccatcctcttaaggtgtcacttgaggatctctacagcggaactacgaagaaactctctctgtctcgcaatgttatctgctctaagtgcagtgggaaagggtcgaaatctggtgcttctgtgacctgtggaggatgtcaaggaactggtatgaaggtgtcagtcaggcatcttggtccatcaatgattcaacaaatgcagcatccttgtaacgaatgtaagggaacgggggagacaatcagtgacaaggatcggtgccctcagtgcaagggtgacaaagttgtgcccgagaagaaggttcttgaggttgttgtggagaggcgaatgcagaatggacagaaaattaccttcaccggggaagctgatgaagcgcctgagactatcacaggggatattgtgtttgtccttcagcagaaagatcaccctaagtttaagagaaagggtccagacctgttttacgagcatactttgagtctgaccgaggcgctctgtgggttcagatttgtgttaacacacctggacggcaggcagctgcttatcaagtcgaatcccggggaagtaatcaaacctgatcaattcaaagcaatagatgacgaggggatgccaatataccagaggccattcatgaagggcaagatgtacatccacttcactgttgaatttccggactctctcagccctgaccaggtcacagcacttgaggcagtcctgccacctaaaccttcaatgctactgtcagacatggagctggacgaatgtgaagaaacgacaatgcatgatgtgaatattgaggaggagatgaggaggcgacaagctcaggcccaacaagaggcttatgatgaagacgatgagccacagggtggtcaaagggtccaatgtgcacagcaatagtgttactctcaaattagaccgaccgttgttatatgtaatctgaatacttgaaacttgaaagctactgctaattttgaaacactctttttac

SEQ ID NO: 8318 - DNA, 1853 bp, Fragaria vesca
gatgctttcaggagagcagtgagctggtcatgctgcaaatcggcagaaagtgcttttttttgtcggatgtgtatgtacacgccgttgtacacactcgccgttaactgaacgttgatgatagctcactgggtgtgctgaagagtctccgttgctaattaagaaaacaaagcacaaaaataggttgtgttacttgcgtacaattctagatccttcttggactgtctgaagaagcaatcccagccgtccacttggtggccttaagaatcagatagttctctcatcagaaagaacagcaattcaagaaaaatgttcgggagaggtgttccgaagaagagcgacaacagcaagtactatgagatccttggagtccccaagaccgcctcccaagatgatctgaagaaggcttacagaaaagcagccatcaagaaccatcctgataagggtggcgaccccgaaaagtttaaagagttggcccaagcctacgaggtgctgagtgatccagaaaagcgcgaaatctacgaccaatatggcgaggatgcgctcaaggaaggaatgggtggcggaggtggtgcccacgacccatttgatattttccagtctttcttcggcggcggcagccgtaggcagcgaaggggagaggatgtgatccatccccttaaagtttctctggaagatctctacagtggcacatccaagaagctgtccctctcccgcaacataatctgctccaagtgcaagggcaaagggtcaaagtctggtgcttcaatcaagtgtcctggttgccaagggtctggaatgaaagtctctattaggcatctcgggccttccatgatccagcaaatgcagcatccttgcaatgagtgcaagggcaccggtgagaccattaatgacaaggatcgctgccagctgtgtaagggtgagaaagttgtgcaggaaaagaaggtattggaagtccatgtcgagaaggggatgcagaatggacagaggatcacattccctggtgaagctgatgaagcgcctgacactgtcacaggggatattgtctttgtcctgcaacaaaaggaacaccctaagtttaagcggaagggtgacgaccttttctacgaacatacgctgtcccttatggaggcgctctgcggcttccaatttgtattgacacatttggacagcaggcaactcctcatcaaatctcatcccggagaggtagtcaagcctgatcaattcaaggctataaatgatgaaggcatgccaatgtaccagagggcgtttatgaagggtaaactatatatacatttcaccgtggagttcccggactcattgaatccagaacagtgcaagaccttggaagcagtgctgcctcccaggagttctacccagcttactgacatggaactagatgaatgtgaggagactacactgcatgatgtgaacatagaagaagaaatgcgccgtaaacaaggacagcagtctcaagaggcatacgatgaggatgaggatatgcatggtggtgcccagagggtccaatgcgctcaacaatgatttgatcgacttgcttatatcttttgagaaaataaaagttgtgtgttggtgggtcgggtttctatgtagttgtcttggtgtttatttccagtttgggttgtttgtagtcccaactattgggaatttacagagtagctatttagaacatgatccttattctagttcatctgaactggttgtttagctttatatttatatgtcatctgtaagtgtttttacaaagttgtactgatataatcgttattcatagcatatgatctttagctacgacgaacggtgacacagtcacagaacatgatgggtttaagccttta

SEQ ID NO: 8319 - DNA, 1473 bp, Vinca minor
tacatttttgctaagagttgtgaaatcagtaagtagatcgaatcgaagatgtttggaagggcaccgaaaaagagcgataattccaagtactatgagatcttgggtgtttcgaagaatgcctcgcaagaagatctgaagaaggcttatcgtaaagctgccattaaaaatcatcctgataaaggaggcgatcctgaaaagtttaaggagcttgctcaggcttatgaggttctaagtgacgttgagaagcgtgagatttatgatcagtatggagaggatgctttaaaggaaggaatgggcggtggaggtggtggtgtccatgacccatttgatatcttttcgtccttctttggcggtgctagtccttttggaggcggaagcagtagaggccggagacagaggaggggtgaggatgtcattcatccactcaaggtttccctggaggatctctataatggaacctctaagaagctctccctctctcgtaatgtgttatgtcaaaagtgcaagggtaaagggtcaaaatccggagcttccatgaaatgttctggatgtaaagggtctggaatgaaagtttctattagacaccttggcccatctatgatccagcagatgcaacatccgtgcaatgagtgcaagggtactggtgaagccataaatgataaggatcgctgcccacagtgcaagggtgaaaagattgtgcaggagaagaaggtcttagatgtgattgtggagaagggcatgcaaaatggacaaaagattacattccctggcgaggccgatgaagctcctgaaactgttactggagacatagtttttgtcttacaacagaaagagcaccctaagttcaagcgaaagggtgatgacctctttgtcgaacacacattgtctctgactgaggctctttgtggcttccagtttattttgactcacctcgataacaggcagcttcttatcaaatcccaacccggagaagttatcaagcctgaccaattcaaggcaataaatgatgaaggaatggtaatataccagaggccattcatgagaggcaaattgtacatccatttcaatgtggaattcccagaatccctgagcaccgagaactgcgaggcgctcgaacatgtattgcctccaagacccacaaagcaaattactgaaatggagttggatgagtgcgaggagaccacacttcatgatgtcaacatcgaggaggaaatgcgaaggaagagtcagcaggccgcacaagaagcatacgatgaggatgaagatatgcctggtggtgctcagagagtgcagtgtgctcaacagtaagttgatcgtggcaggcgggggaagtagtaggagccacatctgggaggcgagggctcggtattattccaatttaatgggtttgctcaagattacgacttgtctattctattaggacttgtagttggatagtttaatgatttggaatatttgttgtaccccaagatt

SEQ ID NO: 8320 - DNA, 1274 bp, Aquilegia formosa
aaaatgtttggaagagcgccaaagaaaagtgacaatacaaagtactatgagattcttggagtttcaaagaatgcatctcaagatgatttaaagaaagcttataaaaaagctgctattaagaatcatcctgataaaggtggtgatccagagaagttcaaggagttaggtcaggcttatgatgtcctcagtgatcccgagaaacgtgaaatatatgatcagtatggcgaagatgaagtgaataatggaatgggtggaggtggaggtggtcacgatccatttgatatcttccagtcattctttggtgggagtccatttggaggtgggggtagcagcaggggccgaaggcagactagagggaaagatgtggtccatccattgaaggtatctttagaggatcttcacaatggattatccaagaagctttcactctcacgaaatgttatctgctccaagtgcaagggcaaaggatcaaaatcaggtgcttccatgacatgccctggctgtcaaggagccggtgtgaaggtctcaataagacatcttggcccctctatgattcaacagatgcaacatccttgcaatgagtgcaagggcactggagaggcaatcagtgacagggaccgttgcccacaatgcaaaggcgagaaggtcgtgccagagaaaaagatgctgggagtccatgttgagaagggaatgcagaatggacagaggataaccttccctggtgaagctgacgaagcgccggacacagtcactggggacgttgtctttgtccttcagcagaaggagcaccccaagtttaagaggaagggtgatgacctctatgttgagcatagtttgtccctcactgaggctctctgtgggttccagttcatattgacacacttggacaacagacaactactcatcaagtccaaccctggggaagttgtcaagcctgatcaatacaaggcaataaatgacgagggtatgccaatgtaccagaggcccttcatgaggggaaagctgtacatccacttcactgtggagttccctgattcactgacgccagagcaatctaaggccttggagacagtgctaccaccaaggacttcagttcagctaacagacatggagctagacgagtgtgaggagacgacactccatgatgtaaatattgaggaggaaatgcgaaggaagcaatcccaggctcgtgaggcatatgaagatgatgaggacatgcacgggggtgctcagagagtacagtgtgcccagcaataatgattatatgaacttta

SEQ ID NO: 8321 - DNA, 1547 bp, Flaveria ramosissima
ctctctttcgcccaacaacacaactcaaagtcttccgatagcgatctacttcttcgcagatttgtaattgagtattgaagatcgaagaaggagaacaagatgtttggaagagcaccgaagaagagcgataacacgaagtattatgagatccttggggtcccgcagaacgcttcacaggatgatctgaagaaggcttataggaaagcggccattaagaaccatcctgacaaaggtggagatcctgagaagtttaaagagcttgcccaagcatatgaggttctcagtgacccagagaagcgtgagatatatgatcaatatggtgaggatgccttgaaggaaggaatgggcggtggaggtggtggtcatgacccctttgacatattccaatccttctttggtggtagtcctttcggtggcggtggtggtagcagcaggggacgaaggcaacgaaggggagaagatgttgttcatcctctcaaagtttctctcgaggatctttataatggaacttccaagaaactctctctttcacgcaatgtaatctgctccaagtgtaagggcaagggttctaagtcaggtgcttcaatgaaatgtgctggatgtcaaggttctggaatgaaggtttctatcagacatcttggcccatctatgatccagcaaatgcagcatccttgtaacgaatgcaagggtactggagaaaccatcaatgataaggatcgttgcgcccaatgcaagggtgagaaagtcgtgcaggagaagaaagtactggaagtgcatgtggagaagggtatgcagaatggacagaagattacattccctggagaggctgatgaagctcctgacactattaccggagacattgtgtttgtgttgcaacaaaaggagcaccccaagtttaagcgaaagggtgatgacctatttgttgaacacacattgagcttgaccgaggccctatgtgggttccagtttatcttaacccatttggataatagacaacttctcatcaaatctcaacccggagaggttgttaagcctgatcaattcaaggcataacagggataggagatgcatgcaagcgttatgaggggagctgtacctccacttcaccgtagaattcccagattcattgtcaccagatcagtgcaaggcgttggaggcagtgctgccacctaagccttcgatgcagatgacagacatggaactggatgaatgtgaagagacaactcttcatgatgtcaacatcgaagaggagatgagacggaagcaacaagccgctcaagaagcttatgatgaagatgaagacatgcacggtggagcacagagggttcaatgtgcgcaacagtaacttgagtcacagtcaaggtttgctcatctgatagacaataatgtcagttgtgttttgtcttctctttttaattaaatatacgatactattaatgactaaccaaaaaaaaaagaaaaaaaaagtaaactctagacgtgtatacactgactactacagactgaccaagacgacacgaagggaggtagagggggggggggggggg

SEQ ID NO: 8322 - DNA, 1501 bp, Flaveria ramosissima
tctttcaactcaacaaactcaagtctccgattggatctacttcttcgcagatttgtaattgagtattaaagatcgaagaaggagagcaggatgtttggaagagcaccgaagaagagcgataacacgaagtactatgagatccttggggtcccgaagaacgcttcacaggatgatctgaagaaggcgtataggaaagccgctatcaagaatcatccggacaaaggtggagatccggagaagtttaaagagctggcccaagcatatgaggtactaagtgacccagagaagcgtgagatatatgatcagtatggtgaggatgccttgaaggaaggaatgggtggtggaggtggtggtcatgatccctttgacatattccaatccttctttggtggtagtcctttcggtggaggcagtggtggtagcagcaggggacgaaggcaacgaaggggtgaagacgttgttcatcccctcaaagtttctcttgaggatctctataatggaacttccaagaaactctctctttcacgcaatgtaatctgctccaagtgtaagggcaagggttcaaagtcaggtgcttcaatgaaatgcgccggctgtcaaggttctggaatgaaagtttctatcagacatcttggcccatctatgatccagcaaatgcagcatccttgtaacgaatgcaagggtactggggaaaccatcaatgacaaggatcgatgcactcagtgcaagggtgagaaagttgttcaggagaagaaggtactggaagtgcatgtggagaagggtatgcagaatggacagaagattacattccctggagaggctgatgaagctcctgacactgttaccggagacattgtgtttgtgttgcaacaaaaggagcaccctaagtttaagcgaaagggtgatgacctttttgtggaacacacattgagcttaaccgaggctctatgtgggttccagtttatcttaacccatttggataacagacaacttctcatcaaatctcaacccggagaggttgtcaagcctgatcaattcaaggcaataaatgatgaaggtatgccaatgtaccaaagaccatttatgagggggaagctgtacctccacttcaccgtagaattcccagattcattgtcaccagatcagtgcaaggcgttggaggcggtgctgccacctaagccttcgatgcagatgacagacatggaactggatgaatgcgaagagacaactcttcatgatgtcaacatcgaagaggagatgaggagaaagcaacaagcagctcaagaagacttatgatgaagatgaagatatgcacggtggggcacagagagtcaatgtgcacaacagtaattgaatcgttgttaaggtttggtctgatctggtcatttatcatcttaggttttggcaagacaataacgtcaactgtaattttactttatactgctatgtatgtccatctgttttgagaacctttgaggtgtgtggattattgactcattcg

SEQ ID NO: 8323 - DNA, 1752 bp, Amorphophallus konjac
gttgggagcggagagagcccttgcgcagcttccttccgagccgcacaacgccgcaaaggccgatcccggtttcccgagctcggaggggggaggtcgcgcctccatcttcgctgcgctgcggagcagagggtggatcggcctccaccgttggcgccggcgacgtccgtggcctgatctgactggatccggcggcggcggcggaaggcgggcgaagatgttcgggagggcgccgaagaagagcgacaacacgcgctactacgagatcctcgctgtgccgaaggacgcctcccaggatgacctcaagcgagcctaccgcaaggccgccatcaagaaccaccccgacaagggcggcgaccccgagaagttcaaggaattggctcaggcctatgaagtcttgagtgatccagaaaagcgtgaaatatatgatcaatatggagaggatgcactcaaggaaggaatgggtggaggtggtggccatgacccatttgatatcttccagtcattctttggtggcaacccatttggaggtagcagcagagggcggaggcagaagagaggagaggatgtgattcatcccctcaaagtctctctcgaggacctgtacagtgggacctcgaagaagctctctctttctcgcaatgtcatatgttctaaatgcaaaggtaaagggtctaaatctggtgcttccatgaggtgtgctggctgccagggctcgggcatgaaggtgtcaattcggcagctcggccctgggatgatcaacaaatgcagcacccgtgcaatgagtgcaaggggaccggagagaccatcaacgagaaggacaggtgccctcagtgcaaaggtgagaaggtggtgcaggagaagaaagtcctggaggttcacgttgagaaggggatgcagaatggccagaagatcacattccctggagaagctgatgaagcgcctgactgtataaccggtgacattgtcttcgtcctccaacaaaaggagcaccccaagtttaagagaaagggagacgacctctttgtggagcataccctctctctgaccgaggcgctatgcggcttccaatatgtgttgactcatttggatggtaggcagctgctcatcaaaactaacccaggggaagtcatcaaacctgatcaattcaaggggataaacgacgagggcatgcccatgtaccagaagccgttcatgaggggcaagctctacatccatttcactgtggacttccccgactcgttgactctggagcagtgcaaggcgctggagacagtcctcccgtcgaagccctcggtgcagctgaccgacatggaactggacgagtgcgaggagaccacgctgcacgacgtgaacattgaggaagagatgaggaggaagcagcaggccgcgcaggaggcctacgaggaggacgaggagtcccacggcggcgcgcagagggtgcagtgcgcccagcaataaagtgtgtgtcgaagctattataacttctctatgtgtcatctgatatctcgccctgcctgctttctttaagctggacttggattttgtttgctagggatacttggaatgacatgctcgaggaaccaaaaaaacattccccatagtttgcgggtctttattttttcctcgatttttctccgctttgtagtgccctcctttttttataagaaagagattcggacaacgatctcattattgtcaaattgtcgaacggtactgaatgagaattacatccggagctctggcgattggtgt

SEQ ID NO: 8324 - DNA, 1626 bp, Elaeis guineensis
  misc_feature (64)..(64): n is a, c, g, or t
  misc_feature (99)..(99): n is a, c, g, or t
  misc_feature (132)..(132): n is a, c, g, or t
  misc_feature (156)..(156): n is a, c, g, or t
  misc_feature (193)..(193): n is a, c, g, or t
  misc_feature (436)..(436): n is a, c, g, or t
  misc_feature (461)..(461): n is a, c, g, or t
  misc_feature (979)..(979): n is a, c, g, or t
  misc_feature (1005)..(1005): n is a, c, g, or t
  misc_feature (1016)..(1016): n is a, c, g, or t
  misc_feature (1087)..(1087): n is a, c, g, or t
ctgacgcttgccgttagggttctcggctgtccgtcttctctgtttgcatcgggatcgatcgtgngaggggttcgtcggaggagattattgttatcgttncttttagattcgagggactggttagggttttcnggagtagaagatgtttgggaggcngccgaagaagagcgacaacacgaggtactatgagatncttggggtgccgaagaacgcatctcaggatgacctgaagaaggcctaccggaaggccgccatcaagaaccaccccgacaagggcggcgaccccgagaagttcaaagagttggcccaggcctacgaggttctgagtgatcctgagaagcgtgagatatatgatcagtatggagaggatgctctcaaggaaggaatgggtggtggcggtggcggccatgacccattcgatatcttccaatctttnttcggtggaaacccctttggcggangtggaagcagccgaggccgaaggcagaggaggggagaagatgtgatccatcctctgaaggtttctttggaagacctgtacaatgggacatcaaagaagctctctctttctcgaaatgtcatctgccagaagtgcaagggtaagggttcaaaatctggtgcctcgatgaaatgcgctggctgtcaggttccgtatgaagtctcgattcgtcagctggacttccatgattcaacaaatgcagcacccttgcatgagtgcaagggaactggggagaccattaatgagaaggataggtgcccacagtgcaagggtgagaaggttgtgcaggagaagaaagtgctgcaggttgttgttgagaagggaatgcagaacggccagaagataacgttccctggagaggctgatgaagctcctgatacggttacaggagatatcgtgtttgtgctacaacaaaaggatcatcccaagttcaagagaaagggtgatgatctcttctttgagcatacattgtccctcacngaggccctctgtggcttccagtttgncttgacccatntggacaacaggcagttgctcattaagtcgaaccctggtgaagtcgtcaagcccgatcaattcaaggccatnaatgatgaaggtatgccgctgtaccagaggccttttatgaggggaaaactctacatccactttgcggtggatttcccggattcgttgacgcctgaccagtgcaaagctattgaagctgtgcttcccccaaagcctgtttcccagctgacagacatggagatagatgagtgtgaggagactactttgcatgatgttaacatcgaggaggagatgcggaggaagcaggcacaggcacaggaagcatacgaggaggatgaggaggctcatggtggtgcccagagagttcagtgcgctcaacaataagagaaggatttctagtttgatagaatgtgggcagtttaattttgacggctatgattgtcgtcattgttagctatttggtgatgctataatcatctcggtggacagcagactgacgtgtttcaagctgctagagacctctgttctatgcattttgtttttcactcttcatgcaaaaagatttgtctaaatacgtggatggttcggccaaccaccaccatcccgtcaaacttcttagc

SEQ ID NO: 8325 - DNA, 1531 bp, Pseudoroegneria spicata
  misc_feature (139)..(139): n is a, c, g, or t
  misc_feature (708)..(708): n is a, c, g, or t
  misc_feature (1181)..(1181): n is a, c, g, or t
  misc_feature (1417)..(1417): n is a, c, g, or t
ccgttgctgtcgcgaccggcgatctcgtttccccaccggatcaagcagctagggtttctttcgtcttctccgcggagcttggagttcgtgttcatcgtctgaggcgagatgttcgggcgcgggccgccgaagaagagcnacaacacgcgctactacgagatcctgggcgtgcccaaggacgcgtcccaggacgacctcaagaaggcctaccgcaaggccgccatcaagaaccaccccgacaagggcggcgacccagagaagttcaaggagctagctcaggcttatgaggtcctgagtgatcctgagaaacgagagatttatgatcagtatggcgaggatgccctcaaggagggaatgggaggtggaggaatgcatgatccgttcgacatcttccagtcattcttcggtggtggcggcaacccctttggaggtggcgggagcagcaggggcaggcgacagcgcaggggtgaggatgtggttcatcctctgaaggttagccttgaggaattgtacaatggaacatcaaagaagctatcccttgcccgcaatgtgctctgctcgaagtgcaatggcaagggttcaaagtctggggcttccatgaagtgtgccggctgccaaggtgctggttacaaggtccagatcaggcagctgggaccaggaatgattcagcaaatgcagcagccttgcaacgagtgcaggggaagtggngagaccatcagcgataaggatcgctgcgggcagtgtaaaggtgagaaggtggtgcacgagaagaaggtcctggaggtggtggttgagaaggggatgcagcatggacagaagatcaccttccccggcgaggcagatgaagcgcctgatactgtcactggagacataatcttcgtcctccagcagaaggagcatcccaaattcaagcggaagggtgatgacctcttctatgagcacaccctgaccctgactgaggccctgtgtggcttccaatatgttctgactcatttggacggcaggcagctgctcatcaagtccaaccctggcgaagtggtcaagcctgattccttcaaggcgattaacgatgagggcatgcctatgtaccagaggccgttcatgaagggcaagctgtacatccacttcacggtggatttccccgactcgctgagcctggaccagtgcaaggccctcgagantgtcctcccgcccaagccggcgtcgcagtacacggacatggagctggacgagtgcgaggagacgatggcctacgacatagacattgaggaggagatgaggaggcggcagcagcagcaggcgcaggaggcctacgacgaggacgaggacatgcccggtggcggcggccagcgggtgcagtgcgcccagcagtagtcaggcaggatgttgtgattgtcagtcagcagatgaattggtntctgtccttctcaagttttccatgttagggttcttgcccttttggtgctagtatatgatataactactttactgaacaaatgccgggtcgtccaggaaaattatttgtgttcta

SEQ ID NO: 8326 - DNA, 1525 bp, Leymus cinereus x Leymus triticoides
  misc_feature (9)..(10): n is a, c, g, or t
cgaccgcgnnacctcgtttccccaccggatcaaacagctagggtttcgtcttctctgcggagcttggagctcgtgttcatcctctgaggcgagatgttcgggcgcgggccgccgaagaagagcgacagcacgcgctactacgagatcctgggcgtgcccaaggacgcgtcccaggacgacctcaagaaggcctaccgcaaggccgccatcaagaaccaccccgacaagggcggcgaccccgagaagttcaaggagctagctcaggcttatgaggttctgagtgatcctgagaagcgagagatctatgaccagtatggtgaggatgccctcaaggagggaatgggaggtggaggaatgcatgatccattcgacatcttccagtcattctttggtggtggtggtaaccccttcggaggtggtgggagcagcaggggcaggaggcagcgcaggggtgaggatgtggttcatcctctgaaggttagccttgaggaattgtacaatgggacatcaaagaagctctctcttgcccgcaacgtgctctgctcaaagtgcaatggcaagggttcaaagtctggggcttccatgaagtgtgccggttgccaaggtgctggttacaaggttcagatcaggcagctgggaccaggaatgattcagcaaatgcagcagccttgcaacgagtgcaggggaagtggggagaccatcagcgataaggatcgctgcgggcagtgcaaaggtgagaaggtggtgcacgagaagaaagtcctggaggtggtggtcgagaagggaatgcagcatggacagaagatcaccttccccggcgaggcagatgaagcgcctgataccgtcactggagacataatcttcgtcctccaacagaaggagcatcccaagttcaagcggaagggcaatgacctcttctacgagcacaccctgaccctgaccgaggccctgtgtggcttccagtatgttctggctcatttggacggcaggcagctgctcatcaagtccaaccctggcgaggtcgtcaagcctgattcattcaaggcgatcaacgatgagggcatgcccatgtaccagaggccgttcatgaagggcaagctgtacatccacttcacggtggatttccccgactcgctgagcctggaccagtgcaaggcgctcgagactgtcctcccgcccaagccagcgtcgcagtacacggacatggagctggatgagtgcgaggagacgatggcctacgacatagacattgaggaggagatgcggaggcggcagcagcagcaggcgcaggaggcctacgacgaggatgaggacatgcccggcggcggcggcggccagcgggtgcagtgcgcccagcagtaggcaggcaggatgttgtgattgtcagtcagcagatgaattcgtttctgttgttctcaagttttccatgttagggttcttgcccttttggtgctagtatatgatataactactttactgaacaataccgggtcggccaggaaaattatttgcgttcttgttttca

SEQ ID NO: 8327 - DNA, 1873 bp, Fragaria vesca
tctctcctcgcgtttaggtcgtgtttgcctccaaagtctccgtctttctcagctcagcggattctcttaaccgagtctctgcccaaatctgatctgataccaatctgaagaggggagcctgtcaattttcgatttggggtttctatcgaatcggaatcgaagatgttcggaggaggtagggcggccaagaagagcgataactcaaagtactatgaggttctgggagtctccaagactgcttcccctgatgatttgaagaaggcttacaagaaagccgccatcaaaaaccatcctgataagggcggagatcctgaaaaatttaaagagttggctcaggcttatgaggttttgagtgacccggagaagcgtgaaatatatgatcagtacggtgaggatggcctgaaggatggtgggccaccgggccatgacccatttgatatcttctcgtcattctttggtggtggtggcagcccatttggaggcatgccgggtggtggtagtagcagaggaaggcgccagagacgtggagaggatgtggttcactcattgaaggtctctttggaagacctatatcttggaacctcgaagaaactttccctgtcacggaatgtgttgtgctccaagtgcaaaggtaaggggtcaaaatccggtgcctcgaccaagtgtggtggttgccaaggaactggtatgaaggtcactattaggcatcttggaccctctatgattcaacagatgcagcatgcttgcaatgaatgcaagggtactggggagaccatcagtgacaaggaccgctgtggacagtgcaagggagagaaggttgctcaagaaaagaaggtcttggaagttcatgtcgagaagggtatgcagaatggacagaagatcacgtttcctggtgaagctgatgaagctcctgacacaatcactggtgatatagtattcatcattcagcaaaaggaacatcccaaattcaagagaaagggtgatgacctttttgtggaacactctttgttgctgacggatgctctatgtggtttccagtttgtgctgaaccatttggatggcagacagctacttatcaaatccaaccctggtgaagttgtgaagcctgattcgtttaaggctgtcaatgatgagggcatgccaatgtatgggaggcctttcatgaagggcaagctatacatccatttctcagtcgagttccctgaaacgctgagccttgagcaggtcaaggctttagaagctgctcttccaacaagggcatcatctcagcagctgacagatatggagctggatgagtgtgaagagacgactctccatgatgtgaacatggaggaggagatgaggaggaaacagcaccacgcgcattcggaggcctatgatgaggacgaagacatgcctggtggtgcgcagagggtgcaatgcgcgcagcagtgattgtattcataactcatagaggatgtgttgactgtgatgagtggtgttctggatgaaactttaaaattttggcaggactacttggggtgtctaaagattattttgaaagtttctattctattcttgaactatttataaatgaccatagttcctactgttcctatggtgaattcgattgactaagctgtctgatttggttaaggcgctaatctttctgtctgtctaaatgctgataacatcgtagataataaatttttgtggatttagcatgagattctgtctgaaaatcatgttccaggcggctgctattttgtgttcatcttgcacagaaaaaaattgcacacacaatccagacaatgatgcatcatcggtttagcggtttggttatacattgccagcttcatatgtgaccctaacacgggttgaattgttagttcca

SEQ ID NO: 8328 - DNA, 1715 bp, Triphysaria pusilla
tattatttcttagtaagtcttcttaggccggctgtctgccctattaaaaccacagatctcccaagttcataaaccttcttcttattgctgcctccgcctctcctagtcccgctacattatttttttctgtaagtgcctataaatttaccgatctattttcaattacacatcgaatcgatagatcgattttggggtggtcgatttgattgatttcgaagagcaaaaaaagagcagtaaagatgtttggaagggcgcccaaaaaaagtgataacaccaagtactaccagatcttgggagtgtctaagaatgcttcccaggatgacctgaagaaggcttaccgtaaattagccattaaaaatcaccctgataagggtggagatccagaaaagttcaaggagattgctcaagcatatgaggtcttgagtgattcagagaagcgtgagatctatgatcagtatggtgaggatgctctcagggaaggaatgggtggtggaggaggtggcggtcataatccgtttgaattctttgaaaacatgtttggcggtagcccttttggtggaggtggtggacctagccgaggtaggaggcaaagaaggggagaagatgtacaacatcatctcaaggtttcattagaggacctttacaacgggaccttgaagaagttatcactctcacgcaatgtgctctgttccaaatgcaaagggaaagggtcaaagtccggagcttcattgaaatgttccggctgccaaggatctggggtgaaagtgtcaattagacatctgggtccgtcaatgatccagcaaatgcagcatgcttgcaatgagtgcaagggtactggtgaaacgattaacgataaggatcgttgcacccagtgcaagggtgagaaaattgtgcaggaaaagaaggttctggaagttgttgttgagaagggtatgcaacatagtcagaaaatcacgttcccgggcgaggcagatgaagcgccggacactgttacaggagatattgtctttctacttcaacagaaggagcatccgaagtttaaaagaaagggcgacgatctatttgttgaacataccttgactttgaccgaagcactatgtggctttcagtttatcttaactcatttggacaaccgtcaactccttattaaatctgaacctggtgaaattgtcaagcctgatcaattcaaggcaattaacgatgaagggatgccgatgtaccagagaccgttcatgaaagggaaattgtacatacatttcaccgttgattttccagaatccttgagacccgagcaaaacaaggctctagaggtggttctgcccccgagaccctcaaactgtttgacagatatgaagttagaagagtgcgaggagactacattgcatgacatcaacatggaagaggagatgcataggaaacaacaagcagctcatgaggcgtatgacgaagacgatgatgacttgcacgaaggaggtgctcagagggtgcagtgtgcacagcagtgatcatcagctcccgcttgctttacaagttagataagaagaccatataatttatgtcattattctttgctgtacttgtgattggcttacttttggattgttcagttttatgtgatgttctctgctcggtctaagttcgagtgaattctaaaatgggtttacatggtatttgatatacaaggcactaattttaatgtcaaaaaaaaaaaaaaa

SEQ ID NO: 8329 - DNA, 1282 bp, Flaveria ramosissima
aaagtcttccgatagcgatctacttcttcgcagatttgtaattgagtattgaagatcgaagaaggagaacaggatgtttggaagagcaccgaagaagagcgataacacgaagtattatgagatccttggggtcccgcagaacgcttcacaggatgatctgaagaaggcgtataggaaagcggccattaagaaccatcctgacaaaggtggagatcctgagaagtttaaagagctcgcccaagcatatgaggttctcagtgacccagagaagcgtgagatatatgatcaatatggtgaggatgccttgaaggaaggaatgggcggtggaggtggtggtcatgacccctttgacatattccaatccttctttggtggtagtcctttcggtggcggtggtggtagcagcaggggacgaaggcaacgaaggggagaagatgttgttcatcctctcaaagtttctctcgaggatctttataatggaacttccaagaaactctctctttcacgcaatgtaatctgctccaagtgtaagggcaagggttcaaagtcaggtgcttcaatgaaatgtgctggatgtcaaggttctggaatgaaggtttctatcagacatcttggcccatctatgatccagcaaatgcagcatccttgtaacgaatgcaagggtactggggaaaccatcaatgacaaggatagatgcacacagtgcaagggtgaaaaggtcgtgcaggagaagaaggtactggaagtgcatgtggagaagggtatgcagaatggacagaagattacattccctggagaggctgatgaagctcctgacactgttaccggagacattgtgtttgtgttgcaacaaaaggagcaccccaagtttaagcgaaagggtgatgacctatttgttgaacactcattgagcttgaccgaggccctatgtgggttccagtttatcttaacccatttggataacagacaacttctcatcaaatctcaacccggagaggttgtcaagcctgatcaatttaaggcaataaatgatgaaggtatgccaatgtaccaaagaccatttatgagggggaagctgtacctccacttcaccgtagaattcccagattcattgtcatcagatcagtgcaaggcgttggaggcggtgctgccatctaggccttcgatgcagatgacagacatggaactggatgaatgcgaagagacaactcttcatgatgtcaacatcgaagaggagatgaggaggaagcaacaagcagctcaagaagcttatgatgaagat

SEQ ID NO: 8330 - DNA, 1329 bp, Cleome gynandra
aaccgccataaaaaccaatcccgacaagggtggagatcccgagaagttcaaagagttagctcaggcttatgaagttctcagtgatcctgaaaagcgtgagatttatgaccaatatggtgaggatgctctcaaggagggaatgggtggtccaggtggtgggcatgacccatttgatattttctcatccttctttggtggaagtccgtttggagggggtagtagccgaggcaggaggcagaggcgtggtgaagacgttgttcatcctctgaaggtttccttagaagacctttatgttggattatcaaagaaactctcacttacgaggaatgctttgtgctcgaagtgtaacggaaaaggttcaaaatccggagcttcgatgacatgtgctggctgtcagggtactgggatgaaggtcacgatcaggcagttgggacccggaatgattcagcagatgcagcatgcttgtaatgaatgtaagggtactggtgagaccatcaacgacagggatcgatgtccacaatgcaagggagataaggttgtcccggagaagaaggtgcttgaagtacatgtggagaagggaatgcagcacagccagaagatcacattctctggtcaagctgatgaagcgcctgacacagtctctggagatatagtgtttgttcttcagcagaaggagcatccgaggtttaagagaaagggagatgacctctttgtggaacacagcctatctctaaccgaggctctgtgtggcttccagtttgccctaacccacttggatggcagacaacttctcatcaggtccaatcccggagaggttgtgaaaccggattcgtacaaggcgatcaacgacgagggaatgccgatataccagaggccgttcatgaaggggaaactatacatccacttctcagttgacttcccggatactctgtccctggatcaagcaaaggcactagaagctgtgttgccaccaaggccgtctacgagccaacttactgatatggagatagacgagtgtgaagagactacacttcacgacgtcaacatggaggaggagatgaggaggaagcaacaagctcagagagaggcttacgaggatgatgacgatgagccacacggtggacagcgggtccaatgtgcccagcagtgattgtaggctttcggtggttgatggctttctaaacgttgtttctttttataagggtctgagacatggaatctgaaacccttggagacttgagagtcgtggaacttgtttgtttggtttcgttttgtacgcgtcgtctaaatttaagtccgtatgacaaattttgattctgttgaagaaag

SEQ ID NO: 8331 - DNA, 1905 bp, Plantago ovata
ctcctctccgttcccataaaaccaaccaattcctaatctatctctctctctctctgtcttctcctactctccttctctcctataaataaaaattcaatcgattagctccagaggaccagatccaactctcttcgccgtccttggtcttctttctccgatcgattagctcttttagtctctctctctccctgatctactcggaaagatgtttggtagagcgccaaagaaaagcgataacaccaagtactatgagctcctgggagttcccaagactgcttcaccagatgatctcaagaaggcttatcgtaagtccgccattaagaaccatcctgataaaggtggagatcccgaaaagtttaaagagattgcccaagcgtatgaagtcttgagtgacccagagaagcgtgagatatatgatcaatatggtgaggacgctcttaaggaaggaatggctggtggaggtgctggcggtcacaacccctttgacatctttgaatcattctttggcggtggcggtggtaatccttttggaggaggtggaagtagcagaggccgaaggcaaagaaggggtgaggatgttgttcaccccttgaaggtttcgctcgaggatctgtattctggaatttccaagaaactatctctttctcgcaatgtgctctgctctaggtgcaaagggaaagggtcaaaatctggagcttcaactaaatgttctggatgtcatggttctggtatgaaggtctctattagacatcttggaccttctatgatccagcagatgcagcatccttgcaacgaatgcaagggtactggtgaaaccattaccgacaaagaccgttgcactcaatgcaagggtgagaaagttgcgcaggaaaagaaggtattggaagtgaatgtggagaagggtatgcaacatgggcagaaaatcacattccctggtgcagctgacgaagcgcctgacactgtcacaggagatattgtgtttgtactacaacagaaggagcatcctaaattcaagcgaaagggtgatgacttgttcgtgcagcacaccttgacccttactgaagcgttatgtggcttccagtttatcctgacccatttggacaaccgtcagctacttattaaatctgaacctggtgaagttgtcaagcctgatcaatacaaggccattaatgatgaagggatgccaatataccagaggaacttcatgagaggaaaattgtacattcagtttgctgtggagttcccggagagcctaagccctgagctaagcaagtctctggaatctgtcctacctccaaggacctcatcccagatgagtgatatggagttggatgagtgcgaggagactacactccatgatgtgaacatggaggaagagctgcgcaggaagcagcaccagcatgcccaggaggcatatgaggaagatgatgacatgccaggaggggctcagagggtgcagtgtgcccagcaatgatacaacactgtatcggattaggttctgtgaggcagaagaagcttttgatgttgacaatttcagcagctagttagggaagatggtggtttaatactcgttttgatgtctttttttctcgctgttttatagtagaacaattcgttgtccccttaatcgctagtataacgggagacttcatttatatgcaaattgcactgctagcaatatattttatttgatgactgttctcagaataatctatgtgaaagattgctacttttagcttcgccaaattttgatgttgtaatgctagactacatagtgttgtctgttgtgtgaggcgcaatttgatgtactaggatttttagcgttctgggaatgtgattcaaacctgcatttgttgcacattttgttcggatatcaagatttaggtgatctctattggtttctcc

SEQ ID NO: 8332 - DNA, 1512 bp, Triticum aestivum
acaaaccgatcccgaccggcgacctcgcttccaccggatcaaccagctagggtttcgtcttcgtcctctccgcggagcttgggattttcggcgcgatgttcgggcgcgggccgccgaagaagagcgacagcacgcgctattacgagatcctgggcgtgcccaaggacgcctcccaggacgacctcaagaaggcctaccgcaaggccgccatcaagaaccaccccgacaagggcggcgaccccgagaagttcaaggagctagctcaggcttatgaggtcctgagtgatcctgagaagagagaaatttatgaccagtatggtgaggatgccctcaaggagggaatgggaggtggaggaatgcatgatcctttcgacatcttccagtcattctttggtggtggcggcaacccctttggaggtggcgggagcagtaggggcaggaggcagcgcaggggtgaggatgtggttcatcctctcaaggttagccttgaggagttgtacaatggaacatcaaagaagctctctcttgcccgcaacgtgctctgctcgaagtgcaatggcaagggttcaaagtctggggcttccatgaagtgtgccggctgccaaggtgctggttacaaggtgcagataaggcagctgggaccaggaatgattcagcaaatgcagcagccttgcaacgagtgcaggggaagtggggagaccatcagcgataaggatcgctgtgggcagtgcaaaggtgagaaggtggtgcacgagaagaaagtcctggaggtggtggtcgagaagggaatgcagcatggacagaagatcaccttccccggcgaggcggatgaagcgcctgataccgttactggagacataatcttcgtcctccagcagaaggagcaccccaaattcaagcggaagggcgatgacctcttctacgagcacaccctgaccctgaccgaggccctgtgtggcttccagtatgtcctggctcatttggacggcaggcagctgctcatcaagtccaaccctggcgaagtggtcaagcctgattcattcaaggcgatcaacgatgagggcatgcccatgtaccagaggccgttcatgaagggcaagctgtacatccacttcacggtggatttccccgactcgctgagcctggaccagtgcaaggcgctcgagactgtcctcccgcccaagccggcgtcgcagtacacggacatggagctggacgagtgcgaggagacgatggcctatgacatcgacattgaggaggagatgcggaggcggcaacagcagcaggcacaggaggcctacgacgaggatgaggacatgcccggcggcggcggccagcgggtgcagtgcgcacagcagtaggcaggcaggatgttgtgattgtcagtcaagcagaagaattcgtttctgttctcaagttttccatgttagggttcttacccttttggtgctagtatatgatataactactttactgaacaataccgggtcgtccaggaaaattatttgcctt

SEQ ID NO: 8333 - DNA, 1521 bp, Triticum aestivum
acaaaccgatcccgaccggcgacctcgcttccaccggatcaaccagctagggtttcgtcttcgtcgtcttctccgcggagcttggagttttcggcgagatgttcgggcgcgggccgccgaagaagagcgacagcacgcgctactacgagatcctgggcgtgcccaaggacgcgtcccaggacgacctcaagaaggcctaccgcaaggccgccatcaagaaccaccccgacaagggaggcgacccagagaagttcaaggagctagctcaggcttatgaggttctgagtgatcctgagaagcgagagatctatgaccagtatggtgaggatgccctcaaggagggaatgggaggtggaggaatgcatgatccttttgacatcttccagtcattctttggtggtggcggcaaccccttcggaggtggcgggagcagtaggggcaggcggcagcgcaggggtgaggatgtggttcatcctctgaaggttagccttgaggaactgtacaacggaacatcaaagaagctctctcttgcccgcaatgtgctctgctcgaagtgcaatggcaaggggtcaaagtccggggcttcgatgaagtgtgccggctgccaaggtgctggttacaaggtgcagataaggcagctgggaccaggaatgattcagcaaatgcagcagccttgcaatgagtgcaggggaagtggggagaccatcagcgacaaggatcgctgtgggcagtgcaaaggcgagaaggtggtgcacgagaagaaagtcctggaggtggtggtcgagaagggaatgcagcatgggcagaagatcaccttccccggcgaggcggatgaagcgcctgatactgttactggagacataatcttcgtcctccagcagaaggagcaccccaaattcaagcggaagggcgatgacctcttctacgagcacaccctgaccctgaccgaggcactgtgtggcttccagtatgtcctggctcatttggacggcaggcagctgctcatcaagtccaaccctggcgaagtcgtcaagcctgattcgttcaaggcgatcaacgacgagggcatgcccatgtaccagaggccgttcatgaagggcaagctgtacatccacttcacggttgattttcccgactcgctgagcctggaccagtgcaaggcgctcgagactgtcctgccgcccaagccggcgtcgcagtacacggacatggagctggacgagtgcgaggagacgatggcctacgacattgacatcgaggaggagatgcggaggcgacagcagcagcaggcacaggaggcctacgacgaggacgaggacatgcccggtggcggcggccagcgggtgcagtgcgcccagcagtaggcaggcaggatgttgtgatcgtcagtcagcagatgaattcgtttctgttgttctcaagttttccatgttatggttcttacccttttggtgctagtatatgatataactacttcactgaacaataccgggtcgtccaggaaaattatttgccttacct

SEQ ID NO: 8334 - DNA, 1814 bp, Pseudotsuga menziesii
tattgctatttgcaggtttaattgacagggaaaagaggtgaaatgggagcgttgattgaaagaaccggaattccgttgcgaggggaggaaagcacaaaaggagaaggaagcccctgaggctcattcaagaaatttgcgctgctcttgtcaaatttcttcccaacattttcagccggcctctggctacatattgctatttgcaggtttaattgacagccaaaagagtcttgttgtggcctgtatttcttcctgaagttgttggagatctcaagaatttgtagctgaagggtttcaccggattgtttttcgtaagtgaaaatgttcggagctcgtgcccctaagaagagtgacaacaccagatattatgaagttctgggagtgccaaagagtgcttcacaggatgaactgaagaaagcttacagaaaggcagctatcaaaaaccatcccgacaagggtggagatccagaaaagtttaaggaacttgcccaggcatatgaggtacttagtgatcctgagaaaagggaggtttatgaccagtatggagaggacgcacttaaagaagggatgggcggcggtggcggtcatgatccatttgatatttttcagtcattctttggtggaagtccttttggtggcggtggaagcagcaggggaagccgcaggcaaaggagaggcgaggatgttgttcaccccttgaaggtatcattggaagacctttacaatggaacatcaaagaagttgtcactatctcgaaatgtgttgtgctctaaatgcaaggggaaaggatcaaaatctggtgcatcaatgaaatgcagcgggtgtcaagggtctggcatgaaagtctctattagacatctaggaccttcaatgatccagcaaatgcaacatgtctgcagtgattgtagggggacaggtgagacaataaacgaaaaagatagatgcccgcaatgtaagggtgaaaaggtcttgccggagaagaaaatgcttgaggtaacagttgataagggaatgcaaaatggtcagaggatcacttttcaaggggaagcagatgaagcgcccgacacggttaccggtgacattgtttttgtggttcaacaaaaggagcatcccaaattcaagcgaaagggagatgatctttttgttgagcatactttatcattgacggaagcactgtgcgggttccagtttatattgacccatctggatggtcggcaactgcttattaaatctagtcctggtgaagttgttaaaccaggtcagttcaaggctattaacgatgaaggaatgcctgcttaccagcggccattcatgaagggtaatctgtacattcatttctctgtagatttcccagattcttttactcctgaacaatgcaaggcgctggaagccgtattgcctcctcgatctgcaagtcagctaacagacatggagctagatgagtgtgaggaaacaaccctccatgatgtaaactatgaggaagaaatgaggaagaaacaaagtcaacaggaagcttatgaagaagatgaggaaggctctggtgggccaagagtacaatgtgcacaacaatgagagtagctaattaaagaatagatttgtttgtagcatcagactaagaggaattttcatttaactgttgaatgctatagttataatatattggatttcattctgtaatttcctgaaggtaaacaaatacagaatgcatatataacccgataaaatcaattttttgtgcaaaatatgatgttatttgaagtctaccatgttacttatctaaaggacatggtgtatgctaaatgtatattgtggatgga

SEQ ID NO: 8335 - DNA, 1569 bp, Hordeum vulgare
cggcgaccccgtcccccaccggatcaaccagctagggtttcgtccccttcgtcttctccgccgagcttggagggttcgcgctcatcgcctgaggcgagatgttcggccgcgggccgccgaagaagagcgacagcacgcgctactacgagatcctgggcgtgcccaaggacgcgtcccaggacgacctcaagaaggcctaccgcaaggccgccatcaagaaccaccccgacaagggcggcgaccccgagaagttcaaggagctagctcaggcttatgaggtcttgagtgatcctgagaagcgagagatctatgatcagtatggtgaggatgccctcaaggagggaatgggaggtggtggaatgcacgatccatttgacatcttccaatcattctttggtggtggcggcaacccctttggaggtggtggcagcagcaggggcaggcgtcagcgcaggggtgaggatgtggttcatcctctgaaggttagccttgaggagttgtacaatggaacatcgaagaaactctctcttgcccgcaatgtgctctgctcaaagtgcaatggcaagggttcaaagtctggggcttccatgaagtgtgccggctgccaaggtgctggttacaaggtccagatcaggcagctgggaccaggaatgatacagcaaatgcagcagccctgcaatgagtgcaggggaagtggtgagaccatcagtgataaggatcgttgcgggcagtgcaagggtgagaaggtggttcacgagaagaaagtcctggaggtggtggtcgagaagggtatgcagcatggacagaagatcaccttccctggcgaggcagatgaagcgcctgataccgtcactggagacataatcttcgtcctccagcagaaggagcaccccaaattcaagcggaaggctgacgacctcttctatgagcacaccctgaccctgacggaggccctctgtggcttccaatatgtcctagctcatttggatggcagacagctgctcatcaagtccaaccccggggaagttgtcaagcctgattcattcaaggcgatcaacgacgagggcatgcccatgtaccagaggcccttcatgaagggcaagctctacatccacttcacggttgttttccccgactcgctgagcctggaccagtgcaaggccctcgagacggtcctcccgcccaagccggcatcgcagtacacagacatggagctagacgagtgcgaggagacgatggcctacgatatagacattgaggaagagatgcggaggcagcagcagcagcaggcgcaggaggcctatgacgaggacgaggatatgccgggcggcggcgggcagagggtgcagtgcgcccagcagtagtcaggcaggatgttgtgatcgtcagtgagcagatgaattcgtttctgtccttctctcaagttttccatgttagggttcttacccttttggtgctagtatatgatatattaactacttgaacaaatgccgcttcttccgggaaaattatttgcgttctcgttttgcttgttggctgctgatgagcagagctgacattatgtttgac

SEQ ID NO: 8336 - DNA, 1478 bp, Ambrosia trifida
agtttgtaactgaatactgagaatcaaagaagaaggtcaggatgtttggaagagcaccgaaaaagagcgataacacaaagtattatgagatccttggagtccctaaaaacgcatcacaggatgatctaaagaaggcttatagaaaagctgctattaagaatcatcctgacaagggtggagatcctgaaaagttcaaagagcttgcccaagcatatgaggtactgagtgatccagaaaagcgtgagatatatgatgagtatggtgaggatgccttgaaggaaggaatgggaggtggcggaggtggtcatgacccctttgacatcttttcatctttctttggtggtggtggaggtggtagcagccggggacgaagacaacgaaggggagaagatgtcgttcaccctctcaaagtttctcttgaggatctctataatggaacttctaaaaagctctctctttcacgtaatgttatctgctccaagtgtaagggcaagggttcaaagtccggtgcttcaatgaaacgtgctggatgtcaaggttcaggaatgaaagtttccatcagacatcttggcccatctatgatacagcaaatagcagcatccttgtaacgagtagcaagggtactaggagaaaccaatcaacgaataaggaatcgactgcacgtcagtaggcaaagggtggtagaaagttgttcaggagaagaaagtgcttgaagtacatgtggagaagggcatgcgaaatgggcagaagataacattcctggagaggctgatgaagcccctgacaccgttacaggtgatatagtgtttgtgttgcaacaaaaagaagcaccctaagtttaagcgaaagggtgatgacatattttttgtagcacacgttgagcttgacagaggctctgtgcgggttccagtttgtcttgacccatttggataacagacagcttctcatcaaatctcaacctggagaggttgtgaagcctgatcaatttaaggcaataaatgatgaaggaatgccaatgtaccagaggccatttatgagggggaagctgtacatccacttcactgtggacttccctgattcattatccccggaacagtgcaaggcgttagaggccgtgctaccacctaagccgtcgcagcagatgacagacatggagctggacgaatgtgaggagacaacattgcacgatgtcaacatcgaagaagagatgagaaggaagcaacaacaagaagcttatgatgaagatgaagacatgcatggtggagcccagagggtacaatgtgcacagcagtagtggattcatcactttggtctggtttggtactccggtctagtgtctgatatcagcttgtgattgtttcttttttttactttaaaaatatgaaactgcaaaatgtgttgtatgaatgaatttaaaaattaaagtgtcattacttgttttatgttctgctgttaatgagtatactgccattaatata

SEQ ID NO: 8337 - DNA, 1345 bp, Cirsium arvense
cccgaagaagagcgataataccaagtactatgagatcctaggggttccgaataccgcttcgcaagatgatctcaagaaggcttatcggaaagccgccattaagaatcaccctgacaaaggaggagatcctgagaagtttaaagagcttgcccaagcatatgaggttctgagtgatccagaaaagcgtcaaatatatgatgaatatggagaggatgctctaaaggaagggatgggcggtggaggtggtggacatgatccatttgacatcttccagtcattctttggtggtagtccttttggtggtggtggtagcagcagcaggggacgaaggcagagaaggggagaagacgttatccaccctctcaaagtttctctggaggatctttacaatggaacgtccaagaaactctcactttcacgtaatgtaatctgctccaagtgcacgggcaaagggtccaagtcgggtgcttcaatgaaatgttcaggctgtcaaggttcaggcatgaaagtttctatcagacatcttggcccatctatgatccagcaaatgcaacaaccttgtaatgagtgcaagggtaccggagaaacaattgatgataaggatcgctgcccacagtgcaagggtgaaaaggtggtgccggagaagaaagtccttgaagtccatgttgagaagggcatgcagaatggacagaagattacattccctggagaggctgatgaagctcctgacactgttactggtgatattgtgttcgtcttgcaacaaaaagagcatcccaagtttaagcgaaagggtgatgatatattttatgaacacactttgaatctgacagaagcactctgtggcttccagttcatcttgacccatctagataacagacaacttttgatcaagtctttacccggggaggttgttaaacctgatcaattcaaggcaataaatgatgaaggaatgccaatgtattcaaggccattcatgaaggggaagctatacatacactttagtatcgatttccctgattcaataagcccagaacaaagcaaggttctggagtcggttcttccaggtaggccttcggttcagattacagatatggaagtggatgaatgtgaagagacaactctgcatgatgtcaacattgaagaagagatgagaaggaagcagcaacaagcagcttatgatgaagatgatgatgatgacgatatgcatgctggagcccagaaggttcaatgtgcacaacaatgagtcaacaaggtatggtatggttacttttttataggtgtttttggcaaggcacttttgctttgtgacatattattagaaacataaaaaatgtatgcaact

SEQ ID NO: 8338 - DNA, 1481 bp, Allium cepa
  misc_feature (1184)..(1184): n is a, c, g, or t
  misc_feature (1217)..(1217): n is a, c, g, or t
tgacaataaaaaataagaatccaagatgtttggaagagctcctaagaaaagcgacaataccaagtattatgagattcttggagtttccaaaaacgcgtcgccagacgatttgaagaaggcatatcgaaaagctgcgattaagaatcatcctgataaaggtggcgatcctgagaagtttaaggagttggctcaagcatatgaggttctaagtgaccctgaaaagcgtgagatatatgaccagtacggtgaggatgcactcaaggaaggatgggtggaaggtggtggtggccatgacccctttgacatctttcagtcgttctttggtggtgaggttttggaggtggtggtagcagccggggccgtagacaaagaagaggcgaagatgtggtacatcctctcaaagtatctctagaagaactctacaatggaacttctaagaaactctctttgtctagaaatgttatctgctcaaaatgcaatggcaaaggatcaaaatcaggtgcttcaatgaaatgtgcatcttgccaaggttctggtatgaaagtctctattcgtcaattgggtcctggaatgattcagcagatgcaacatccttgcaacgactgtaagggtacaggagaaatgataaacgataaggatagatgcccattgtgcaaaggtgaaaaggttgtgcaagagaagaaggttttggaagtgcatgttgagaaagggatgcagaatgggcagagaattacctttcctggtgaagccgatgaagcgccagatacaattacaggggatattgtgtttgtactacagcagaaggaacatcccaaattccaaaggaagggagatgatttattttacaagcataccctctctcttaccgaggctctctgtggtttccagtttgtgttaactcatctggataacaggcaactccttatcaagtctaatcctggagaggtgatcaagccagatcaattcaaggcgatcaatgatgaaggaatgccaatgtatcaaaggccattcatgagagggaagttgtacattcagttcttagttgatttccctgattcactcactccagaacagtgtaaagtgattgaaagtgtgctcccacctagaagtgcctcttctcagctcacggatatggagattgatgaatgtgaagaaacacaatgcatgatgtgaacatagaagangagatgagaaggaagcacaccagcagcgcagangcttatgatgaggatgatgaaggtcatggtggtgcccaaagggtgcaatgtgctcagcagtgagactattgtcgtcgctgacttattattttgtaacctgttatgtttagttcttactatataattgctgtagcgactataaacattactatgttgctgagacaatacagttcatattgaattgttccagagtttgcgttaccctggttcatcttgtaactcggttatttgtaacgctgctcgtatctaaagtatattgttttc

SEQ ID NO: 8339 - DNA, 1612 bp, Triphysaria pusilla
ctcgcattcctaatccttctctattgctagcgctacctccgcctctcctaaccccactccgattctcctctcaaaaaagagcagtagagatgtttgggagggcgccgaagaaaagtgataacaccaagtactacgagatcttgggagtctcgaagaatgcttccccggatgacttgaagaaggcttatcgtaaattagccattaaaaatcatcctgataaaggtggagatccagaaaagttcaaagagattgctcaagcatatgaggtcttgaatgatcctgagaagcgtgaaatctatgatcagtatggtgaggatgctctcaaggaaggaatgggtggtggaggaggcggtcacagcgagtttgacttgttcgaaaacctttttggcggtcacccttttggtggaggtggtggacctagccgaggtaggaggcaaagaaggggagaagatgttcagcatcctctcaaggtttcattagaggaactttacaatgggacctcaaagaagttatctctctcacgcaataaactctgcaccaagtgcaaaggaaaagggtcaaagtctggagcttcaactaaatgttctggctgccaaggatctgggatgaaagtctcaattaggcatctaggcccgtcaatgatccagcaaatgcagcatccttgcaatgagtgcaagggtaccggtgaaatgattagtgataaggatcgctgcacccagtgcaagggtgagaaggttgtgcaggaaaagaaggttctggaagtagttgttgaaaagggtatgcaacatggtcagaaaatcaagttccctggcgaggctgatgaagcgccggacactgttaccggagatattgtctttgtacttcaacagaaggagcacccgaagtttaaaagaaagggcgatgatctgtttcttgaacataccttgactttgactgaagcactatgtggcttccagtttgtcttaactcatttggacaaccgtcaactccttatcaaatctgaacctggtgaagttatcaagcccgatcaattcaaggcaattaacgatgaagggatgccgatataccagagatctttcatgaaagggaaactgtacgtacagttcaccgttgattttcctgattcgttgagtcccgagcaaagcaaggctctggaggcggtgctgcctacaaagccgacaaccagtctgacggatatggagttagatgagtgcgaggagacaactttgcatgacatcaacatggaagaggagatgcgtaggaaacagcaatcggctcatgaggcgtatgatgaagatgatgacatgcatggaggaggtggtcagagggtgcagtgtgcacagcagtgattatttattgattagtgttatgtgacgagaagacttgaacttgtttggcattataagactttattattattattttttggtgtaacgacatatgttgtgattgctattattatgcacttttggattattcaagttttatgtgttgttttctgctctgctctatgttggggcgcttatgcaaaaatggatttacattactttatctacgaggaaataaatttcttctagtggatgactgaaattagtttgaaagatgatgatag

SEQ ID NO: 8340 - DNA, 1212 bp, Momordica charantia
atcctcggggtgcccaagtccgcctcccaggatgacctcaagaaggcctaccgcaaggccgccatcaagaaccatcccgacaagggcggcgaccccgagaagttcaaggagcttgcacaagcttatgaggttttaagtgacccagagaagcgtgagatttatgatcagtacggtgaagatgccctcaaggaaggaatgggtggaggaggaggccatgtcgatccatttgacatcttctcatcattctttggaccctcttttggaggaggtggtggcagcagcagaggcagacggcaaaggaggggagaagatgtagtgcatccacttaaagtttctctggaagatctttacaatggtacctcaaagaagctctccctctcgcgcaatgttatctgctcgaagtgcaagggcaagggctccaagtctggtgcttcaatgaggtgcccaggttgccagggttcaggtatgaaagtcaccatccgccagctggggccttccatgatacagcagatgcagacggcttgcaatgagtgcaaggggactggagagagcatcaatgagaaggatcgctgcccagggtgcaagggtgagaaggttgttcaggagaagaaggttctggaagtacatgttgagaaggggatgcaacacggccagaagatcaccttccccggtgaagctgatgaagcgcctgatactaccactggagacactgtattcgtcctccagcagaaggatcactccaagttcaagagaaagggtgatgaccttttttatgagcacacattgtctctgactgaggctctctgtgggttccaattcgttcttacacatctggacaacaggcagcttctcatcaagtcaaaccctggtgaagttgttaagcctgaccaattcaaggcgataaacgatgaggggatgccaatgtaccagaggcctttcatgaagggcaagctctacattcacttcactgtggagttccctgactcgctggcgccagagcagtgcaaggctcttgaggcggttcttccaccaaagcctacgtccaagctgacagacatggagatagatgagtgcgaggagaccactatgcacgacgtgaacaacatcgaggaagagatgcgcaggaagcaagctcatgctgcccaggaggcgtacgaggaggacgatgatatgcctggaggtgctcaaagagtgcagtgcgcgcaacagtag

SEQ ID NO: 8341 - DNA, 1342 bp, Arabidopsis lyrata
tttctcccttcgtctccatcaagcaaccctctctctctctcatcatcatcgcagaggagacgatcgtacgcgacgaatcctagagagattgagagggacagcgagttttgagccaaaggttgttggcgatctatattgaagaagtgaacaaggatgcgcaagtggatctgttgtacatgtcagatagaagactcaaatgaagagcaacaactgaaaagttcgcagcagcaatctgatgcaaatcataagaatccaaaaccagcacctgttgcaaaacacgagatgaagaaggaagctcttccgatcgaggtccctcccttgtctttggatgaggtgaaggaaaagactgaaaattttggatccaaggcactgattggtgaagggtcttacggaagagtatattatgcgacactaaatgatggtgtagcggttgctctgaagaaacttgatgtcgcgcctgaagctgaaacagatgccgaattcttgagtcaggtttccatggtctctaggctgaagcatgaaaatctcattcaattgcttggtttttgtgttgatggaaacctacgcgtccttgcatatgagtttgcaacaatggggtcgttgcatgacatcttgcatggtagaaagggagttcaaggggcacagccaggtccaacacttgactggataacgagggtgaagatagcggttgaggcagctaggggtttggaataccttcatgagaagtctcagcctcctgtaatccatagagacataagatctagcaatgtccttctttttgaagactacaaagcaaagattgctgatttcaatctctcgaatcaagcacccgataatgctgcccgtcttcactcaacaagagtcttggggacttttggttatcatgctccagaatatgcaatgactggacagttgactcagaagagtgatgtgtacagctttggggttgtacttctagaacttcttacagggaggaaaccggtggatcataccatgcctcgaggtcaacagagtcttgtaacctgggcgacaccaagactcagtgaagataaagtgaaacagtgcattgatccaaagctaaaagcggattaccctccaaaagcagttgctaagctagcagcagtggcagcattgtgtgtgcaatacgaagctgagtttagaccaaatatgagcatagttgtgaaggcgctacagcctctcctgaaacctccagccgcagctcccgcaccagaatcttgaaactcttttaatcttttttttttttcactgcaactatcagaaagaatctacatagtaccattgccataaatgatgatgaggttggttttgaaagtgataacta

SEQ ID NO: 8342 - DNA, 1822 bp, Arabidopsis thaliana
cgagaagattttttcgtaattcgttgttaatttctctcgttggtcagatatatttcgatatctattattattatttggtgattttttcatatctggaaattgagtaagtaacgatttttttttttaaaaaaaaaaaagagagagagagagattaggaaacaagaaagcagaaagagaggagtgattagagagagagagagatcaataaccaaagaagaaggaagggaaggggattagattacaaaaacgccaaagctgttaactttttctttttggccatttcctatttctcccttcgtctccatcaagcaaccctctctctctctctctctctatcatcatcatcgcagaggagacgatcttacgcgacgaatccttgagagattgagagggacaagcgagttttgtaggtgtctcagaccggacccaaggattgttgacggtctatattgaacaagtaaacaaggatgcgtaagtggatctgttgtacatgtcaaatagaagactcaaatgaagagcaacaactgaaaagttcacagcagcaatctgatgcaaatcataagaattcaaaaccagcacctgttgcaaaacatgaggttaagaaggaagctcttcccatcgaggtccctcccttgtctttggatgaggtcaaggaaaagactgaaaattttggatccaaggcactgattggtgaagggtcttatgggagagtatattatgcgacactaaatgatggtgtggcggttgctctgaagaaacttgatgtcgcacctgaagctgaaacagataccgaattcttgagtcaggtttccatggtctctaggctgaagcatgaaaatctcattcaattgcttggtttttgtgttgatggaaacctccgcgtccttgcatatgagtttgcaacaatgggatcgttgcatgacatcttgcatggtaggaagggagttcaaggagcacaaccaggtccaacacttgactggataacgagggtgaagatagcggttgaggcagctaggggtttggaatacctccatgagaagtctcagcctcctgtaatccatagggacataagatctagcaatgtccttctttttgaagactacaaagcaaagattgctgatttcaatctctcgaatcaagcacctgataatgctgcccgtcttcactcaacaagagtcttggggacttttggttatcatgctccagaatatgcaatgactggacagttaactcagaagagtgatgtgtacagctttggtgttgtacttctagaacttcttacagggaggaaaccggtggatcataccatgcctagaggtcaacagagtcttgtaacctgggcgacaccaagactcagtgaagataaagtgaaacagtgcattgatccaaagctaaaagccgattaccctccaaaagcagttgctaagctagcagcggtggcagcattgtgtgtgcaatacgaagctgagtttagaccaaatatgagcatagttgtgaaggcgctacagcctctcctgaaacctccagcagcagctccagcaccagaatcttgaaacttttaaatcttttttttcgctgcaactatcagaaagaatctacatagtaccatttgccataaatgataatgaggttggttttgagagtgataactactattattaaaagatgatattatgtttcatttgatgatttgattttgcacacaaattttgttgtgctagaaagagagagagataattgatggcaaagtttattgttgccgtttgctgagtgggagagaaaggaactctgattttatttatatgatccctcttattcctat

SEQ ID NO: 8343 - DNA, 1458 bp, Eutrema halophilum
tttctttcgccttcgtctcgatcaagcaagcccctctctttctctctctctccaacgtagaggagacgatcgtgcgaaccctggagagattgagagggacagcgaattttttaggagccaaaggttgtggacgatcatttggtgaagaagtgagcaaggatgcgcaagtggatctgttgtacatgtcaaatagaagactcaaacgaagaggaacacctgaaaagctcgcagcagcaatctgatgcaaatcacaagaatccaaaaccagcacccgctgcaaagcatgaggtgcagaaggaagctcttcccatcgaggttccgcccttgtctttggatgaggtgaaggaaaagactgaaaatttcgggtcaaaggcgctgattggtgaaggatcttacggaagagtatattatgcgacattaaatgatggtatagcggttgctctgaagaaacttgatgttgcacctgaagctgagtcagatgccgagttcttgagtcaggtttccatggtttctagactgaagcatgagaatctcattcaattgcttggattttgtgttgatggaaacgtccgtgtccttgcatatgagtttgcaacaatgggatcgttgcatgacatcttgcatggtaggaagggagttcaaggggcacagccaggtccaacacttgactggataacgagggtgaaaatagcggtcgaggcagctaggggtttggaataccttcatgagaagtctcagcctcctgtaatccatagagacataagatctagcaatgttcttctttttgaagactacaaagcaaagattgctgatttcaatctctcgaatcaagcacctgataatgctgcccgtcttcactcaacaagagtcttgggaacttttggttatcatgctccagaatatgcgatgactgggcagttgactcagaagagtgatgtgtacagctttggggttgtacttctggagcttttgacagggaggaaaccggtggatcataccatgcctcggggtcagcaaagtcttgtaacctgggcgacaccaagactcagtgaagataaagtcaaacagtgcattgatccaaagctaaaagctgattaccctccaaaagcagttgctaagctagcagctgtggcagcattgtgtgtgcaatacgaagctgagtttagaccaaatatgagcatagttgtgaaggcgctacagccactcctcaaatctccacctccacctccagctccatctccagcaccagaatcttgaaactttactttcatttgcatctatcagaatctataatcagtgccattaccaatattaatatatatgcatgaggtttggttttgggagtgataactataaagatgacattatgtttcatttgtatgattgattttgcacacaattttgttgtgctagaagagagattatggcaagttgccattcggtgagtgggagagagag

SEQ ID NO: 8344 - DNA, 1496 bp, Eutrema parvulum
tttctccttcgtctctatcaagcaagcccctctctttctctcaccaacgcagaggagacgatcgtacgcgacgaaccctagagagattgagagggatagcgatttttgagccaaaggttgtggacgatctattgttgaagaagcgaacaaggatgcgcaagtggatctgttgtacatgtcagatagaagactcaaatgaagaggaacaactgaaaagttcgcagcagcagtctgatgcaaatcacaagaatccaaaaccagcagctgttgcaaagcatgaggtgcagaaggaagctcttcccatcgaagttcctcccttgtctttggatgaggtgaaggaaaagactgaaaattttggatcaaaggccctgattggtgaaggatcttatgggagagtatattatgcgacactaaatgatggtatagcggttgctcttaagaaacttgatgttgcacctgaagccgaatcagatgccgagttcttgagtcaggtctccatggtttctagactgaagcatgagaatctcattcaattgcttggttattgtgtcgatggaaacctccgtgtccttgcatatgagtttgcaacaatgggatcattgcatgacatcttgcatggtaggaagggagttcaaggggcacagccaggtccaacacttgactggataacaagggtgaaaatagcggttgaggcagctaggggtttggaataccttcatgagaagtcgcagcctcctgtaattcatagagacataagatccagcaatgttcttctttttgaagactacaaagcaaagattgctgatttcaatctctcaaaccaagcgcctgataatgctgctcgtcttcactctacaagagtcttgggaacttttggttaccatgctccagaatacgcaatgactggccaattgactcagaagagtgatgtgtacagctttggggttgtacttctagaacttctgacaggaaggaaaccggtggatcataccatgcctcggggtcaacagagtcttgtaacttgggcgacaccaagactcagtgaagataaagtcaaacagtgcattgatccaaagctaaaaactgattaccctccaaaagcagttgctaagctagcggccgtggcagcgttgtgtgtgcaatacgaagctgagtttagaccaaatatgagcatagttgtgaaggcgctacagccgctcctcaaatctccacctccagctccatctccatctccatctccagcaccagaatcctgaagcttttgtttcatttgcaaactatcagaatctgtaatcagtgccattaccaatatatgaatgaggttggtttgggagtgataactagaaagatgatattatgtttcatttgatgattgattttgcacacaattttgttgtgctagaagagagattatggcaggtttataagagttgccatttttgtgagtgggagagataaaagacttttgactattattattaatatatattattatt

SEQ ID NO: 8345 - DNA, 1616 bp, Brassica napus
gtttaaagatttaaaatagctgaacaaattagtcatacgaaaacaaaagacagaagcagtaacgaagattcgcacaagtttccatcacaacacactaaacaagtttatgtttatcgctacgcggagaaaataacgtcaggcagcccgatctaggattaataaatcaacgcgactttgaaacgctctgaaccgcttatactcacgatcatcgataaccgggtattcttctttctcccctctctttcttctctcatcaacgcagaggcgacgatcgcacgcgacgagctctccacagagagattggagaggaacatcgaaagggacgcagggagagatattagacgggagccgaaaaggttggtggaacatctcttagtgaacaaggatgcgcaagtggatctgttgtacttgtcagattcaagactccaatgaagaggaacacttgaaatcttctcagcagccatccgatgcgaatcacaaggttccaaaaccagcagctgttgcaaagcacgaggtgcagaaggaggaacatcttcccgtagaggttcctcccttgtctttagatgaagtcaaggaaaagactgaaaatttcggatcaaaggctctaattggagagggatcttacggaagagtatactatgcaacgctgaacgatggtgtagctgttgctctgaagaaacttgatgtctcacctgaagctgagtcagacgccgagttcttgagtcaggtttcaatggtttctagactcaagcatgagaatctcgttcaactgcttggtttctgcgttgatggaagcctccgcgtccttgcgtacgagtttgcaacaatgggatctttgcatgacatcttacatggtaggaagggagttcaaggagcacagccaggtccaacactagactggacaacgagggtgaaaatcgcggtcgaggcagctaggggtttggagtaccttcacgagaagtcacagcctgctgtaatccatagagatataagatccagcaacgttcttcttttcgaagactacaaggccaagattgctgatttcaatctctcgaaccaagcacctgataacgctgctcgtcttcactcgacaagagtcttgggaacttttggttatcatgctccagaatatgcaatgactggacagttgactcagaagagtgatgtgtacagctttggggttgtgcttctagagcttctgacagggaggaaaccggtggatcacaccatgcctcgtggtcagcaaagtcttgtgacttgggcgacaccaagactcagtgaagataaagttaaacaatgcattgatccaaagcttaaagcggattaccctccaaaagcagttgctaagctagcagcagtggcagcattgtgtgtgcaatatgaatctgagtttagaccaaatatgagcatagttgtgaaggctctgcagccgctcctcaaacttgcagctccagctccctctccagcgccagagtcttgaaacttttttttcatttgcaaactatcagataactatgaaaagatgatataatgtttcatttgatggatgattgattttgcacacagttttgttgtgctagaagaagagagactgtgcgagtgggagagataacaag

SEQ ID NO: 8346 - DNA, 1430 bp, Brassica rapa
actcgtctccatcaagcaaactcccctctctttctctctcatcaacgcagaggcgacgatcgcacgcgacgagctctccacagagagattggagaggaacatcgaaagggtcgcagggagagatattagacgggagccgaaaaggttggtggaacatctcttagtgaacaaggatgcgcaagtggatctgttgtacttgtcagatacaagactccactgaagaggaacacttgaaatcttctcaccagcaatccgatgcaacgaatcacaagaatccaaaaccagcagctgttgcaaagtctgatgcgcagaaggaacctcttcccgtagaggttcctcccttgtctttagatgaagtcaaggaaaagactgaaaatttcggatcaaaggccctgattggagaaggatcttacggaagagtgtattacgcgacgctgaacgatggtgtagctgttgctctgaagaaacttgatgtctcacctgaagctgaatcagatgctgagttcttgagtcaggtttcaatggtttctagactcaagcatgagaatctcgttcaactgcttggtttctgcgttgatggaagcctccgcgtccttgcgtacgagtttgcaacaatgggatctttgcatgacatcttacatggtaggaagggagttcaaggagcgcagccaggtccaacactagactggacaacgagggtgaaaatcgcggtggaggcagctaggggtttggagtaccttcacgagaagtcgcagcctcctgtaatccatagagatataagatccagcaacgttcttcttttcgaagactacaaggccaagattgctgatttcaatctctcgaaccaagcgcctgataacgctgctcgtcttcactcgacaagagtcttgggaacttttggttatcatgctccagaatatgcaatgactggacagttgactcagaagagtgatgtgtacagctttggggttgtgcttcttgagcttctgacagggaggaaaccggttgatcacaccatgcctcgtggtcagcaaagtcttgtgacttgggcgacaccaagactcagtgaagataaagttaaacaatgcattgatccaaagcttaaagcggattaccctccaaaagcagttgctaagctagcagcagtggcagcattgtgtgtgcaatatgaatctgagtttagaccaaatatgagcatagttgtgaaggcgctgcagccgctcctcaaagttgcagttccagctcctccctctccagcgccagagtcttgaaacttttcttttcatttgcaaactatactatgaaaagatgatataatgtttcatttgatggatgattgattttgcacacagttttgatgtgctagaagaagagagactgtgccattttcgtgtatgtgggagagagaacaaagactttgacttaccccc

SEQ ID NO: 8347 - DNA, 2386 bp, Brassica napus
attcggcacgaggtctccttcaagcaatcccctctctctctctcatcaacccagaggcgacgatcgtacgcgacgagctctcaagagagattgagagggagggacgcagagagagagattagactggaacatctcttattgaacaagtatgcgcaagtggatctgttgtacatgccagatacaagactccagtgaagaggaacacttgaaaagttctcagcagcaatcagatgcgaatcacaaggttccaaaaccagcagctgttgctaagcacgaggcggaggtgcagaaggaacctcttcctgtagaggttcctcccttgtcttcagatgaagtcaaggaaaagactgaaaatttcggatcaaaggccctaattggtgaaggatcttacggaagagtgtattacgcgacactaaacgatggcgtagcggttgctctgaagaaacttgatgtctcacctgaagctgagtcagatgctgtgttcttgagtcaggtttcaatggtttctagactcaaccatgagaatctcgttcaactgcttggcttctgcgttgatggaagcctccgcgtccttgcgtacgagtttgcaacaatgggatcgttgcatgacatcttacacggtaggaagggagttcaaggagcacagccaggtccaacactagactggacaacgagggtgaaaatcgcggtcgaggcagctaggggtttggagtaccttcacgagaagtcgcagcctcctgtaatccatagagatataagatccagcaacgttcttctttttgaagactacaaggccaagattgctgatttcaacctctcgaaccaagctcctgataacgctgctcgtcttcactcgacaagagtcttgggaactttcggctaccatgctccagaatatgcaatgactggacagttgactcagaagagtgatgtgtacagctttggggttgtgcttctagagcttctgactgggaggaaaccggttgatcacaccatgcctcgtggtcagcaaagtcttgtaacttgggcgacaccaagactcagtgaagataaagtcaaacagtgcattgatccaaagcttaaagcggattaccctccaaaagcagttgctaagctagcagcagtggcagcattgtgtgtgcaatatgaatctgagtttagaccaaatatgagcatagttgtgaaggcgctgcagccactcctcaaacttgcagctccagctcctccctctccagcgccagagtcatgaaacttttctttttatttgcaaactatcagataactatgaaaagatgatattaatgtttcatttgatggatgattgattttgcacacagttttgttgtgctagaagaagagagattatgtgagtgggagagataacaaagacttttgactattaataataacaatatcattattgcaaatgagtctgttgttatcacaggtacacaagtgaagcttcctaggtagcatcatctagatagttctcaaaagcttagtttcattttccctttttttacaaagagacaaatgaagaaagaaaagcggaggattgttctgttgtgttttcttaagcaacactgaaagaagtggctgctttctcaacaaacttattggctcccttgaaccacctcttgtctccagcttgtgctttgcagatatatagcttccctccattcacagtagctgtgatcagctgatgcttaccgccttcgtctccatcggctgttcttgtcaacaccgacaagtaatagtatggtttcccaccaacgtcctgaatgtttgtgtccaaaatgtttgctgtcgccactgcattgttgtcaaagcctccctcagaggcagtctcgccaaagtaagcttgtttacctaggagatagttgacctgagagaggaactcttcaggggaaccatagtcagtgatggacttcttgtcagtaggagtgaccatgacattgagattgctagtggcgtcaaagttgtcttcgtacctaaggacttgtcctggatactctacctctctgcttgggttccatttagctggcacctgcacgatgaatccatctccactgtatgcagtgaagtctgtgttcttctttggcttcccaaacacatttgcagcttcaccgtaggcggcatcagcgggagacactttggaaccaacggcggcgccgccgaccaagagtgtgagagcgagacggcgagagacggcggagttatcgtcttcatggtgctgttgtgctttacacactatctggacgggtttggagagggacaagtggcgctgggatgagttggaagatgatgatcgtgcggcggaggaggctagtgcgctctggtgtaggaaacacgcgctgtacgccattttctctctctctccttttct

SEQ ID NO: 8348 - DNA, 1059 bp, Brassica napus
gatctgttgtacttgtcagatacaagactccaacgaagaggaacacttgaaatcttctcaccagcaatccgatgcgaatcacaagaatccaaaaccagcagctgttgcaaagtctgatgcgcagaaggaacctcttcccgtagaggttcctcccttgtctttagatgaagtcaaggaaaagactgaaaatttcggatcaaaggccctcattggagaaggatcttacggaagagtgtattacgcgacgctgaacgatggtgtagctgttgctctgaagaaacttgatgtctcacctgaagctgagtcagatgctgagttcttgagtcaggtttcaatggtttctagactcaagcatgagaatctcgttcagttacttggtttttgcgttgatggaagcctccgcgtccttgcgtacgagtttgcaacaatgggatcgttgcatgacatcttacatggtaggaagggagttcaaggagcacagccaggtccaacactagactggacaacgagggtgagaatcgcggtagaggcagctaggggtttggagtaccttcacgagaaatctcagccccctgtaatccatagagatataagatccagcaacgttcttcttttcgaagactacaaggccaagattgctgatttcaatctctcgaaccaagcacctgataacgctgctcgtcttcactcgacaagagtcttgggaacttttggttatcatgctccagaatatgcaatgactggacagttgactcagaagagtgatgtgtacagctttggggttgttcttctagagcttctgacagggaggaaaccggttgatcacaccatgcctcgtggtcagcaaagtcttgtgacttgggcgacaccaagactcagtgaagataaagttaaacaatgcattgatccaaagcttaaagcggattaccctccaaaagcagttgctaagctagcagctgtggcagcattgtgtgtgcaatatgaatctgagtttagaccaaatatgagcatagttgtgaaggctctgcagccgctcctcaaacttgcagctccagctcc

SEQ ID NO: 8349 - DNA, 1856 bp, Malus domestica
gggacaaatttaccaaaaaaaaaaaaaaaaaaaaaaaaggaaaataggaggggaggatatatctctgatctatctgtccatctgagcagtttgttgatttgcctcgccagtttgccactccgcgttgcctctctgtctttcctctctctctttttcctatttatctgtctctttctctctctaaaacaaacccaacctctcaagtctctctctctcccctcccaaaaagcaacagccgaagccccctttcaaatcctacctgtcgctttaccttcacaaaccctaaaaagagacagaagagagagagagaagcgcagaagaaagagagagagaggcgcagagggagagagagagaccgaagcaagaggcgcatgctcctcccccaggttggtttgtacgattagagaatacaagtgctgaagacgatttgtatttgaggaagaaagtcaggatgcgcaggtggctctgttgtgcttgtcacgtcgaagagtcttatccatcaaacgaaaatgaacgcctgaagagcccaaatcactatggagatgggaaccaaaagggatctaaggtgtcagctcctgtaaaatctgaagtacagaaggctgctccacctattgaagtgcctcaattatctgtggaggagctgaaagagaagactgacaattttggatccaaatcattgattggtgaaggttcatatgggagagtatattatgcaagcttgaacgatggtaaagctgtggcagtgaagaagcttgacgttgcatctgaacctgagacaaatgttgagtttttgacccaggtttccatggtatcaagactgaagcacgaaaatcttgttgagttgcttggttactgtgttgatggaaatctgcgcgttctggcttatgagtttgcaaccatgggatctctacatgacatattacatggtagaaagggagttcagggggctcaacctggtcctacactagactggatgcagcgggtaagaattgcagttgaggcagctagggggttggaatacttacacgagaaggttcaaccagctatcatacacagagatataagatctagcaacgtgcttctctttgaagatttcaaagccaagatagcagattttaatctgtcgaatcaggctcctgatatggctgctcgtcttcattctactcgagttttgggaacatttggttatcatgccccagagtatgcaatgacaggccaattgacacagaagagtgatgtgtacagctttggagtggttctactagaacttctgaccgggaggaaacctgttgatcatacaatgcctcgtggacagcagagtcttgttacttgggctactccaagattgagcgaagacaaagttaaacaatgtgttgatccaaagctaaaggattatcctgctaagggggtcgcgaagctggcagccgttgcagcactgtgtgtgcaatatgaatctgaattccggccaaatatgagcattgttgtgaaggctcttcaaccgcttctgaagccaccagcagcagctccggagtcttgaaggcaagggcctcagtctttccttgtgctggaatttctgcgtccttgaaacactctgctttcaactgcctcccgctgatttcatcgtaaacattatatatagtttcatttttttacatttcatatatgagattggatgtgtaggattggtttggccagtttcatgtcattgctgagtgctgtatgtctaattttttcgccatgaattgacttgggggttggattgtgaggtggatatatttttcactgaatattgtttgctttctttgacttctgtaatcttaatgagctatcacagcgtatgttttgcaacggaaaat

SEQ ID NO: 8350 - DNA, 1279 bp, Brassica napus
ctcgttcgtcgtctccatcaagcaagcctctctctctctctctctctctctttcacgatcgttacgcaacgaatcctagagagattgagagggacacagcgagttttgttggtgaggcacggaggttagacaggaggaaacgatgaggatgtgcaagtggatgtgctgtacttgtcaaattcaagactctcatgaagaggaacatttgaaatcctctcaccagcatcatcattctgatgcaaatcacaagaatccaaagccaccagctgttgcaaagcctgaggtgcgcaaggaacctcttcccatcgaggtccctgccttgtctttggacgaggtcaaggaaaagactgataatttcggatcaaagtccctcattggtgaaggctcttacggaagagtgtactacggcacattgaatgatggtgttgctgttgctctcaagaaacttgatgccgcacctgaagctgaatcagattccgagttcttgagtcaggtctccatggtgtctagactgaagcatgagaatctcgttcaattgcttggtttttgtgttgatggaaagctccgcgtccttgcttatgagtttgcaactatgggatcgttgcatgacgtcttgcatggtaggaagggagttcaaggggcacagccaggtccaacacttgactggacaacgcgggtgaaaatagcagttgaggcagctaggggtttggaataccttcatgagaagtctcagcctcctgtgatccacagagacattagatcaagcaatgttcttcttttcgaagactacaaaccaaagattgctgatttcaatctctctaaccaatcgcctgataacgctgctcgtcttcactctaccagagtcttgggaacttttggttatcatgctccagaatacgcaatgactgggcaattaactcagaagagcgatgtgtacagctttggggttgtacttctagaacttctgacagggaggaaaccagttgataataacatgcctcgtggtcaacagagtcttgtcacctgggcgacaccaagactcagtgaagataaagtcaaagagtgcattgatcccaagctacaagcggattaccctccaaaagcagttgctaagctagcagcggtggcggcattgtgtgtgcaatacgaagctgaatttagaccaaatatgagcatagttgtgaaggcgctacagcctcttctcaaacctcctccacctgcagcagctccatcttcttgaatcttttctttcattttgcaaactatcagaatctgtaat

SEQ ID NO: 8351 - DNA, 1545 bp, Brassica napus
tcgttcgtcgtctccatcaagcaagcctctctctctctctctctctctctttcacgatcgttacgcaacgaatcctagagagattgagagggacacagcgagttttgttggtgaggcacggaggttagacaggaggaaacgatgaggatgtgcaagtggatgtgctgtacttgtcaaattcaagactctcatgaagaggaacatttgaaatcctctcaccagcatcatcattctgatgcaaatcacaagaatccaaagccaccagctgttgcaaagcctgaggtgcgcaaggaacctcttcccatcgaggtccctgccttgtctttggacgaggtcaaggaaaagactgataatttcggatcaaagtccctcattggtgaaggctcttacggaagagtgtactacggcacattgaatgatggtgttgctgttgctctcaagaaacttgatgccgcacctgaagctgaatcagattccgagttcttgagtcaggtctccatggtgtctagactgaagcatgagaatctcgttcaattgcttggtttttgtgttgatggaaagctccgcgtccttgcttatgagtttgcaactatgggatcgttgcatgacgtcttgcatggtaggaagggagttcaaggggcacagccaggtccaacacttgactggacaacgcgggtgaaaatagcagttgaggcagctaggggtttggaataccttcatgagaagtctcagcctcctgtgatccacagagacattagatcaagcaatgttcttcttttcgaagactacaaaccaaagattgctgatttcaatctctctaaccaatcgcctgataacgctgctcgtcttcactctaccagagtcttgggaacttttggttatcatgctccagaatacgcaatgactgggcaattaactcagaagagcgatgtgtacagctttggggttgtacttctagaacttctgacagggaggaaaccagttgataataacatgcctcgtggtcaacagagtcttgtcacctgggcgacaccaagactcagtgaagataaagtcaaagagtgcattgatcccaagctacaagcggattaccctccaaaagcagttgctaagctagcagcggtggcggcattgtgtgtgcaatacgaagctgaatttagaccaaatatgagcatagttgtgaaggcgctacagcctcttctcaaacctcctccacctgcagcagctccatcttcttgaatcttttcttttcattttgcaaactatcagcatctgtaatcactactgcccttgccaatatatgaatggagtggtaactataaagatgatattattatgtttcatttgatgattgattatacaaatgaatctaccgaattcaattccttttatagagtctgttgatagcaaagataagcatcatcatcttgatagtttctcaaaagcttagtttcattatccttttttacaagagacaaatgaagaaagaaagcaatgcattgttctgttctgttggtgttgctttacatttaagcaacactgaaa

SEQ ID NO: 8352 - DNA, 1529 bp, Malus domestica
cctcttctctctctctctctctctctctccctctctctctcttatttctgcccctctctttctcaacaacgactcaaaaaacaaacccaacctctcaagtatcccaccctcccgaaagcaacagcctaagcccctttcaaatcctacctgttccctttaccctcacaaaccctaaaagaggtaggagagagagatatatagagagagagaaagcgaagcaagaggcacatgctcctccccctggttactttgtacaattggaggatacaagtgctgaggacgatttatatttgaggaagaaagtcaggatgcgcaggtggctctgttgtacttgtcacgtcgaagagtcttatccatcaaacgaaaatgaacacctgaagagcccaaagcactatgcagatgggaaccaaaagggatctaaggtgtcagctcctgtaaaatctgaagtacagaaggctgctccacctattgaagtgcctcaattatctgtggaggagctgaaagagaagactgacaattttggatccaaatcattgatcggtgaaggttcgtatgggagagtgtattatgcaagcttgaatgatggtaaagctgtggccgtgaagaagcttgatgttgcctctgaacctgagacaaatgttgagtttttgacccaggtttccatggtttcaagactgaagcacgaaaatcttgttgagttgcttggttactgcgttgatggaagtctgcgtgttttggcttatgagtttgcaaccatgggatctctacatgacatattacatggtagaaagggagttcaaggggctcaacctggccctacactaggctggatgcagcgggtaagaattgcagttgatgcagctagggggttggaatacttacacgagaaggttcaacctgctatcatacacagagatataagatctagcaatgtgcttctctttgaagattttaaagccaagatagcagattttaatctgtcaaatcaggctcctgatatggctgctcgtcttcattctactcgagttttgggaacatttggttatcatgccccagagtatgcaatgactggtcaattgacacagaagagtgatgtgtacagctttggagtggttctactagaactactgactgggaggaaacctgttgatcatacaatgcctcgtggacagcagagtcttgttacttgggctactccaagattgagcgaagacaaagttaaacaatgtgttgatccaaagctaaaggattatcctgctaagggggtcgcgaagctggcagccgttgcagcactgtgtgtgcaatatgaatctgaattccggccaaatatgagcattgttgtgaaggctcttcaaccgcttctgaagccaccagcagcagctccggagtcttgaaggcaagggcctcagtctttccttgtgctggaatttctgcatccttgaaacacacttttcaactgcctcccgctgatttcatcgtacacattatatatagtttcatttttttacattacatatatgagattggat

SEQ ID NO: 8353 - DNA, 2122 bp, Medicago truncatula
acaacgcacaacacacctggctttcacacactttctctctatttagctttattattatatcattcattctttctttttatctttctctcaacgaaacgaaaccctagtgcgcgtacaaggcgcatacgactcctcctgattactttgttctggggaactcaacttacaaggacaatttatatccaaggaagagtacaaggatgcgtcgttggctatgctgcacttgtcaggtggaagagtcttatccatcaaatgaaaatgaacacctgaaaagcccaagaagttatggagatggcaacccaaaaggctcaagggctccggctcccgtcaaacctgaaacacaaaaggcaccaccacctatcgaagttccagcattatccttagatgagctgaaggaaaaaactgacaactttggatcaaaggcattgattggtgaagggtcgtatgggagggtgtattatgcaacattaaacgatggaaaggctgtggctgtgaaaaagcttgacgtttctactgaacccgaatcgaataatgagtttctaacccaggtttccatggtctcaagattgaagaatgaaaattttgttgagttgcatggatactgtgttgaaggaaatctccgtgtacttgcatatgagtttgctactatgggctctcttcatgacattttgcacggtagaaagggagttcaaggggcacaaccagggccaactcttaactggatgcagcgagttagaattgcagttgatgcagcaaggggattagaatatttacatgagaaagttcaaccatcaatcatacacagggatatcaggtcaagcaatgtgcttatctttgaagattacaaagctaaggtagctgattttaacctctctaatcaggcccctgacatggctgcacgccttcattctacccgtgtattgggaacctttgggtatcatgctccagaatatgccatgactgggcagttgactcaaaaaagtgatgtttacagttttggtgttgttcttcttgagctccttacaggtaggaaacctgttgatcataccatgcctcgaggacagcaaagtcttgtcacatgggctactccaagactaagtgaagataaagtgaaacaatgcgtggacccaaaactgaaaggagaatatcccccaaaaggagttgctaagcttgcagctgtagcagcactttgtgtgcagtatgaagctgagtttaggcccaatatgagcattgttgttaaagcactccagccacttctgaaggctcccgctcctgcaccagaaacttgaagcagatgaattgaagttaaaatacttctattttgtttctgcatcttctgcacagtttgagtcagatattatcaaatactgcaaataataatatatataacatatatttttacttttgtttgagattggatgtgtaggattggattgggtggtttcatgtcatttttaatttccatgtatttctggtattgcactttagtgcagaggattatagagccatactgcaacattgggtctgggttgcgtggtttgtttgataaatgttgtttgtcactcaacgctaatccccccatattctttatttgtttcttgactgagctgatgatacttggattgaaatacttatatttgttggacctttttgtttgtctgttcttttctatcatatcttactgggttgtgtggtatgttgttgtaattttcgtaccgtgtcgtgtcaatttacttggattggagggacgcgttcaatagcttttgaaaagagaggtggctgatgatgttcccgactctatggtgttagaagagtcaaagtattttagggttcacttgcgcggcatggttttgatgttattttatagtcatcagattggtggcatgcttatgcctcttactcgagtctaaagtttaaacattttttatggtggcggctcgacttatgctgtgttcagcaggtttttcacttttattatatttaatcatctcattaatttagaaaatttattatgatcaaagattttgggtttctttgttctcgtccagactcacaatttgtaatggaagtgagtcttaacgagttaggttatatttgagtcaatatatactttattcttggt

SEQ ID NO: 8354 - DNA, 1855 bp, Glycine max
gggtattaggcgcgttgcttgtgtggatgtcccatctcaatacctggctttggcttctctttattattccttccttccttcttcgcatcaacaaaccctaacatagcatcctaagatacagagactatcaccatcgtcctgctcatttggcacatgcttctccccctgaatactttgtccgcctggagaacacaacttacaaagacgatctatatttaaggaagaggacaaggatgcgtcggtggctttgttgtacttgtcaggtggaagagtcttacccatcaaatgaaaatgaacacctgaaaagcccaaggaattatggagatggcaaccaaaaaggctcaaaggtgtcagctcctgtcaaacctgaaacacaaaaggcacctccacctattgaagctccagccttgtctttagatgagctgaaggagaagactgacaactttggttcaaaggcattaataggtgaaggatcgtatggaagggtgtattatgcaaccttaaacaatgggaaagcagtggctgtgaaaaagcttgatgtttcatctgaacccgaatcaaataatgagtttttgacccaggtttccatggtctcaagattgaaggatgacaattttgttgagttgcatggttactgtgttgaaggaaatcttcgtgtacttgcatatgagtttgctactatgggctctcttcatgacatattgcacggtagaaagggagttcaaggtgctcaacctgggccaactcttgattggatacagcgagttagaattgcagttgatgcagcaaggggattggaatatttacatgagaaagttcaaccgccgattatacacagagatatccgatcaagtaatgtgctaatatttgaagattacaaggccaagatagctgactttaacctttctaatcaggcccctgacatggctgcacgtcttcattcaactcgtgtattgggaacttttggttatcatgctccagaatatgcaatgactgggcagttgactcaaaaaagtgatgtctatagttttggtgttgttcttcttgagcttcttacaggaagaaaacctgttgaccataccatgcctagaggacagcagagtcttgtcacatgggctactccaagattaagtgaagataaagtgaaacagtgcgttgacccaaaactgaagggagaatacccccccaaaggagttgctaagcttggagctgttgcggcactgtgcgtgcagtatgaagctgagtttaggccaaatatgagcattgttgttaaagcactccaaccacttctgaagtctcctgctcctgctcctgctcctgttccagaaagttgaagcaaataaattcgctttggtttctgcatcttctgcacagttcgattcagttatctccagatttcatcaaatactgcggatatatctatatatttttttattattttttgtttgagattggatgacatgtgtaggattgggttggctcgtttaatgtcattgttaaattccatgtatttattgcatcacacttgtagtgctgagtctgctgacacccattgagccataatgcaacaataggttaatttgggttgtgtgggtaaatgttgtttgtcacttaacgttaatgccctccatattctttatttgtttcttgctatcaaactgagctgatacttgccttgaaagacctactatatttgtgggacctctctctctctctcgctttttgcggtgtgtttacaggattataattattgttcttgttattggttgtgtagtaagaggattatgattcgtgtttttgtaatttacttagtctcgtaaaagtagtttctgacttaaatgttttgtttactttg

SEQ ID NO: 8355 - DNA, 1686 bp, Vigna unguiculata
  misc_feature (930)..(930): n is a, c, g, or t
  misc_feature (1654)..(1654): n is a, c, g, or t
  misc_feature (1657)..(1657): n is a, c, g, or t
  misc_feature (1660)..(1660): n is a, c, g, or t
ctctcttcttgggtctgaatctgtttattattcgttgcttgggttggcacaaacaaaccctaagacattagagacgaagcctctcaatctcctctcatctcacttgaaatcgtataatctttaaggcacatgcgtctcctcctgattactttgtccgccaggggaatacaacttatcaagacgatctatttttgaggaagaggacaaggatgcgtcggtggctttgttgcacttgtcaggtggaggagtcttacccatcgaacgagaatgaacacctgaagagcccaaggaattatggagacagcaaccaaaaaggctcaaaggtgtcagctcctgtcaagcctgaaacacaaaaggcaccaccgcctattgaagctccagccctatctttagatgagctgaaggaaaagactgacaactttggttcgaaggcattaatcggtgaaggatcgtatggaagggtgtattacgcaaccttaaacaatggaaaagcagtggctgtgaaaaagcttgatgtttcatctgaacccgaatcaaataacgagtttttgacccaggtttccatggtctcaagattgaagaatgataattttgttgagttgcacgggtactgtgttgaaggaaatctccgtgtgcttgcatatgagtttgctactatgggctctcttcatgacatattgcacggtagaaagggagttcaaggtgcacaaccagggccaacacttgattggatccagcgagttagaatcgcagttgatgcggccaggggattggagtatttacatgagaaagttcagccaccaattatacacagggatatcagatcaagtaatgtgctaatctttgaagactacaaggctaagatagctgactttaacctctccaatcaggcccctgacatggctgcacgccttcattcaactcgtgtantgggaacttttggttatcatgctccagaatatgcaatgactgggcagttgactcaaaaaagcgatgtctatagttttggtgttgttcttcttgagcttcttactggaagaaaacctgttgaccacaccatgcctcgaggacagcagagtcttgtcacatgggctactccacgattgagtgaagataaagtgaaacagtgcgttgacccaaaactgaagggagaatacccccctaaaggagttgctaagcttgcagctgttgcagcactgtgcgtgcagtatgaagctgagtttaggccgaatatgagcattgttgttaaagcactccaaccacttctgaagactcctgctcctgctccagaaagttaaagcaaatgaaatggttcactttggtttctgcatcttctgcacagctcgattcaattatctccagatttcatcaaatactgcagatatatctatatttttatttttgtttgagattggatgtgtaggatttaattggctcgtttcatgtcattgttaaattccatgtatttatggcgtcgcacttgttgtgccgagtctgctgacatatatagagccatgatgccacataggtttgggttgcgtggtgcatatctgtgggtaatgttgtttgtcagttaacgttaatgcccccatattctttatttgtttcttgctatcaaactgagctgatacatgtcttgaaaacccatcacttnttnttntatctatttttttttcttgttctgca

SEQ ID NO: 8356 - DNA, 3651 bp, Glycine max
atacaccacaccacacctggctttctctttatcattcgttccttcctttcttcgcattgacaaaccctaacatagcatcatcctaaggcacatgcttctccccctgaatactttgtcctccaggggaacacaacttataaagacgatctatatttaaggaagaggacagggatgcgtcggtggctttgttgcacatgtcaggtggaagagtcttacccatcaaatgaaaatgagcacctgaaaagcccaaggaattatggagatggaaatcaaaaaggctcaaaggtgtcagctcctgtcaagcctgaaacacaaaaggcacctccacctattgaagctccagccttatctttagatgagctgaaggagaagacagacaactttggttcaaaggcattaataggtgaaggatcgtatggaagggtgtattatgcaaccttaaacaatggaaaagcagtggctgtgaaaaagcttgatgtttcatctgaacctgaatcaaataatgagtttttgacccaggtttccatggtctcaagattgaagaatggcaattttgttgagttgcatggttactgtgttgaaggaaatcttcgtgtacttgcatatgagtttgctactatgggctctcttcatgacatattgcacggtagaaagggagttcaaggtgctcaaccaggaccaactcttgattggatacagcgagttagaattgcagttgatgctgctcggggattggaatatttacatgagaaagttcaaccaccgattatacacagggatatcagatcaagtaatgtgctaatctttgaagattacaaggccaagatagccgactttaacctttctaatcaggcccctgacatggctgcacgccttcattcaactcgtgtattgggaacttttgggtatcatgctccagaatatgcaatgactgggcagttgactcaaaaaagtgatgtctatagttttggtgtggttcttcttgagcttcttactggcagaaaacctgttgaccataccatgcctagaggacagcagagtcttgtcacatgggctactccaagattaagtgaagataaagtgaaacagtgcgttgacccaaaactgaagggagaatacccccctaaaggggttgctaagcttgcagctgttgcggcgctgtgcgtgcagtatgaagctgagtttaggccaaatatgagcattgttgttaaagcactccaaccacttctgaagtctcccgctcctgctgctccagaaagttgaagcaaataaaatcgcttagatgtctgcatcgtctgcacagttcgattcagttatctccagatttcatcaaatactgcggatatatctatacatctatatttttttaaaatttttgtttgagattggatgtgtaggattgaattggcttgtttcttgttgtcattgttaaattccatgtatttatttcatcgcacttgtagtgccgagtctgctgacacccattgagccataatgcaacaataggtttgggttgtgtgggtaaatgttgtttgtcacttaacgttaatgccctccatattctttatttgtttcttgctatcaaactgagctgatacttcccctgaaagacctactatatttgttggacctttacctctccctctctcttttgtggtgtgtttacaagattatagttattgttcttgtaattaatcccccccatttcggttctttagttgtggaataacaggattatgattcgtgtttttgtgattttcgtattcccttaaaaagcgacttgaaaagtcaattaactaggagttcaagagcaagtgcgccccaaccctgcaaaacgaaagagtttagtgtagcgatggctgatgtttcagattcacgagaacaccccgttcttggttcagcgcaactgttggtggagctggaatctgcgctgggcggtgagaaaacggtgacggcgcaggcttcttcttcttccttaggcttggggattgaggttatcgacgaaacggcgttgctagactccgttgcgaagaagaacggaggaaccaagaacaatcaccagaagtctcagccctcaaataagattgggaacagaaagtactcgcgtaaggagttggagggtctgagattcctgaacatggcccgacagcgcaagttctggaaagcaattcacgctgcctttcaaagcaccgtggccatcgagtatgacactttagcctccactcccctgccgccccataacaaaccaatcctcagtgtggctgctactaacggaagatggagatatatgaatgtctttgtccattgaagaatgagcaaaagggacctggaacatgtctaatatgcaacattagttgaccatgttctgattgttgtaattaggcactgacttcagttgcatggttactagtgtaaaatcattgtttaggaaaagccttgtacagtaggcttcattgtagatttgaaagattactttggtcattcaaataatgacgatgctttgttttttagttcatcttttactttgcatgctgagaattacattgttgttttttcaataatcaataagaacttcaatttcttgtctacattgtgtcataatcttgtgagtgaggatgggtgctcagttgcaaaagagtgcagtgaagaatatgatggtagtgacgatgattatgctagcatccagaggcctgcctttatggttgatggagaacctaattttgattctggtccaccagaagatggatgggaatatcttaggcgtgtcaggtgggaggcacatcaaattccgaaagtgaaggtagcaaaacttgatagaggtaaacttaacaaggaacaaagtgcatacatgccccagattcctgatattgccaattgtccagagtatctgctgccattgaaagagtgggaggatgtgtttcttgctgagttttctgcactgagaaggaatttctcatgccttgatggttcaagtgccatacattctgaaaatcttcatgttcattcctcacaactagttgggaacaattgtggagaattttctagtgctatgagcagagatgtgttacttaataatcatttgagaattgggaagacaaatgatcaaccatctaactcgactgctgaaaataacgatagaacattgtctccagagaatcctgaagcaaaaacaatggactctgtagcccgggtatcaagtttgttgaaacgaattaggttgctagaggctgcaggcactatgacaaggaatgattgcatgtggctttttgctctctgtgcaacagttgatgctccactagatgctgacacttgtgcttctctcaggagtctgctaaggaagtgtgccagcatacgtgccggaaaggctggattggatgaggaggttgtaatgttgaatatattggctacaatttcggggaggtattttggacaatctgaaaactgaattgaattcccagtttgtaactttgttatgttttggtaactggtatggagccaatgacgtgtatgctatcgtaataacttatttgtttagctgataacatggagtttctttaatatgttcttttttttattctgcttctacttctatgttcttttggagtgcgaagatatataatattggcatgccaaaaaagaaattgattatat

SEQ ID NO: 8357 - DNA, 1587 bp, Fragaria vesca
gagagagagaggggacacacacattcacaggcacatgcccctccccctggttactttgtgagacttgagaacgctagtgctgacgacgatttatatttgaggaagaaagccaggatgcgcaggtggctttgttgttcttgtcatgtggatgagtcttatccatcacatgaaagtgaacacctgaagagcccagggagttatgctgatgggaatcacaagggctctaaggcgcccgctcctatgaagcctgatatacaaaaggcagcaccacctattgaagtccctccattgtctctggaggagctgaaagagaagactgacaattttggatctaagtcactgattggtgaaggatcatatgggagagtatattatgcaagcatggatgatggtaaagctgttgctgtcaagaagcttgacgttgcatctgagcctgagtcaaatgttgagtttctgacccaggtttccatggtttctagactgaggcatgacaatcttgttgagttgcttggttactgtgttgaaggaagtctacgggtgcttgcatatgagtttgccaccatgggttcgctgcatgatatattgcatggtagaaagggagttcaaggagcacaacctggtccaacacttgactggatgcagcgtgtgagaattgcagttgatgcagctagggggttggaatacttgcatgagaaggttcaacctcctattatacatagagatatcagatctagtaatgtgcttctctttgaagatttcaaagccaagatagcagattttaatctttcaaatcaggctcctgatatggctgctcgtcttcattccactagagttttgggaacttttggttatcatgctccagagtatgcaatgactggtcaattgacacagaagagtgatgtctacagctttggagtagttctcctagagcttctgactgggagaaagcctgtcgatcatacaatgccacgtggacagcagagtcttgtgacttgggctactccaagattgagtgaagataaggttaaacaatgtgtagatcccaagctgaaaggagaatatcctcccaaaggagttgcaaagcttgcagctgtggcagctttgtgtgtacaatatgaagctgagttccggccaaacatgagcattgttgttaaggctcttcaaccgcttctaaagccacctgcacctgctctagagtcatgaatttaagtgcttccttaggactctctgcatcctcaatacattccagtttcacttgcctgcagatatcatcataagctttaaatatatatatatatatatatatatatattttacttttcgtatatgagattggatatgatatgtagggttgatttattgtcattgctaagttctttgttgctggagctgattattggtaacaaattttccagtcataaattgatttggggtgttgggttgaggtggatatatttgtcactggatatagaattgtagattgcttgctttgactagtgtttttctgagtgaggctgtcacgtatgttgtgaactataaaacacctataatgccccctatttattatagggcgactatgattgtgca

SEQ ID NO: 8358 - DNA, 1680 bp, Phaseolus coccineus
tgtgtttattattcgttccttcgttgtattcgcttggcagaaagaaaccctaacacataacatacgaaatctctcatctcatatcaaagcatctttaaggcacatgcttcacctgattacttcgtccgccaggggaatacaacttatcaagacgatctatttttgaggaagaggacaaggatgcgtcggtggctttgctgcacttgtcaggtggaagagtcttacccatccaacgaaaatgaacacctgaaaagcccaaggaattatggagacagcaaccaaaaaggctcaaaggtgttacctcctgtgaagcctgaaacacaaaaggcaccaccacctattgaagctcccgccctatctttagatgagctgaaggaaaagactgacaactttggttctaaggcattaattggcgagggatcgtacggaagggtgtattatgcaaccttaaacaatggaaaagcagtggctgtgaaaaagcttgatgtttcatctgaacccgaatcaaataacgagtttttgacccaggtttccatggtctcaagattgaagaatgataattttgttgagttgcatggttactgtgttgaaggaaatcttcgtgtacttgcatatgagtttgctactatgggctctcttcatgacatattgcacggtagaaagggagttcaaggtgcacaaccagggccaactcttgattggatacagcgagttcgaatcgcagttgacgcggcaaggggattggagtatttacatgagaaagttcagccaccgattatacacagggatatcagatcaagtaatgtgctgatctttgaagagtacaaggctaagatagctgactttaacctttctaatcaggcccctgacatggctgcacgcctccattcaactcgtgtattgggaacttttgggtatcatgctccagaatatgcaatgactgggcagttgactcaaaaaagtgatgtctatagttttggtgttgttcttcttgagcttcttacaggaagaaaacctgttgaccacaccatgcctcgaggacagcagagtcttgtcacatgggctactccacgattgagtgaagataaagtgaaacagtgcgtagacccaaaactgaaaggagaatacccccctaaaggagttgctaagcttgcagctgttgcagcactgtgcgtgcagtatgaagctgagtttaggccaaatatgagcattgttgttaaagcactccaaccacttctgaagactcctgctcctgctcctgctccagaaagttgaagcaaatgaaatggtccactttggtttctgcatcttctgcacagctccattcaattatctccagatttcatcaaatactgcagatatatctatatatttttatttttgtttgagattggatgtgtaggattggattggctcgtttcatgccattgttaaattccatgtattttatggcatcgcacttgtagtgccgagtctgctgacatatattgagccatgatgccacataggtttgggttgcgtggtgcctatctgtgggtaatgttgtttgtcagttaacgttaattcacccatattctttatttgtttgttgttatcaaactgagctgatacttgtcttgaaagatcatcatttgttccctctttttatttgccctttaattttgtgctgtggcaacattt

SEQ ID NO: 8359 - DNA, 1595 bp, Lotus japonicus
ctttcgcgagcgattcacttgtgttgggagtttgcataaacaacaaaccctagacttagctaaggcacatgcttctcctcctcctggttactttgtccgcctgggaaatacaagcaaagacgatttatatttgaggaagagaacaaggatgcgtcgctggctttgttgcacttgtcaagtggaagagccttacccatcaaatgaaaatgaccacctcaaaagcccccggaattatggagatggcaactcaaaaggctcaaaggcttcagctcctgtcaagcatgaaacacaaaaagcaccaccacctatcgaagttcctgcattatccttagatgagctcaaggagaagactgacaactttggatcaaaggcattgattggtgaaggatcatatggaagggtgtattacgcaaccttaaatgatggaaacgctgtggctgtgaagaagcttgatgtttcttctgaacccgaaacaaataatgaatttttgactcaggtttccatggtctcaagattgaagaatgacaattttgttgagttgcacggttattgtgttgaaggaaatcttcgagttcttgcatatgagtttgctactatgggctctcttcatgacatattgcatggtagaaagggagttcaaggggcacagccaggtccaactcttgattggatacagcgtgttagaattgcagttgacgctgcaaggggactagaatatttgcacgagaaagttcaaccggctattattcacagagatatcagatcaagtaacgtgcttatctttgaagattacaaggctaagatagctgatttcaacctttctaatcaggcccctgacatggctgcacgccttcattctactcgagtgttgggaacttttgggtatcatgctccagaatatgccatgactggccagttgacacaaaaaagtgatgtctacagttttggtgttgttcttcttgagcttcttacaggaagaaaacctgttgatcacaccatgccccgaggacagcaaagtcttgtcacatgggctaccccacgattgagtgaggataaagtgaaacaatgcgtggacccaaaactgaagggtgaatatcccccaaaaggagttgctaagctggcagctgttgcagcactgtgtgtgcagtatgaagctgagtttaggccaaatatgagcattgttgttaaagcactgcaaccacttctgaagacccccgctgctgctcctgcaccagaaaattgaagccaatgaattgaagtttataacttctctttggaatctgcatcttttgcacagtttgagtcaatatctccagatttcatcaaatactacaaatatatacataataatatataattatatttttgtttgagattgaatgtgtaggattggattggctcgtttcatgtcattgttaaattccatctatgtctgacatggcacttgcaatgctgataatacaacaatggatttgggtttgggttgcgtggtggatatttgtggggatcaaacctcggatattctttatttgtttcttgcatcagactgagctgatacatgacttgaaaaacatatatttgttgatttagcttga

SEQ ID NO: 8360 - DNA, 801 bp, Theobroma cacao
actagtaatacaatgggtaagtgtcattcaaatcatggcaaagaccacaactgtaatctgtatgagtgagtacatctgaaacttcccttctcaagtctcaactcccttcacatgaaattccctatttatgccccacaccacacaaaccaccttcttcaaccaaacccctcttccttctttacttcacatttcaaccttctgctcttctccttgtttttgacaattttaggaggggtttgctatatagcaaaaggccatggctaaacttgttgctgccttcttgttggccctcattgccttctccatgcttcaaaccatggtcatggcatcacatggacatggaggccaccactacgatcaaaaacattacggccctggaagcctcaagagctcccaatgcccaacacagtgttcgaggaggtgcagcaagacccagtaccataagccatgcatgttcttctgtcagaaatgctgcaggaaatgcctgtgtgtgcccccagggtattatgggaacaaagctgtgtgcccttgctacaacaactggaagaccaaggaaggaggacccaagtgcccttgaagaatcttttcccattttccttcctttatccttatttcctactgaatcaagttccttaatcatagttaagcattctattgcactactgctaactatatatttacgttttgtgcttttggaaatgtgctggattttgtaccactttgtcactccatgagggtacccaccctctaaatgagagtggctaatctttgttctatttatcaatgaaggtgttattcaac

SEQ ID NO: 8361 - DNA, 585 bp, Manihot esculenta
ctctttcttttatcaccttcactgctactgtctcctcttctccttgcactgtgacgaagcccatggctaagtttgtcgctgtcttcctcttggccctcattgccatttcaatgctccaaactttggttatggcatctcatggtcatggaggtcaccactataacaatcagaatagctacgggccagggagtctcaagagctatcaatgcccatcacaatgctcgaggaggtgcagcaagacccaataccacaagccatgcatgttcttctgtcagaaatgctgcagaaagtgcctgtgtgtgcctcctgggtattatgggaacaaagccgtgtgcccttgctacaacaactggaagaccaaggagggaggacccaaatgcccttgaagcaaaatctcttgttcacctttctaaatctccctttttattgctgctatagtactttgatcttaaaattatcagtgccaatggtaccattgtaacactttttgaggtgggttttgtcatttatagtcactccttgagggagatctctgaaatgagagtggctaatctattatcaatgaattctatatatgttttggtt

SEQ ID NO: 8362 - DNA, 344 bp, Manihot esculenta
gccatggctaaatttgttgctgctttcttcttggccctcattgccctttcaatgctccaaactttggttatgtcatctcatgggcatggaggtcaccactacaacagccaaaggcgatatggaccagggagtcttaagagctaccaatgcccatcacaatgctcgaggagatgcagcaagacacaataccacaagccatgcatgttcttctgtcagaaatgctgcagaaagtgcctgtgtgtgcctccagggtattatgggaataaagctgtgtgcccttgctacaacaactggaagaccaaggaaggaggacccaaatgcccttgaaccaaatctctcattcc

SEQ ID NO: 8363 - DNA, 641 bp, Fagus grandifolia
aattcggcacgagattttcttcttccaattgtgcctttgccttttgaggttctgacaagcttaagaggggtttgattgtagcaatgaccatggctaagtttgttgctaccttgttcttggccctcattgccctctccatgcttcaaaccatggttatggcttctcatgggcatggtggtcatcattatgacaacactagcaagtatggacaagggagtctcaagagctaccaatgcccatcacaatgctcgaggaggtgcagcaagacccaataccataagccttgcatgttcttctgtcagaagtgctgcaaaaagtgcctgtgtgtgcccccagggtattatgggaataaagctgtgtgcccttgctacaacaactggaagaccaaggaaggaggccccaagtgcccttgaattcccatccttgccctttcaaatgttatcctatgatcctatcattagcatactactgcattactactaacttttatatgtatttctctttgagatgggcctgttttgttgggttgaggacttaaaatgctgtatcaatcagtcactccttaggggttttacctaaatgagagtggctagtctataagttatctgtgaaatcactggtttcactaattaatatttttg

SEQ ID NO: 8364 - DNA, 635 bp, Gossypium hirsutum
agccccttcttccatcctcactccacatttcactctctttttcaactttctcttcttctctttgttttaaagaggggctggagttttagccaaagaaaactccatggctaaacttgttgctactttcttcttggctctcattgccatctccatggttcaaactttggttatggcatcacatggacatggtggtcaccattatgataacaaacgttatggacctggaagtctcaagccttaccaatgtccatctcagtgcacaaggaggtgtagccagacacagtaccataaaccatgcatgttcttctgtcagaaatgttgcaggacatgcctttgtgttcctccagggtattatgggaacaaacaagtttgcccttgctacaacaactggaaaaccaaggaaggaggccccaaatgcccttaaattactcaaaagaagacccacattattatccctataaatttcctatttgaaattcaagtcatttaagcataaggttgcactgtaatactaactatatattttatgttgttagttgttactagtggtttaagtgttttgtttttttgtaccaaattgtcactccattaaaatgagagtggctaaactttgttctattttattaatgaagatg

SEQ ID NO: 8365 - DNA, 673 bp, Gossypium hirsutum
gtatcaacgcagagtacatggggatccaagccccttcttccatcctcactccacatttcactctctttttcaactttctcttcttctctttgttttaaagaggggcttgagttttagccaaagaaaactccatggctaaacttgttgctactttcttcttggctctcattgccatctccatggttcaaactttggttatggcatcacatggacatggtggtcaccattatgataacaaacgttatggacctggaagtctcaagccttaccaatgtccatctcagtgcacaaggaggtgtagccagacacagtaccataaaccatgcatgttcttctgtcagaaatgttgcaggacatgcctttgtgttcctccagggtattatgggaacaaacaagtttgcccttgctacaacaactggaaaaccaaggaaggaggccccaaatgcccttaaattactcaaaagaagacccttttttttttacattattatccctataaatttcctatttgaaattcaagtcattgaagcataaggttgcactgtaatactaactatatattttatgttgttagttgttactagtggtttaagtgttttgtttttttgtaccaaattgtcactccattaaaatgagagtggctaaactttgttctattttattaatgaagatg

SEQ ID NO: 8366 - DNA, 622 bp, Tropaeolum majus
tatcaacgcagagtattacggccggggattccttatttatcttctctttatattttgacgcattaggaggagttttgttattgtagaacggaggtccatggctaagtttgcagctttcttcctccttgctctcattgccatttccatgctccaaaccatggttttggcatcccatgggcatggaggacatcactttgacaaaaaacactttggaccagggagtctaaagagctaccaatgccctacgcagtgcacaaggagatgtagtaggacccaataccacaaaccgtgcatgttcttttgtcagaagtgctgcagcaagtgcttgtgtgtgcccccggggttttatggtaataaagctgtttgcccttgctacaataattggaagaccaaagagggaggacctaaatgcccttgattttattagttattttccatttttatccttccactttttggttaattaaggaaacaattattatccttatattattgtcattaattttaatgtaatttggttttactaattaccaccccatgagggcttgttcctataaatgagggtggctaatatagtcaattcattgacttttttgttatttttttgttattaattattaat

SEQ ID NO: 8367 - DNA, 694 bp, Sarracenia psittacina
tctctctctctctctctctctctctctctcttctgcattattgtttggttgcgagagaggggtttgttatccacattccacagtagcaaacggccatgcctaaggttgctgctttctttctgttcacccttctcgccatttccatgctccagctcatggttttggcatcccatggccatggtgggcaccatttgaacagtagcccatatggtagtgggagtctgaagagttcccaatgcccatcccaatgctcgaggaggtgcagccagacccaataccacaagccttgcatgttcttctgtcagaagtgctgcaataaatgcctgtgtgtgccccctggctactatggcaacaaagccgtctgcccttgctacaacaattggaagaccaagcaaggagggcccaagtgcccttaaaggacccaagtgcccttaacaacttaaaagttaaaaccctccatatctttttctttctttctttcttcttatcctcaactcttttaactacctaccaccaccagattactgctctaccaccacaataccaccaccagattactgctctactaccacaattaccatatgtattgtatttggaactcatgatgctcctattacaatctttaaagcctctttgtgttctttttgttttgaaaattatatgtatttctattctaatgcattacatgttggat

SEQ ID NO: 8368 - DNA, 761 bp, Populus trichocarpa
tctcaagtcttaacaagcaaatcccctcttctctcactttcacatctcttttcatctctttttggtgtttagacaatcctaggaagaagggttttgccttgtagctaaggccatggctaagtttgttgctgtcttcctcttggctctcattgccatttccatgctccaaaccttggttgtggcatcccatgggcgtggaggtcaccacaataacaacaagaacaaatatggacctgggagtctcaagagcttccaatgtccatcacaatgcacgaggaggtgtagcaagacccagtaccataagccatgcatgttcttctgtcagaagtgctgcaagaagtgcctctgcgttcccccagggtattatgggaataaagctgtgtgcccttgctacaacaactggaagaccaaggaaggagggcctaagtgcccttgaacaataattaatttcccttccctggtctccttttactatattatatgtatcaagtgttatgctctcggaatagcactaactatatactatatgtttggaaagctgtggttccggcggggaaagatggacttgtgttgtcgtcggtctatcgctcaagaagtcagtccttaggcctccgcaaatgaaagcggctaatctgttgttctattatcaatgagaattcgtgtttttttttgtgagttcacctctgagtcttgtgggtggttggttgatgaaaattgatatctgacctgagatttccttttctaaaatgttttgggttgtt

SEQ ID NO: 8369 - DNA, 711 bp, Castanea mollissima
acctctaagtttcctcttcctcttcttcccattgtccctttgccttttgaggttttgacaagctaagaggggtttggtttgtaacaatggccattgctaagtttgttgctgccttgctcttggccctcattgccctctccatgcttcaaaccatggttatggcttctcatgggcatggtggacatcactatgacaacactaacaagtttggacctgggagtctcaagagctaccaatgcccatcacaatgcacgaggaggtgcagcaagactcaataccataagccctgcatgttcttctgtcagaaatgctgcaaaaagtgcctgtgtgtgcccccagggtattatgggaacaaagctgtgtgcccctgctacaacaactggaagaccaaggagggaggccccaagtgcccttgaatcaactctcaatttcccatccttgtccttcctttcctatatattgtttttttttatttaatatcctatcacctagcatactactactgcattttacctctaacttttatatgtattcaccctaaagagtaaagatgaatctctattttgttgggttgaggggcttaaaatgctgtatcaatcagtcactccttaggggttttacctagatgagagtggctaatctatgtgttatctgtcaaaaaaagtgaaatctctggtttcactaattggcaagtaatattttgctctaaat

SEQ ID NO: 8370 - DNA, 711 bp, Quercus alba
ctctaccattgtactcataatatcaaacccctcgcctctaagtttcctcttgctcttcttcctattgtccctttgccttctgaggttttgacaagctaagaggggtttggtttgtaacaatggccattgctaagtttgttgctgccttgctcttggccctcattgccctctccatgcttcaaaccatggttatggcttctcatgggcatggtggtcatcactatgacaacactaacaagtttggacctgggagtctcaagagctaccaatgcccatcacaatgcacgaggaggtgcagcaagacccaataccataagccctgcatgttcttctgtcagaaatgttgcaaaaagtgcctgtgtgtgcccccagggtattatgggaacaaagctgtgtgcccttgctacaacaactggaagaccaaggaaggaggccccaagtgcccttgaatcaactctcaattttccatccttgtccttcctatcctatatatgttttttttaatcctatcacctagcagactactgctgcattttactactaacttttatatgtattcactgtaagatgaatctctattttgttgggttgagggcttaaaatgctgtatcaatcagtcactccttaggggttttacctagatgagagtggctaatctatatgttatctgtcaaaaaagtgaaatctctggtttcactaattgattagtaa

SEQ ID NO: 8371 - DNA, 778 bp, Vigna unguiculata
cccagcatctcctcaaacatccctcttgtttcttggtcttgattcgtgattcagacacaaggttctgccaaatcaagaggggttttctgatcgtagtgtgtgtgcaacaatggctatggctaagttctttgcagctatgatcttggcactcattgccatttccatgcttcaaacagtggttatggctgcaaatgggcatggagaccatctgaatgataacaagagcaaatatggaagtgggagtctcaagagttatcaatgcccatcacagtgctcgaggagatgtagcaagacccaataccacaagccctgcatgtttttctgtcagaagtgttgcaggaagtgcctgtgtgtgcctccggggtattatggtaataaggccgtgtgcccttgctacaacaactggaagaccaaggagggaggacccaagtgcccttaagcttcaacctcacctcaacaaacataagtgttgctttcttatatatttatcacttccttcattgttccatttaaggcactaccttacttccctactattcacatgtcctaactaaatggtatagccccttgtggtggcactattgttatgcattttgggatgtcctccctttaaggaccaccatctgtagtatcactccttaggactttgtttcctttaacgtgagtggctaattacttatatcaatacatcatctgtggaacttgttgctaccttaatatcttgtcttggaatgaatggtgcttcagtgttgcgttacttcactgttattgcaaaaaa

SEQ ID NO: 8372 - DNA, 763 bp, Lotus japonicus
attcaatcatcactccccttatctgctctctttaattcccttgtgggttgttgttcactttggtgctacataacacaagttctgctaaacagtgtagagtggtgcctgcagcttgaaacaatggccatgcctaaattacttgttgtcttgatcttggccctcattgccatttccatgcttcaaacaatggtcatggcatctcatgggcatggaggccattactacactgacaagaaaaaatatggacctggaagtctcaagagctaccaatgcccatcacaatgcacgaggaggtgcagcaggacccagtaccacaaaccttgcatgtttttctgccaaaagtgctgcaggtcttgcctctgtgtgcccccgggttattatgggaacaaagctgtgtgcccttgctacaacaactggaagaccaagagaggaggtcccaagtgcccttaagcatgttctccatctaattaaaagagacagctttctatatatatgatataatctccttgactccttgttcccttctatgtcctaaccaaaatacttgtcttttggctctatgtaataaggctatgtttggatatctattatggacattagcatacatttcaagccaaaaaaatgaatgaaattctcatgttagattgagatgaaagttgggtgacaacatactcaactagtattcaaacttgtatgttactttgcttgccactcaggctttttatggtttaattcaaatgaagtgtgtctaatactattgctc

SEQ ID NO: 8373 - DNA, 665 bp, Tropaeolum majus
cggccgggggaatcaaacttctctccttgtccacttcttcgtctttgtgtaagaggggttaggctactgtagaagagacctccatggctaagtttacagctttcttcctcattgctctcattgccattaccatgcttcaaaccatggttatggcatcacaagggcgtggagggaatcactccgaccaaaaacattatggacctgggagtctcaagggctaccaatgcccttcacagtgcacaaggaggtgtagtaggacccagtaccataaaccatgcatgtttttctgccagaagtgctgcaacaagtgcttgtgtgtaccaccggggttttatggtaataaaggtgtgtgcccttgctacaacaactggaagaccaaggaaggaggaccaaaatgcccttaagatgataataataataatttataatctctttccatttttacccttatcttaatcatactttaaaatatttcattaagaaaaaacattaactatgtaacgtggtttttgtttggagtttaatgtagtcttttgttaattttaatcaaatgggtcactccatgagtgttgttttgctcttgatgagggtggctaaattaatatatcattaatcaatatgtcgctttgtttatttatctaaaaaaaaaaaaaaaaggccgcctc

SEQ ID NO: 8374 - DNA, 745 bp, Fragaria vesca
agtaccaccccactctaaatctaaccccttctactgttagctccctcttcctcaagctttgagagtttgagggtttggtttcgccatttcaggaggggttaggtttgtctgtagcaatggccatggtcaagtttgttgctgctttgctcctgtcactccttgcaatctccatgctccaaaccatggttatggcaaatcatgggcatggaggtcaccacaaaggcaataaccaatatggaccagggagtctcaagagctaccaatgcccatcacagtgcacaaggaggtgcagcaagacccaataccacaagccttgcatgttcttctgccagaaatgctgcagcaagtgcctgtgtgtgcccccaggtttctatgggaacaaggctgtgtgcccttgctacaacaactggaagaccaaggaaggaggacccaaatgcccttgaagcctttgagccctctttctacttatctagtttactctaactaatatatatgatctgtattctctttgaaaactgggtttgtttttgtggggttagaagggactagatccgaaatctctatgatctagtcactgagaaagagtttacctaaaatgtggctatggctattattaatctatatagtcactgatgcaatttctggttttttacttgcgtgatttgtggagactattatattttgtttgtatccatggacatgaaatgaggttttggaattgggatccagcaaccaatgacatgat

SEQ ID NO: 8375 - DNA, 2696 bp, Vitis vinifera
aaataagggaacagctcaagggcattttggtcctctttccttggtcttccagttgttgtagcatgggcagacgactttattaccataataccctgggggaacgcataggcactttttgcagcgcttctgacataagaccatgcaaggtttgtggtactgtgtcttgctgcacctccttgagcattgtgacgggcattggaagctcttcagactccccggaccatagttcttttggtcgtagtggtgactgccatggccatgcaaagccaaaacagtggtgtgaagcatggaaatggcgagaagagccaagagaaacaacgcaaacaccttcgccatggcgatctaatgcttcgagggcagtgggtttgtgaagatgagaaaggtggtgagtgaagtgggtattggatcttctgtactgatcaaaccacttatatgtgtatgcatatatatatttacagtttcaggtcttagcagtatgatcctcgtaaataagagaagagcgatggaactcttcccagaaagtgtgacaaaactttggaatgaatgggaactccgcgcattggttttattgagccttttcttacaaattgtgctcatactcttgggtaacaggaggaaatatatagctagtaactgggtcagaatcatcatttggctggcttatttagctgcagattggattgcagcagtctgtattggcgtcctgtccaatgagaatggagatgacaacttatcacaaccaaacagtttgatatgggcattttgggcaccatttctgctgctgcaccttggcggcccggataccattacagcctattcattggaggataatgaattatggttaagacactttcttgcactagtcatccagtttggagggacattttacatttttcttaggtcctggaaggccaaactgcttaatattctggccattccaatttttgtggctggactcatcaagtatggggaaaggacctgggttctaaggtctgcaagcagtgagcaattcagagatgccctgctacctcgtcctgatccagggcctaattatcccaaattcatggatgagtacacttcaggaaaagccgagggatatcaagtttcaatacaacaacgaggtaaaacttctaggacagtgcattctcctccagaaggagacattttgcgacaggcttattacttcttcgaaactttcaagggtttgtttgcagatatcattcttagctcccagaggcgcaaaaggagccacggtggtcaagtaaaaacaaaaacaaaaacacagcgtgcaactgatctctgctatgagaatgatgcagagaagaatccagattgtaaagcgtgcaaggtgctttctgattatatgttgtatcttctggtcatgtgccctttcatgctgcctgacggaattggggagattagatatcgagacagctgcgccgaggctaaagaattcttcaaggatagaaagcacataaaaagtagaacccaagcttgcaaagatttactgagatgggagctgatgaggggtgtgtgggtggagatgctatgttacgctgcaagtcaatgtcggccgaatcagcatgccaagcagctcaggcgaggcggagagctgctcactcatgtctggcttctcatggctcatcttgatgtaagagaaaatttccagatttcacaaggcaatgcaaaaggtgggataattgacatttgcttccgttttaattcaaatgtgaacaatacatatatttcaggtaatcctcctcccattattggtggctgcatcatgattgatttcactcttgatctgttgaaagtgttatactcatatataattttgttaattaatggatcatgtaaataaaaaaatttctggcagtgatagagtagttcattgatattatgatttacttgtcatttattataacttagttattacagtaaggatcccaaaattgtccaggaaatgacataaattattcctgggtttcaaggcgaaatccctgccaattcaaggaagggcattccctgcgttgttggaaagtaaactttacaaaaagagaactgcacaatgtctttgttaaaaagctttaaaggtaacaaagagggcaccacattggagcaataacatgttttaccaactcctacggatgaaaagtctcctggggctggggacaaaggttgatggaaatcatcttcagccgtccttcagaagatggtaccattccattgaatatcattgcagagggcgccaaactttctgtagaggatgtggagtatcttttcatgaagagcctttctgttcacatggatttgactttgttagccttgacatggacaataacaaggtggcacaaggactcaatgtcttgtgcaaggagatgacttggtgagccatggacgcaatgccatgacatgtgtagcaccaatagagagactcgaatagggcacatcaatgtgaaaagttaacatcgaggcttgctattcataactgtccaatgacacctccttctctagttcctggattgtttcagaagcaaaattaatcaccattctaaaaacttctcgtgtgataaatgttttccatggtctgtgagtgtgattcatgtagttacgtttgaaatatatttcatgaagctttaatgggatatgttaatgtgttcttctgataaatcgttttgtgaaatttcaattataag

SEQ ID NO: 8376 - DNA, 682 bp, Arachis hypogaea
cccctctctcaatctctttatagtgccttttggttctttcatttatataagcaaaatttggctaagtgtaggggagatctaagagagggggtaacaatggccaagtctaagttccttcctgttttcatcttggccctcattgtcatttccatgcttcaaactgtggtcatggcatctcatgggcatggaggacaccattacaatgaccagaggaaatatggacctggcagtctcaagagctaccaatgcccatcaaaatgttcaacaaggtgcagtaggacccaataccacaagccgtgcatgtttttctgtcagaagtgctgtaacaagtgcctctgtgttcccccggggtattatgggaacaaagctgtctgcccctgctacaacaactggaagaccaaggaaggaggaccaaaatgcccttaattaattagttaattaaacagagagaaattgaaaattgaaaaccttgtaaacaataattccggggaaattaaaaaaatcgttaaaaataagaaatcagtatttaatattgagattgtaattttatcgtgtatgtgtttaattatcttgattccaagataattagatcctcagattttattttattagttttttattttaaaaaatttgatgcaataattttaatttatttacttcttccttctttatggtctaacta

SEQ ID NO: 8377 - DNA, 720 bp, Phaseolus coccineus
gatcccaacgcatctcctcaaacatccctcttgtttcttggtcttgatttgtgaatcagacagaagggtctgccaaatcaagaggggctttgtgatcatattgtgtgtgcaacaatggctatggctaagttctttgcagctatgatcttggcactcattgccatttccatgcttcaaacagtggttatggctgcaaatgggcatggagaccacctgaatgataacaagagcaaatatggaagtgggagtgtcaagagttaccaatgcccatcacaatgctcgaggagatgtagcaggacccaataccacaaaccctgcatgtttttctgtcagaagtgctgcaggaaatgcctgtgtgtgcccccggggtattatggtaataaggctgtgtgcccttgctacaacaactggaagaccaaggaaggaggacccaagtgcccttgagcttcaacttcaacatcacttgttgttctctcatatatttatcatttccttcattgttccatttaagacactagcttacttccctactattttacatgtcctaactaaatggtatagccccttgtggtggcactatgatatatgttttcttatgcattttgggatgtcctccctttaaggaccacatctgtactatcactccttaggacttggtttccttcaatgtgagtggcttacttatatcaatatatcatctgtggaacttcttgctagcgt

SEQ ID NO: 8378 - DNA, 750 bp, Malus domestica
cccaccacacttgaatctaaataactcccacttccttctcttcttgttcacatctccctcctcttgctcctgaggttatttttgccatttcaggaggggattgtctgtaacaatggccatggctaagttctttgctgccttgttcttggctctccttgccatctccatgcttcaaaccatggttttggcaaatcatgggcatggaggtcatcacaagggcaataatgcctatggacctgggagtctcaagagcagccaatgcccgtccgaatgcacgaggaggtgcagccagacgcagtaccacaagccctgcatgttcttctgtcagaaatgctgcaaaaagtgcctgtgtgtgccccctgggttttacgggaacaaggccgtgtgcccttgctacaacaactggaagacccagcaaggaggacccaaatgcccctgattaatttatcccttaattatcccttaatcatcttagtattactaattaactatatataataataatatataatataagttacatatatacataaaatgtatgagttctctttggagctgggtttgttctgttggtttgagaaagacttgaatttgtcattgtcttgccaatttccagtcactgagaatttggtttgaattagagaaaccctaatatgtattgtcatcaacgcaatttctggttttataaatggaataattaaaaattaaaatttgcactatcttttgtattgtggatggtggaatcctact

SEQ ID NO: 8379 - DNA, 714 bp, Malus domestica
tcccaacacttgaatctaaataactcccacttccttctcttcttgttcacatctccctcctcttgctcctgaggttatttttgccatttcaggaggggattgtctgtaacaatggccatggctaagttctttgctgccttgttcttggctctccttgccatctccatgcttcaaaccatggttttggcaaatcatgggcatggaggtcatcacaagggcaataatgcctatggacctgggagtctcaagagcagccaatgcccgtccgaatgcacgaggaggtgcagccagacgcagtaccacaagccctgcatgttcttctgtcagaaatgctgcaaaaagtgcctgtgtgtgccccctgggttttacgggaacaaggccgtgtgcccttgctacaacaactggaagacccagcaaggaggacccaaatgcccctgattaatttatcccttaattatcccttaatcatcttagtattactaattaactatatataataataatatataatataagttacatatatacataaaatgtatgagttctctttggagctgggtttgttctgttggtttgagaaagacttgaatttgtcattgtcttgccaatttccagtcactgagaatttggtttgaattagagaaaccctaatatgtattgtcatcaatgcaatttctggttttataaatggaataattaaaaattaaaatttgc

SEQ ID NO: 8380 - DNA, 630 bp, Rosa hybrid cultivar
ccactctcagtctccatcttcctctagttttgaggttttggttttcccatcttaggaggggttaggtttgtctgtagcaatggcgacggtcaagtttgttgctgctttgatcttgtcactccttgcaatctccatgctccaaagcatggttatggcaaaccatggccatggaggtcaccacaaaggcaataatcaatatggaccagggagtctcaagagctaccaatgcccatcacagtgcacaaggaggtgcagccagacccaataccacaagccctgcatgtttttctgccagaaatgctgcagcaagtgcctctgtgtgcctccagggtactatggaaacaaggctgtgtgcccttgctacaacaactggaagaccaaggaaggaggaccaaaatgcccttgaagcttttgagccctcttccttcttatctagtccactctactactgactatatatatgatatgtattctctttgagctgggtttgtttttgttgggttaaaagggactagatcagaaatctctgtgatctagtcactgagaaagagtttacctaaaatgtggctatggctattattaatctatagtcactgatgcaatttcaggcttttacttaaaaaaaaaaaa

SEQ ID NO: 8381 - DNA, 726 bp, Cajanus cajan
tacggggggaccacccccttctcctttctttgatatctacagtggttctttttgaaggggtttgtgtctgcttgcaacaacaatggctgtgcctaggctactagttgttttgatcctggccctcattgccatttccatgcttcaaacaatgattatggcatctcatggacatggaggccaccactacaatgacaagaaaaatttggacctggcagtctcaggagctaccaatgcccttcccaatgcacgaggaggtgcagcaggacccagtaccacaagccctgcatgttttctgccagaagtgctgtagaaaatgcctgtgtgtgcctccggggtattatgggaataaagctgtgtgcccttgctacaacaactggaagaccaaggaaggaggccccaaatgcccttaattaaccttcttcatcatattaacaaacatacccttaaatttaattatttcccatatcatatcatataatataattaatttccttagtcctctctatgccttgattaatcaaatacatatccattttggcctcttagtaatactttgtattgaggatgcctttcagagatagtgtgtgggctcctcttcatgcttttaaatgaagtgtctaatactgttgctgtttgtcatctatgttgagcttttcatgatttgttatcatctttatctccctttattgtatgaacaatggcaggcagttattaacttattatcat

SEQ ID NO: 8382 - DNA, 690 bp, Glycine max
gatcccagcatctcctcaaacacaaacatccctcttgatttgaaggttgttttgtgcttatagataaaagttctgccaaatcaagaggggttttcagatcatagtgtgtgtgtgtgtgtgttaaacaatggctaagttctttgctgctatgatcttggcactcattgccatttccatgcttcaaacagtggttatggctgctaatgagcaaggaggccacttgtatgacaacaagagcaaatatggaagtgggagtgtcaagagataccaatgcccatcacaatgctcgaggagatgtagccagacccaataccacaagccctgcatgtttttctgtcagaagtgctgcaggaaatgcctgtgtgtgcccccggggtattatggtaataaagctgtgtgcccttgctacaacaactggaagaccaaggaaggaggacccaagtgcccttgaacttcaacttcatcaaattgttgcttttcactatatttttatcatctcccttgggccaatttaatgcactagcttactttccctactattttacccgtcctaaccaaatgctccccttttggtggcactctacgatatatgtttttatgtattttggtgtatcctccttaggccttgtttgcctttaatgagagtggttattaatatcaatatatcaactataaaacttattgctagca

SEQ ID NO: 8383 - DNA, 691 bp, Actinidia deliciosa
tcttttcgccctttggctattggttcccaatccccttctctctcctgaattctcttgtttggttttatccagtgtgtgtgagagagaggggtttgcatcagtagcaaaaatgtccatcaccaagttctctgctttcttgctgttggctctgctttccatttccatgcttcagaccctggtattggcaaatcatggccatgggggacaccacaagaacagaaacggatatggaccggggagtttgaagagtttccaatgcccatcgcaatgctcgaggaggtgcagcaagacgcagtatcacaagccctgcatgttcttctgtcagaagtgctgcaacaagtgcctgtgtgtgcctccggggttttatgggaataaaggggtgtgcccttgctacaacaactggaagaccaaggaaggtggaccaaaatgcccttgaagaacccacctttatttctctaccttcctccattattatccgatctctcactatatttatatatatttactaatagcagcagattactgtgcaatgcctttgttatatgttggtgttgtttgtttttgggttcttaattatctttattattgatattgtaaggaatccaagggtgtaatagtccattgatcattggacaaccctcgatataatatgaattgtccatttgcactttccccccctcaaaaaaaaaaa

SEQ ID NO: 8384 - DNA, 568 bp, Vigna unguiculata
gggcaccctcttcttctttctgcagcttcagtttgcacaatagttgaagagctttctgatttatgttagcttccaacaatggctgttgtgactgctaagctactttctgctttcatcattgccctcattgccatttccatgcttcagacaatggttgtggcatctcatggacatggaggtcaccactacaatgacaagaaaaaatttggacctggaagtctccagagctcccaatgcccttcacaatgcacaaggaggtgtagcaggacccagtaccacaaaccttgcatgtttttctgtcagaagtgttgtatgaagtgcctgtgtgtacccccggggtattatgggaataaagcagtgtgcccttgctacaacaactggaagaccaagagaggaggacccaagtgcccttaacctctttttcttccatcacattaacaatcttatatacctttaatttccataaaatataatgtctcaattattcaaaagattaaattttgaatgtaattttaaatgtgtttgcttcaataatctatatcaacgacttttttgtattttaagatca

SEQ ID NO: 8385 - protein, 396 aa, Arabidopsis lyrata
MSNSRMNGVEKLSSISTRRVANPGKATLLALGKAFPSQVVPQENLVEGFLRDTKCEDAFIKEKLEHLCKTTTVKTRYTVLSREILDKYPELTTEGSPTIKQRLEIANEAVVEMALEASLGCIKEWGRPVEDITHIVYVSSSEIRLPGGDLYLSAKLGLRNDVNRVMLYFLGCYGGVTGLRVAKDIAENNPGSRVLLTTSETTILGFRPPNKARPYDLVGAALFGDGAAAVIIGADPRECEAPFMELHYAVQQFLPGTQNVIDGRLTEEGINFKLGRDLPQKIEENIEEFCKKLMGKAGGDESMEFNDMFWAVHPGGPAILNRLETKLKLEKEKLESSRRALVDYGNVSSNTILYVMEYMREELKKKGDEAQEWGLGLAFGPGITFEGLLIRSLTSP

SEQ ID NO: 8386 - protein, 395 aa, Eutrema halophilum
MSNPGMKGVEKQSSIFTRRVANPGKATVLALGKAFPSQVVPQENLVEGFLRDTKCDDAFIKEKLEHLCKTTTVKTRYTVLSREILDKYPELTTEGSPTIKQRLEIANEAVVEMALEASLGCIKEWGRPAGDITHIVYVSSSEIRLPGGDLYLSAKLGLRNDVNRVMLYFLGCYGGVTGLRVAKDIAENNPGSRVLLTTSETTILGFRPPNKARPYDLVGAALFGDGAAAVIIGADPRESEAPFMELHYAVQQFLPGTQNVIDGRLSEEGINFKLGRDLPQKIEENIEEFCKKLMGKAGDESMEFNDMFWAVHPGGPAILNRLETKLKLEGEKLESSRRALRDYGNVSSNTILYVMEYVRDELKKKGESAQEWGLGLAFGPGITFEGLLIRSLTSL

SEQ ID NO: 8387 - protein, 393 aa, Eutrema parvulum
MSNTGMNGVEKQRSTRRVASPGKATVLALGKAFPSQVVPQENVVEGFLRDTKCDDAFIKEKLEHLCKTTTVKTRYTVLSREILDKYPELTTEGSPTIKQRLEIANEAVVEMALEASLGCIKEWGRPVEDITHVVYVSSSEIRLPGGDLYLSAKLGLRNDVNRVMLYFLGCYGGVTGLRVAKDIAENNPGSRVLLTTSETTILGFRPPNKARPYDLVGAALFGDGAAAVIVGADPRECEAPFMELQYAVQQFLPGTQNVIDGRLSEEGINFKLGRDLPQKIEENIEEFCKKLMGKAGDDSMEFNDMFWAVHPGGPAILNRLETKLKLEREKLESSRRALMDYGNVSSNTILYVMEYVRDELKKKGDAAPEWGLGLAFGPGITFEGLLIRSLTSP

SEQ ID NO: 8388 - protein, 393 aa, Brassica rapa
MSSSGMNGVKKQISTRRVANPGKATVLALGKAFPSQVVPQEHLVEGFLRDTKCDDPFIKEKLEHLCKTTTVKTRYTVLSREILDKYPELTTEGSPTIKQRLEIANEAVVEMALEASLGCIKEWGRTVEDITHIVYVSSSEIRLPGGDLYLSAKLGLKSDVNRVMLYFLGCYGGVTGLRVAKDIAENNPGSRVLLTTSETTILGFRPPNKARPYDLVGAALFGDGAAAVIIGADPLPSEAPFMELHYAVQQFVPGTQTVIDGRLTEEGINFKLGRDLPQKIEENIEEFCKKLMGKAGDDSMEFNDMFWTVHPGGPAILNRLETKLKLGREKLECSRRALVDYGNVSSNTILYVMEYMRDELKKKGDGAQEWGLGLAFGPGITFEGLLLRSLAST

SEQ ID NO: 8389 - protein, 393 aa, Brassica napus
MSSSGMNGVKKQITTRRVANPGKATVLALGKAFPSQVVPQEHLVEGFLRDTKCDDPFIKEKLEHLCKTTTVKTRYTVLSREILDKYPELTTEGSPTIKQRLEIANEAVVEMALEASLGCIKEWGRPVEDITHIVYVSSSEIRLPGGDLYLSAKLGLKNDVNRVMLYFLGCYGGVTGLRVAKDIAENNPGSRVLLTTSETTILGFRPPNKARPYDLVGAALFGDGAAAVIIGADPLPSESPFMELHYAVQQFVPGTQTVIDGRLTEEGINFKLGRDLPQKIEENIEEFCKKLMGKAGDDSMEFNDMFWTVHPGGPAILNRLETKLKLGREKLECSRRALVDYGNVSSNTILYVMEYMRDELKKKGDGAQEWGLGLAFGPGITFEGLLLRSLASP

SEQ ID NO: 8390 - protein, 393 aa, Brassica napus
MSSSGMNGVKKQISTRRVANPGKATVLALGKAFPSQVVPQEHLVEGFLRDTKCDDPFIKEKLEHLCKTTTVKTRYTVLSREILDKYPELTTEGSPTIKQRLEIANEAVVEMALEASLGCIKEWGRTVEDITHIVYVSSSEIRLPGGDLYLSAKLGLKSDVNRVMLYFLGCYGGVTGLRVAKDIAENNPGSRVLLTTSETTILGFRPPNKARPYDLVGAALFGDGAAAVIIGADPLPSEAPFMELHYAVQQFVPGTQTVIDGRLTEEGINFKLGRDLPQKIEENIEEFCKKLMGKAGDDSIEFNDMFWTVHPGGPAILNRLETKLKLGREKLECSRRALVDYGNVSSNTILYVMEYMRDELKKKGDGAQEWGLGLAFGPGITFEGLLLRSLASP

SEQ ID NO: 8391 - protein, 369 aa, Brassica napus
TVLALGKAFPSQVVPQEHLVEGFLRDTKCDDPFIKEKLEHLCKTTTVKTRYTVLSREILDKYPELTTEGSPTIKQRLEIANEAVVEMALEASLGCIKEWGRTVEDITHIVYVSSSEIRLPGGDLYLSAKLGLKSDVNRVMLYFLGCYGGVTGLRVAKDIAENNPGSRVLLTTSETTILGFRPPNKARPYDLVGAALFGDGAAAVIIGADPLPSEAPFMELHYAVQQFVPGTQTVIDGRLTEEGINFKLGRDLPQKIEENIEEFCKKLMGKAGDDSIEFNDMFWTVHPGGPAILNRLETKLKLGREKLECSRRALVDYGNVSSNTILYVMEYMRDELKKKGDGAQEWGLGLAFGPGITFEGLLLRSLASP

SEQ ID NO: 8392 - protein, 389 aa, Raphanus sativus
  misc_feature (363)..(364): Xaa can be any naturally occurring amino acid
MSNSGMNGVKNQINTRRVANPGKATVLALGKAFPSQVVPQEHLVEGFLRDTKCDDAFIKEKLEHLCKTTTVKTRYTVLSREILDKYPELTTEGSPTIKQRLEIANEAVVEMALEASLCCIKEWGRQVEDITHIVYVSSSEIRLPGGDLYLSAKLGLKNDVNRVMLYFLGCYGGVTGLRVAKDIAENNPGSRVLLTTSETTILGFRPPNKSRPYDLVGLLCSGRAAAVIVGADPYIRVSLHGAALRCSAVLARDAEVIDGRLTEEGINFKLGRDLPQKIEENIEEFCKKLMVKAGDDSMEFNDMFWTVHPGGPAILNRLETKLKLGREKLECSRRALVDYGNVSSNTILYVMEYMRDELKKKGXXAQEWGLGLAFGPGITFEGLLIRSLT

SEQ ID NO: 8393 - protein, 390 aa, Unknown
  Sequence found in Organisms: Citrus sinensis, Citrus clementina, Citrus sinensis
MSQINGSGSDGHHSASARRTPTPGKATVLAIGKAFPSQLIPQECLVEGYLRDTKCEDESIKEKLERLCKTTTVKTRYTVMSKAILDKYPELTTEGSATIKQRLEIANPAVVEMALEASLACIKEWGRPAEDITHIVYVSSSEIRLPGGDLYLSSKLGLRSDVGRVMLYFLGCYGGVTGLRVAKDIAENNPGSRVLLTTSETTILGFRPPNKSRPYDLVGAALFGDGAAAVIVGADPFLDKESSPFMELNYAVQQFLPGTQNVIDGRLSEEGINFKLGRDLPQKIEENIEEFCKKLMAKAGLQDFNDLFWAVHPGGPAILNRLESNLKLNNQKLECSRRALMDYGNVSSNTIFYVMDYMREELKRKGDEEWGLALAFGPGITFEGILLRGL

SEQ ID NO: 8394 - protein, 219 aa, Arabidopsis lyrata
MASPTQTLLLLLTTVFFFISASADPDMLQDLCVADLPSGIKINGFPCKDAATVTSADFFSQGLANPGLTNNTFGALVTGANVMTIPGLNTLGVSLSRIDYAPGGLNPPHTHPRATEIVFVLEGTLDVGFLTTANKLISQSLKKGDVFAFPKGLVHFQKNNGHVPASVIAAFNSQLPGTQSLGATLFGSTPPVPDNILAQAFQTSSGTVKHIKSKFQPKK

SEQ ID NO: 8395 - protein, 221 aa, Eutrema halophilum
MASPTRTLFLLLSFAVFFFFITVSADPDMLQDLCVADLSSGIKVNGFPCKDAANVTSLDFFSQGLANPGLTNNTFGALVTGANVMTIPGLNTLGVSLSRIDYAPGGLNPPHTHPRATEVVFVLEGTLDVGFLTTANKLISQSLKKGDVFAFPKGLVHFQKNSGHVPASVIAAFNSQLPGTQSLGATLFGSSPPVPDTILAQAFQTSPGTVKHIKTKFQPKK

SEQ ID NO: 8396 - protein, 216 aa, Brassica napus
MASPTLFLSILLFFLITVSADPDMLQDLCVADLSSGIKVNGFPCKDAANVTSLDFFSQALANPGLTNNTFGALVTGANVMNLPGLNTLGVSLSRIDYAPGGLNPPHTHPRATEVVYVLEGTLDVGFLTTANKLISRSLKKGDVFAFPKGLVHFQKNNGDVPASVIAAFNSQLPGTQSLGATLFGSTPPVPDEILAQAFQTSSGTVKHIKTRFQPKK

SEQ ID NO: 8397 - protein, 215 aa, Brassica napus
MASPTLFLSILLFFLITVSADPDMLQDLCVADLSSGIKVNGFPCKDAANVTSLDFFSQALANPGLTNNTFGALVTGANVMNLPGLNTLGVSLSRIDYAPGGLNPPHTHPRATEVVYVLEGTLDVGFLTTANKLISRSLKKGDVFAFPKGLVHFQKNNGDVPASVIAAFNSQLPGTQSLGATLFGSTPPVPDEILAQAFQTSSGTVKHIKTRFQPK

SEQ ID NO: 8398 - protein, 220 aa, Eutrema parvulum
MASSIPFLSIFLGLVAFFFITVSADPDMLQDFCVADLSSGIKVNGYPCKDAAKVTSLDFFSQGLAKPGLTNNTFGALVTGANVMTVPGLNTLGVSLSRIDYAPGGLNPPHTHPRATEVVFVLEGTLDVGFLTTTNKLISQSLKKGDVFAFPKGLVHFQKNSGRGPASVIAAFNSQLPGTQSLGATLFGSSPPVPDNILAQAFQTSPGTVKHIKTRFQPKK

SEQ ID NO: 8399 - protein, 217 aa, Raphanus sativus
MASPTTPFLSIFLFFLITISADPDMLQDLCVADLSSGIKVNGFPCKDAANITSLDFFSQGLANPGLTNNTFGSLVTGANVMNLPGLNTLGVSLSRIDYAPGGLNPPHTHPRATEVVYVLEGTLDVGFLTTANKLISRSLKRGDVFAFPKGLVHFQKNNGDVPASVIAAFNSQLPGTQSLGATLFGSTPPVPDNILAQAFQTSPGTVKHIKTRFQPKK

SEQ ID NO: 8400 - protein, 217 aa, Raphanus sativus
MAPFLSISLALVAIFFITVSADPDMLQDLCVADLSSGIKVNGFPCKDAANVTPLDFFSQGIANPGLTNNTFGSLVTGANVMAIPGLNTLGVSLARIDYAPGGLNPPHTHPRATEVVYVLEGALDVGFLTTANKLISQSLKKGDVFAFPKGLVHFQKNNGRVPASVIAAFNSQLPGTQSLGATLFGSTPPVPDQILAQAFQTSPGTVKHIKTKFQPKK

SEQ ID NO: 8401 - protein, 217 aa, Raphanus sativus
MAPFLSISLALVAIFFITVSADPDMLQDLCVADLSSGIKVNGFPCKDAANVTPLDFFSQGIANPGLTNNTFGSLVTGANVMTIPGLNTLGVSLARIDYAPGGLNPPHTHPRATEVVYVLEGALDVGFLTTANKLISQSLKKGDVFAFPKGLVHFQKNNGRVPASVIAAFNSQLPGTQSLGATLFGSTPPVPNEILAQAFQTSPGTVKHIKTKFQPKV

SEQ ID NO: 8402 - protein, 223 aa, Brassica napus
MASQTPFLSISISLALAAFLFFITVSADPDMLQDLCVADLSSGIKVNGFPCKDAANVTSLDFFSQGIANPGLTNNTFGALVTGANVMTIPGLNTLGVSLARIDYAPGGLNPPHTHPRATEVVYVLEGTLDVGFLTTANKLIAQSLKKGDVFAFPKGLVHFQKNNGRVPASVVAAFNSQLPGTQSLGATLFGSTPPVPDSVLAQAFQTSPGTVKHIKTKFQPKK

SEQ ID NO: 8403 - protein, 215 aa, Raphanus sativus
  misc_feature (105)..(105): Xaa can be any naturally occurring amino acid
FLSISLALVAISFFITVSADPDMLQDLCVADLSSGIKVNGFPCKDAANVTPLDFFSQGIANPGLTNNTFGSLVTGANVMTIPGLNTLGVSLARIDYAPGGLNPPXTHPRATEVVYVLEGALDVGFLTTANKLISQSLKKGDVFAFPRGLVHFQKNNGRVPASVIAAFNSQLPGTQSLGATLFGSTPPVPDEILAQAFQTSPGTVKHIKTKFQPKK

SEQ ID NO: 8404 - protein, 220 aa, Unknown
  Sequence found in Organisms: Brassica oleracea, Brassica rapa
MASPTSFLSIFLCLVAFLFITVSADPDMLQDLCVADLSSGIKVNGFPCKDAANVSSLDFFSQGIANPGLTNNTFGALVTGANVMTIPGLNTLGVSLARIDYAPGGLNPPHTHPRATEVVYVLEGTLDVGFLTTANRLISQSLKKGDVFAFPRGLVHFQKNNGRVPAAVIAAFNSQLPGTQSLGATLFGSTPPVPDEILSQAFQTTPRIVRNIKSRFQPKK

SEQ ID NO: 8405 - protein, 219 aa, Brassica napus
MASPTSFLSLLSLIAFFLITVSADPDMLQDLCVADLSSGIKVNGFPCKDAANVSSLDFFSQGIANPGLTNNTFGALVTGANVMTIPGLNTLGVSLARIDYAPGGLNPPHTHPRATEIVYVLEGTLDVGFLTTANRLISQSLKKGDVFAFPRGLVHFQKNNGRVPAAVIAAFNSQLPGTQSLGATLFGSTPPVPDEILSQAFQTTPRIVRNIKSRFQPKK

SEQ ID NO: 8406 - protein, 218 aa, Brassica napus
SPTSFLSIFLCLVAFLFITVSADPDMLQDLCVADLSSGIKVNGFPCKDAANVSSLDFFSQGIANPGLTNNTFGALVTGANVMTIPGLNTLGVSLARIDYAPGGLNPPHTHPRATEVVYVLEGTLDVGFLTTANRLISQSLKKGDVFAFPRGLVHFQKNNGRVPAAVIAAFNSQLPGTQSLGATLFGSTPPVPDEILSQAFQTTPRIVRNIKSRFQPKK

SEQ ID NO: 8407 - protein, 202 aa, Brassica napus
FLITVSADPDMLQDLCVADLSSGIKVNGFPCKDAANVTSLDFFSQALANPGLTNNTFGALVTGANVMNLPGLNTLGVSLSRIDYAPGGSNPPHTHPRATEVVYVLQGTLDVGFLTTANKLISQSLKKGDVFAFPKGLVHFQKNNGDVPASVIAAFNSQLPGTQSLGCLLCSALRLLFLMRSWLKPFRRLQELLNTIKTRFQP

SEQ ID NO: 8408 - protein, 415 aa, Arabidopsis lyrata
MIIVDVLWKLFPLYSFGSERDSLSESILQIIPETMASSTTKILCDAGDSDLCRDDSAAFLLKFVAIASILLAGAAGVAIPLIGRNRRFLQTEGNLFVAAKAFAAGVILATGFVHMLAGGTEALSNPCLPDYPWSQFPFPGFFAMVAALVTLLVDFMGTQYYERKQERNQAAGETAVVEPGREETAVVPVVGERVNDNKVFGEEDGGGIHIVGIRAHAAHHRHSHSNSHGTCDGHAHGHSHGHGHGHVHGNSDVENGARHVVVSQILELGIVSHSIIIGLSLGVSQSPCTIRPLIAALSFHQFFEGFALGGCISQAQFRNKSATIMACFFALTTPIGIGIGTAVASSFNSHSPGALVTEGILDSLSAGILVYMALVDLIAADFLSKRMSCNVRLQVVSYIMLFLGAGLMSALAVWA

SEQ ID NO: 8409 - protein, 414 aa, Eutrema parvulum
MIIADVLWKSFPLYLFGGSGRDSLSESILQMIPETMASSKILCDAGESDLCRDDSAAFLLKFIAIACILLAGAAGVAIPLVGKNRRFLRTEGNLFVAAKAFAAGVILATGFVHMLAGGTEALTNPCLPDFPWSKFPFPGFFAMVAALITLLVDFMGTQYYERKQERNDEAAGESPAVVEPGREEASVVPVVVERVNDNKVFGEEDSGGIHIVGIRAHAAHHRHSHSNGHGTCDGLAHGHSHGHGHAHGFQDVESGARHVVVSQILELGIVSHSIIIGLSLGVSQSPCTIRPLIAALSFHQFFEGFALGGCISQAQFRNKSATIMACFFALTTPIGIGIGTAVASSFNSRSPGAVVTEGILDSLSAGILVYMALVDLIAADFLSKRMSCNVRLQVVSYVMLFLGAGLMSALAIWA

SEQ ID NO: 8410 - protein, 420 aa, Raphanus sativus
MIIVDILWKLFPLYLFGGGSGRESLSESILQMIPPTMASSKILCDAGESDLCRDDSAAFLLKFVAIASILLSGAAGVAIPLVGKNRRFLQTEGNLFVSAKAFAAGVILATGFVHMLAGGTEALTNPCLPEFPWSKFPFPGFFAMVAALITLLVDFMGTQYYERRQERRGDESAAAASEASAGVGVESGREEASVVVPVVVERVSDCSSKVFGEEEGGGMHIVGIRAHAAHHRHSHSNGLGTCDGHAHGHGHAHGHQDVGNGARHVVVSQILELGIVSHSIIIGLSLGVSQSPCTIRPLIAALSFHQFFEGFALGGCISQAEFKNKSATIMACFFALTTPVGIGIGTAVASSFNSHSPGALIAEGILDSLSAGILVYMALVDLIAADFLSKRMSCNVRLQIVSYVMLFLGAGLMSALAIWA

SEQ ID NO: 8411 - protein, 418 aa, Brassica napus
MIIVDILWKLFPQYLFGGGSGTDSLSESILQMIPSAMASPKILCDAGESDLCRDDSAAFVLKFVAIASIFLSGAAGVAIPLVGKNRRFLQTEGNLFVSAKAFAAGVILATGFVHMLAGGTEALTNACLPEFPWSKFPFPGFFAMVAALITLLVDFMGTQYYERRQERSDDAAAPSEASAVVGVESGREEASVVVPVVVERVSDGNNKVFGEEEGGGMHIVGIRAHAAHHRHSHSNGLGTCDGHAHGHGHAHGHQDVGNGARHVVVSQILELGIVSHSIIIGLSLGVSQSPCTIRPLIAALSFHQFFEGFALGGCISQAQFKNKSATVMACFFALTTPVGIGIGTAVASSFNSHSPGALIAEGILDSLSAGILVYMALVDLIAADFLSKRMSCNMRLQVVSYVMLFLGAGLMSALAIWA

SEQ ID NO: 8412 - protein, 413 aa, Brassica napus
MIIVDILWKSFPLYLFSGSGTDPLSESILQMMASPKILCDAGESDLCRDDSAAFVLKFVAIASIFLSGAAGVAIPLVGKNRRFLQTEGNLFVSAKAFAAGVILATGFVHMLAGGTEALTNACLPEFPWSKFPFPGFFAMVAALITLLVDFMGTQYYERRQERSDNAAAPSEASAVVGVESGREEASVVVPVVVERVSDGNNKVFGEEEGGGMHMVGIRAHAAHHRHSHSNGLGTCDGHAHGHGHAHGHQDVGNGARHVVVSQILELGIVSHSIIIGLSLGVSQSPCTIRPLIAALSFHQFFEGFALGGCISQAQFKNKSATVMACFFALTTPVGIGIGTAVASSFNSHSPGALMAEGILDSLSAGILVYMALVDLIAADFLSKRMSCNMRLQVVSYVMLFLGAGLMSALAIWA

SEQ ID NO: 8413 - protein, 373 aa, Eutrema halophilum
MASSTPSKILCDAGESDLCRDDSAAFLLKFIAIASILIAGAAGVAIPLIGRNRRFLKTEGNLFVAAKAFAAGVILATGFVHMLAGGTEALTNPCLPDYPWSKFPFPGFFAMVAALVTLLVDFMGTQYYERNQERNEAASEPGVVESGREGTAVAPERVNDNKVFGEEDGGGIHIVGIRAHAAHHRHSHSNGHGTCDGHAHGHGHVHGNSDVENGARHVVVSQILELGIVSHSIIIGLSLGVSQSPCTIRPLIAALSFHQFFEGFALGGCISQAQFRNKSAIIMACFFALTTPIGIGMGTAVASSFNTHSPGALVTEGILDSLSAGILVYMALVDLIAADFLSKRMSCNVRLQVVSYVMLFLGAGLMSALAIWA

SEQ ID NO: 8414 - protein, 378 aa, Brassica napus
MIIVDILWKSFPLYLFGGGSGTDSLSESILQMMASPKILCDAGESDLCRDDSAAFVLKFVAIASIFLSGAAGVAIPLVGKNRRFLQTEGNLFVSAKAFAAGVILATGFVHMLAGGTEALTNACLPEFPWSKLPFPGFFAMVAALITLLVDFMGTQYYERRQERSDDATAASEASAAVGVESGREEASVVPVVVERVSDGNNKVFGEEEGGGMHIVGIRAHAAHHRHSHSNGLGTCDGHGHSHGHGHQDLGNGARHVVVSQILELGIVSHSIIIGLSLGVSQSPCTIRPLIAALSFHQFFEGFALGGCISQAQFKNKSATVMACFFALTTPVGIGIGTAVASSFNSHSPGALVAEGILDSLSAGILVYMALVDLIAADF

SEQ ID NO: 8415 - protein, 425 aa, Eutrema halophilum
MFLIDVLWKLLPLYFFGSDRDSLSATESILQIVPETMAASSSSSILCNAGESDLCRDDSAAFLLKLVAIASILMAGAAGVAIPLIGRNRRFLQTDGSLFVAAKAFAAGVILSTGFVHMLAGGTEALTNPCLPDFPWSKFPFPGFFAMVAALITLLVDFMGTQYYERKQEREATDKSDEQPGYEQSPSIVVPVVAEGANDEKVFGEEDNGGIHIVGIHAHAAHHRHNHPQGHNSCEGHRKIDIGHGHGHGHGHGHGHGHGGLDVGSGARHVVVSQVLELGIVSHSIIIGISLGVSQSPCTIRPLIAALSFHQFFEGFALGGCISQAQFRNKSATIMACFFALTTPIGIGIGTAVASSFNSHSVGALVTEGILDSLSAGILVYMALVDLIAADFLSKRMSCNFRLQIVSYLMLFLGAGLMSSLAIWA

SEQ ID NO: 8416 - protein, 423 aa, Brassica napus
MFFIDVLWSLFPLYFFRSERDSLSETESILQVVPETMVASSSTILCNASESDLCRDDSAAFLLKLVAIASILLAGAAGVAIPLIGRNRRFLRTDSSLFVTAKAFAAGVILATGFVHMLAGGTEALNNPCLPEFPWSKFPFPGFFAMVAALITLLVDFMGTQYYERKQEREGADQSDEQLGLEQSPGIVVPVVVEGGDDDDKVFGEEDNGGIHIVGIHAHAAHHTHSHPQGHGSCDGHQKIDIGHGHGHGHGHGHAHGGLELGSGARHVVVSQVLELGIVSHSIIIGISLGVSQSPCTIRPLIAALSFHQFFEGFALGGCISQAQFRNKSATIMACFFALTTPIGIGIGTAVASSFNSHSVGALVTEGILDSLSAGILVYMALVDLIAADFLSKRMSCNFRLQIVSYMMLFLGAGLMSSLAIWA

SEQ ID NO: 8417 - protein, 425 aa, Arabidopsis thaliana
MFFVDVLWKLVPLYLFGSETKSLSATESILQIVPEAMAATSSNVLCNASESDLCRDDSAAFLLKFVAIASILLAGAAGVTIPLIGRNRRFLQTDGNLFVTAKAFAAGVILATGFVHMLAGGTEALKNPCLPDFPWSKFPFPGFFAMIAALITLFVDFMGTQYYERKQEREASESVEPFGREQSPGIVVPMIGEGTNDGKVFGEEDSGGIHIVGIHAHAAHHRHSHPPGHDSCEGHSKIDIGHAHAHGHGHGHGHGHVHGGLDAVNGARHIVVSQVLELGIVSHSIIIGLSLGVSQSPCTIRPLIAALSFHQFFEGFALGGCISQAQFRNKSATIMACFFALTTPIGIGIGTAVASSFNSHSVGALVTEGILDSLSAGILVYMALVDLIAADFLSTKMRCNFRLQIVSYVMLFLGAGLMSSLAIWA

SEQ ID NO: 8418 - protein, 203 aa, Arabidopsis lyrata
MGEASRQQRAWNREMTVTTNLSLDIDKYPRDLLRGFMSENGGGRAFHGGELGCDDESAIELNLGLSLGGRFGVDKTPRKLKRSSSVLDTVPFNDSTVAEPENYTVGLERTTSLPAEMEEEWRKRKEMQSLREWKLREGDVRNRVSELGILMTKRCRLRMRDGLLRVKVASCRDIWFLLIDKCVVLIPMEEVEQEEVAHRACRN

SEQ ID NO: 8419 - protein, 344 aa, Eutrema halophilum
MGEEASRQQRAWNREMTVSTNLSLDIDKYPRDLLRGFMSENGGGRSFHGGETDCDDESAIELNLGLSLGGRFGVDKTPRKLKRSSSVIGTVPFDDSTTFVSETEVEPENYTVGLARTTSLPAEMEEEWRKRKEMQSLRRMEAKRRRCEKQSFRVDQTPSFESERWATASKSGFLQRHLVSSNGQVSFDSDGGRGGGGSSSCLSELDNKNQQGSSNSCGDERSPKIMTRCSSTSGSQGTEKPRANEKENEKGVRREDESVDRKGKGTATSTGLFDMPCVFTKGDGPNGRRVDGILYKYGKGEEVRIMCICHGSFLTPAEFVKHGGGGDVDRPLRHIVVNTSSSTF

SEQ ID NO: 8420 - protein, 346 aa, Eutrema parvulum
MGEEASRQERACNREMTVTTNLSLDINKYPRDLLRGFTSENGGGRAIHGGDETLDCEDETAIELNLGLSLGGRFGVDKTPRKLKRSSSVLGTVPYDSSIVAEREAEPENYAVGLARTTSLPAEMEEEWRKRKEMQSLRRMEAKRRRCEKQSFRVGNSDDQTSSFETERWVTASKSGFLQRHLVSSNRQVCVDSDGARGGGSSSSLSELDNKNQQGSSNSCGEERSPRIMTRCSSNSESHGTEKPRANKGDEKGVRREDESVDRKGKGTAAATGLFDMPCVFTKGDGPNGRRVDGILYKYGKGEEVRIMCICHGSFLTPAEFVKHGGGGDVDRPLRHIVVNTSPSTF

SEQ ID NO: 8421 - protein, 233 aa, Arabidopsis lyrata
MQRSSLRLLAKPLLESKRGFCTSSDKIVASVLFERLRVVIPKPDPAVYAFQEFKFNWQQQFRRRYPDEFLDIAKNRAKGEYQMDYVPAPRITEADKNNDRKSLYRALDKKLYLLIFGKPFGATSDKPVWHFPEKVYDSEPTLRKCAESALKSVLGDLTHTYFVGNAPMAHMAIQPTEEMPDLPSYKRFFFKCSVVAASKYNISNCEDFVWVTKDELLEFFPEQAEFFNKMIIG

SEQ ID NO: 8422 - protein, 232 aa, Eutrema halophilum
MRSSLRLLAGSLLESRRGFCTSSDKLVASVLFERLRVVIPKPDPAVYTFQEFKFNWQQQFRRRYPDEFLDIAKNRAKGEYQMDYVPAPRITEADKKNDRKSLYRALDKKLYLLIFGKPFGATSDKPVWHFPEKVYDSEPTLRKCAESALESVLGDLTHTYFVGNAPMAHMVIQPTEETPDLPSFKRFFFKCSVVAASKYNISNCEDFVWVTKDELLEIFPEQAEFFNKMIIS

SEQ ID NO: 8423 - protein, 232 aa, Eutrema parvulum
MRPSLRFLAGPLLECRRGFCTSSDKIVASVLFERLRVVIPKPDPAVYAFQEFKFNWQQQFRRRYPDEFLDIAKNRAKGEYQMDYVPAPRITEADKKNDRKSLYRALDKKLYLLIFGKPFGATSEKPVWHFPEKVYDSEPTLRKCAESALKSVLGDLTYTYFVGNAPMAHMVIQPTEETPDLPAYKRFFFKCSVVAASKYNINNCEDFVWVTKDELLEFFPEQAEFFNKMIIS

SEQ ID NO: 8424 - protein, 239 aa, Brassica napus
MQRLRSSQLLRRPLLESRRLGGGYCTSSSSEKIVASVLFERLRVVIPKPDPAVYAFQEFKFNWQQQFRRRYPDEFLDIAKNRAKGEYQMDYVPAPRITEADKNNDRKSLYRALDKKLYLLIFGKPFGATSDKPVWHFPEKVYDSEPTLRKCAESALKSVLGDLTHTYFVGNAPMAHMAIQPTEETPDLPSYKRFFFKCSVVAASKYNISNCEDFVWVTKDELLEFFPEQAEFFNKMIIS

SEQ ID NO: 8425 - protein, 233 aa, Eutrema parvulum
MQRLRPRLLLGPLLKSRRGYCTSSDKLVASVLFERLRVVIPKPDPAVYAFQEFKFNWQQQFRRRYPDEFLDIAKNRAKGEYQMDYVPAPRITEADKENDRKSLYRALDRKLYLLVFGKPFGATSDNPVWHFPEKVYDSEPTLRKCAESALKSVLGDLTHTYFVGNAPMAHLAIQPTEETPDLPSYKRFFFKCSVVAASKYNISNCEDFVWVTKDELLEFFPEQAEFFNKMIIS

SEQ ID NO: 8426 - protein, 239 aa, Brassica napus
MQRLRSSQLLRRPLLESRRLGGGYCTSSSSEKIVASVLFERLRVVIPKPDPAVYAFQEFKFNWQQQFRRRYPDEFLDIAKNRAKGEYQMDYVPAPRITEADKTNDRKSLYRALDKKLYLLIFGKPFGATSDKPVWHFPEKVYDSEPTLRKCAESALKSVLGDLTHTYFVGNAPMAHMAIQPTEETPDLPSYKRFFFKCSVVAASKYNISNCEDFVWVTKDELLEFFPEQAEFFNKMIIS

SEQ ID NO: 8427 - protein, 239 aa, Unknown
  Sequence found in Organisms: Brassica napus, Brassica rapa
MQRLRSSQLLRRPLLESRRLGGGYCTSSSSEKIVASVLFERLRVVIPKPDPAVYAFQEFKFNWQQQFRRRYPDEFLDIAKNRAKGEYQMDYVPAPRITEADKNNDRKSLYRALDKKLYLLIFGKPFGATSDKPVWHFPEKVYDSEPTLRKCAESALKSVLGDLTHTYFVGNAPMAHMAIQPTEETPDLPSYKRFFFKCSVVAASKYNIRNCEDFVWVTKDELLEFFPEQAEFFNKMIIS

SEQ ID NO: 8428 - protein, 236 aa, Brassica napus
MQRLRSQLLARPLLESRLRGYCTSSSSEKIVASVLFERLRVVIPKPDPTVYAFQEFKFNWQQQFRRRYPDEFLDIAKNRAKGEYQMDYVPAPRVTEADKNNDKKSLYRALDKKLYLLVFGKPFGATSDKPVWHFPEKVYDSEPTLRKCAESALKSVLGDLTHTYFVGNAPMAHMAIQPTEETPDLPSYKRFFFKCSVVAASKYNISNCEDFVWVTKDELLEFFPEQAEFFNKMIIS

SEQ ID NO: 8429 - protein, 239 aa, Brassica napus
MQRLRSQQLLRRPLWESRRLGGGYCTSSSSEKIVASVLFERLRVVIPKPDPAVYAFQEFKFNWQQQFRRRYPDEFLDIAKNRAKGEYQMDYVPAPRITEADKNNDRKSLYRALDKKLYLLIFGKPFGATSDEPVWHFPEKVYDSEPTLRKCAESALKSVLGDLTHTYFVGNAPMAHMAIQPTEETPDLPSYKRFFFKCSVVAASKYNISNCEDFVWVTKDELLEFLPEQAEFFNKMIIS

SEQ ID NO: 8430 - protein, 239 aa, Brassica napus
MQRLRSQQLLRRPLWESRRLGGGYCTSSSSEKIVASVLFERLRVVIPKPDPAVYAFQEFKFNWQQQFRRRYPDEFLDIAKNRAKGEYQMDYVPAPRITEADKNNDRKSLYRALDKKLYLLIFGKPFGATSDEPVWHFPEKVYDSEPTLRKCAESALKSVLGDLTHTYFVGNAPMAHMAIQPTEETPDLPSYKRFFFKCSVVAASKYNISNCEDFVWVTKDELLEFLPEPAEFFNKMIIS

SEQ ID NO: 8431 - protein, 236 aa, Brassica rapa
  misc_feature (2)..(2): Xaa can be any naturally occurring amino acid
  misc_feature (10)..(10): Xaa can be any naturally occurring amino acid
MXRLRSQLLXRPLLERRLRGYCTSSSSEKIIASVLFERLRVVIPKPDPTVYAFQEFKFNWQQQFRRRYPDEFLDIAKNRAKGEYQMDYVPAPRVTEADKNNDKKSLYRALDKKLYLLVFGKPFGATSDKPVWHFPEKVYDSEPTLRKCAESALKSVLGDLTHTYFVGNAPMAHMAIQPTEETPDLPSYKRFFFKCSVVAASKYNISNCEDFVWVTKDELLEFFPEQAEFFNKMIIS

SEQ ID NO: 8432 - protein, 237 aa, Brassica napus
MQRLRSQLLARPLLEESRLRGYCTSSSSEKMVASVLFERLRVVIPKPDPTVYAFQEFKFNWQQQFRRRYPDEFLDIAKNRAKGEYQMDYVPAPRVTEADKNNDKKSLYRALDKKLYLLIFGKPFGATSDKPVWHFPEKVYDSEPTLRKCAESALKSVLGDLTHTYFVGNAPMAHLAIQPTEETPDLPSYKRFFFKCSVVAASKYNISNCEDFLWVTKDELLEFFPEQADFFNKMIIS

SEQ ID NO: 8433 - protein, 239 aa, Raphanus sativus
MQRLRSQLLARPLLEESSRLRGYCTSSSSSEKIVASVLFERLRVVIPKPDPNVYAFQEFKFNWQQQFRRRYPDEFLDIAKNRAKGEYQMDYVPAPRVTEADKNNDRKSLYRALDKKLYLLVFGKPFGATSDKPVWHFPEKLYDSEPTLRKCAESALKSVLGDLTHTYFVGNAPMAHMAIQPTEQTPDLPSFKRFFFKCSVVAASKYNISNCEDFVWVTKDELLEFFPDQAEFFNKMIIS

SEQ ID NO: 8434 - protein, 262 aa, Raphanus sativus
  misc_feature (17)..(17): Xaa can be any naturally occurring amino acid
  misc_feature (21)..(21): Xaa can be any naturally occurring amino acid
EAGVLSLFLSKSTPFFXRLEXEKMQRMRSCRSLVKPLLEESSRLRGYYCTSSSEKIVASVLFERLRVVIPKPDPAVYAFQEFKFNWQQQFRRRYPDEFLDIAKNRAKGEYQMDYVPAPRITEADKNNDRKSLYRALDKKLYLLIFGKPFGATSDEPVWHFPEKVYDSEPTLRKCAESALKGVLGDLTHTYFVGNAPMAHMAIQPTEETPDLPSYKRFFFKCSVVAASKYNISNCEDFVWVTKDELLEFFPEQADFFNKMIIS

SEQ ID NO: 8435 - protein, 193 aa, Arabidopsis lyrata
MESSEDVENLSRAIEKLLIEKRKREASGDAFIEDDDDQLLLSRLISQLESPKSKEKAGVITKEEEESAPSKGKREGQRQLEESIEELAKDIKKVKKQNTITHVLLSAVIILTLTWQLSEYSMIFMLKDRISHPVRSIGGMLNGMFKGKLRPIKNQLAGTSNSNDQNNHGNGTQIGPQLQVPELLREFGFDDDE

SEQ ID NO: 8436 - protein, 700 aa, Arabidopsis lyrata
MANLPILQFEEKIVETVEKNSVVVIIGETGSGKSTQLSQILHRHGYTKSGVIAITQPRRVAAVSVARRVAQELDVPLGEDVGYAIRFEDRTSTKTRIKYLTDGVLLRESLSNPMLDDYSVIILDEAHERSLNTDILLGLVKRLVRIRASNFKVLITSATLDGEKVSEFFSGCPVLNVPGKLYPVEILYSKERPVSYIESSLKVAIDIHVREPGGDILIFMTGQDDIEKLVSKLEEKVRSLAEGSCMDAIIYPLHGSLPPEMQVRVFSPPPPNCRRFIVATNIAETSLTVDGVVYVIDSGYVKQRQYNPSSGMYSLDVIQISKVQANQRAGRAGRTRPGKCYRLYPLAVYRDDFLDATIPEIQRTSLAGSVLYLKSLDLPDIDILKFDFLDAPSSESLEDALKQLYFIDAIDENGAITRIGRTMSELPLEPSLSRTLIEANENGCLSQALTVVAMLSAETTLLPARSKPSEKKRKHDDDSNLPNGSGFGDHIQLLQIFESWDRTNYDPAWCKENGMQVRGMVFVKDVRRQLCQIMQKISKDRLEVGAHGRKSSSRDDYRKLRKALCVGNANQIAERMLRHNGYRTLSFQSQLVQVHPSSVLSADNDGMLPNYVVYHELISTTRPFMRNVCAVDMSWVAPIKRKIEKLNVRKLSGGPAPSFKKPEEKMELSKNDAETPAVSENVDSRIEAARERFLARKGQK

SEQ ID NO: 8437 - protein, 703 aa, Eutrema halophilum
MANLPILQFEEKIVETVEKNPVVVIIGETGSGKSTQLSQILHRRGYTKSGVIAVTQPRRVAAVSVARRVAQELDVNLGEDVGYAIRFEDRTSSKTRIKYLTDGVLLRESLSNPMLDDYSVIILDEAHERSLNTDILLGLMKRLVRIRSSNFKVLITSATLDGEKVSEFFSGCPVLNVPGKLYPVEILYSKERPGSYIESSLKVAIDIHVREPEGDILIFMTGQDDIEKLVSKLEEKVRSLAEGSCMDAIIYPLHGSLPPEMQVRVFSPPPPNCRRFIVATNIAETSLTVDGVVYVIDSGYVKQRQYNPSSGMYSLDVIQISKVQANQRAGRAGRTRPGKCYRLYPFAVFRDDFLDATVPEIQRTSLAGSVLYLKSLDLPDIDILKFDFLDAPSSESLEDALKQLYLIDAIDGNGAITSIGRTMSELPLEPSLSRTLIEANENGCLSQALTVVAMLSAESNLLPVRSKPNEKKRKHDESNLPDGSGFGDHIQLLQIFECWDRNNYDTEWCKQNGMQVRGMVFVKDVRRQLCQIMQKISKDRLEVGARGRNSSSRDDYRKLRKALCVGNANQVAERMLRHNGYRTLSFKPQLMQVHPSSVLSTDNEGMLPNYVVYHELISTTRPFMRNVCVIEMSWVAPIKRKIEKLNVRKLSGGPANSFKEPEEKTELSKNNNNAETTPPAVSENVESRIEAARERFLARKGQK

SEQ ID NO: 8438 - protein, 704 aa, Brassica napus
MANLPILQFEEKIVETVENNPVVVIIGETGSGKSTQLSQILRRHGYTKSGVIAVTQPRRVAAVSVARRVAQELDVPLGEDVGYAIRFEDRTSSKTRIKYLTDGVLLRESLSNPMLDDYSVIILDEAHERSLNTDILLGLMKRLVRIRSSNFKVLITSATLDGEKVSRFFSGCPVLNVPGKLYPVEILYSKERPGSYIESSLKVAIDIHVREPEGDILIFMTGQDDIEKLVSKLEEKVRSLAEGSCMDAIIYPLHGSLPPEMQVRVFSPPPPNCRRFIVATNIAETSLTVDGVVYVIDSGYVKQRQYNPSSGMYSLDVTQISKVQANQRAGRAGRTRPGKCYRLYPLAVYRDDLLDATIPEIQRTSLAGSVLYLKSLDLPDIDILKFDFLDAPSSESLEDALKQLYLIDAIDENGAITNIGRTMSELPLEPSLSRTLIEANESGCLSQALTVVAMLSAETTLLPGRSKPNENKRKRDEESNLPDGSGFGDHIQLLQIFECWDSKNYDIRWCKENDLQVRGMVFVRDVRRQLCQIMQKISKDRLEVGARGRKSSSREEYRKLRKALCVGNANQVAERMLRHNGFRTLTFKPQLVQVHPASVLSTDQDGMLPNYVVYHELISTTRPFMRNVCSVEMSWVAPIKRKIEKLNVRKLSGGPDNSFKEPEEKKSTESSTNTNNAETPTVSENVESRIEAARERFLARKGQK

SEQ ID NO: 8439 - protein, 702 aa, Eutrema parvulum
MANLPILQFEEKIVETVEKNPVVVIIGETGSGKSTQLSQILDRRGYTKSGVIAVTQPRRVAAVSVARRVAQELDVNLGEDVGYAIRFEDRTSSKTRIKYLTDGVLLRESLSNPMLDDYSVIILDEAHERSLNTDILLGLMKRLVKFRSSNFKVLITSATLDGEKVSEFFSGCPVLNVPGKLYPVEILYSKERPGSYIESSLKVAIDIHVREPEGDILIFMTGQDDIEKLVSKLEEKVRSLAEGSCMDAIIYPLHGSLPPEMQVRVFSPPPPNCRRFIVATNIAETSLTVDGVVYVIDSGYVKQRQYNPASGMYSLDVIQISKVQANQRAGRAGRTRPGKCYRLYPLAVYRDDFLDATIPEIQRTSLAGSVLYLKSLDLPDIDILKFDFLDAPSSESLEDALKQLYLIDAIDENGAITSIGRTMSDLPLEPSLSRTLIEAYENGCLSQALTVVAMLSAETTLLPVRSKPNEKKRKHDESTLPDGSGFGDHIQLLQIFECWDRNNYNTEWCKENGMQMRGMVFVRDVRKQLCQIMQKISKDRLEVGARGRKSSNRDDYRKLRKALCVGNANQVAERMLRHNGFRTLSFKPQLVQVHPSSVLSTDNEGMLPNYVVYHELISTTRPFMRNVCSIEMSWVAPIKRKIQKLNVRKLSGGLDNSFSELEEKKTDLSRNINNVETPAVAENVESRIEAARERFLARKGHK

SEQ ID NO: 8440 - protein, 600 aa, Arabidopsis lyrata
MKYVLVTGGVVSGLGKGVTASSIGVLLKACGLRVTSIKIDPYLNTDAGTMSPFEHGEVFVLDDGGEVDLDLGNYERFLDIKLTRDNNITTGKIYQHVIAKERKGDYLGKTVQVVPHVTDAIQDWIERVAVIPVDGEEGPADVCVIELGGTIGDIESAPFIEALGQFSYRVGPGNFCLVHVSLVPVLNVVGEQKTKPTQHSVKGLRGLGLTPDILACRSTKALEDNVKEKLAQFCHVPLEYIFTLYDVPNIWHIPLLLKDQKAHLVISKVLNLASILNEPSLGEWTSRAELCDNLHVPVRIAVVGKYTGLSDAYLSVLKALLHASVACRKKLVVDWVPACDLEKETEKENPDAYKAAWKLLKGVDGVLVPGGFGDRGVEGKILAAKYARENKIPFLGICLGMQIAVIEFARSVLCLHDANSTEFKPETKHPCIIFMPEGSRTHMGGTMRLGSRKSFFNVKDSKSSKLYGNKSFVDERHRHRYEVNPDMVERLEKAGLSFAAKDETGKRMEIIELPNHPFFIGAQFHPEFKSRPGKASPLFLGLIAASCGELDTVLNPASAHQHLISNGPKNVYVNGTPKKSSNGLADVRYNNGYCNGLYTR

SEQ ID NO: 8441 - protein, 600 aa, Eutrema halophilum
MKYVLVTGGVVSGLGKGVTASSIGVLLKACGLRVTSIKIDPYLNTDAGTMSPFEHGEVFVLDDGGEVDLDLGNYERFLDIKLTRDNNITTGKIYQHVIAKERKGDYLGKTVQVVPHVTDAIQEWIERVAVIPVDGEEGPADVCVIELGGTIGDIESAPFIEALGQFSYRVGPGNFCLVHVSLVPVLNVVGEQKTKPTQHSVRGLRGLGLIPDILACRSTKVLEENVKEKLAQFCHVPLEYIFTLYDVPNIWHIPLLLKEQKAHLAISKVLNLASLVKEPSLDEWISRAELCDNLHVPVRIAVVGKYTGLSDAYLSVLKALLHASVACRKKLVVDWVPACDLEKETEKENPDAYKAAWKLLKGVDGILVPGGFGDRGVEGKILAAKYARENKIPFLGICLGMQVAVIEYARSVLCLHDANSTEFKPDTKHPCIVFMPEGSRTHMGGTMRLGSRKSIFNVKDSKSSKLYGNKNFVDERHRHRYEVNPDMVERLEKAGLSFAAKDETGKRMEIVELPSHPFFIGAQFHPEYKSRPGKASPLFLGLIAASSGELDTVLNPASAHQHLTSNGPKNVFANGTSKKSPNGLADVRYNNGYCNGLYSR

SEQ ID NO: 8442 - protein, 600 aa, Eutrema parvulum
MKYVLVTGGVVSGLGKGVTASSIGVLLKACGLRVTSIKIDPYLNTDAGTMSPFEHGEVFVLDDGGEVDLDLGNYERFLDIKLTRDNNITTGKIYQHVIAKERKGDYLGKTVQVVPHITDAIQEWIERVAAIPVDGEEGPADVCVIELGGTIGDIESAPFIEALGQFSYRVGPGNFCLVHVSLVPVLNVVGEQKTKPTQHSVRGLRGLGLIPDILACRSTKALEENVKEKLAQFCHVSLKNIFTLYDVPNIWHIPLLLKDQKAHLAISKVLNLASIVKEPSLEEWTSRAELCDNLHVPVRIAVVGKYTGLSDAYLSVLKALLHASVTCRKKLVVDWVPACDLEKETEKENPNAYKVAWKLLKGVDGVLVPGGFGDRGVEGKILAAKYAREYRIPFLGICLGMQVAVIEFARSVLCLSDANSTEFKPETTNPCIVFMPEGSRTHMGGTMRLGSRKSIFNVKDSKSAKLYGIKTFVDERHRHRYEVNPDMVERLEKAGLSFAAKDETGKRMEIVELPNHPFFIGAQFHPEYKSRPGKASPLFLGLIAAACGELDTVMNPASVHQHLISNGPKNVFVNGTSKKAPNGLADVRYNNGYCNGLYTR

SEQ ID NO: 8443 - protein, 592 aa, Brassica napus
GVVSGLGKGVTASSIGVLLKACGLRVTSIKIDPYLNTDAGTMSPFEHGEVFVLDDGGEVDLDLGNYERFLDIKLTRDNNITTGKIYQHVIAKERKGDYLGKTVQVVPHITDAIQEWIERVAAIPVDGEEGPADICVIELGGTIGDIESAPFIEALGQFSYRVGTGNFCLVHVSLVPVLNVVGEQKTKPTQHSVRGLRGLGLIPDILACRSTKALEENVKEKLAQFCHVPLESIFTLYDVPNIWHIPLLLKDQKAHLAISKVLNLAGIVKEPSLEEWTSRAELCDNLHVPVRIAVVGKYTGLSDAYLSILKALLHASVACRKKLVVDWVPACDLEKETEKENPNAYKAAWKLLKGVDGVLVPGGFGDRGVEGKILAAKYARENKIPFLGICLGMQVAVIEFARSVLSLLDANSTEFKPDTKHPCIVFMPEGSRTHMGGTMRLGSRKSIFTVKDSKSAKLYGNKSFVDERHRHRYEVNPDMVERLEKAGLSFAAKDETGKRMEIVELPNHPFFIGAQFHPEYKSRPGKASPLFLGLIAASCGELDTVMNPASVHQHLISNCPKSVFVNGTSKKAPNGMADVRYNNGYCNGLHSR

SEQ ID NO: 8444 - protein, 297 aa, Brassica napus
MKYVLVTGGVVSGLGKGVTASSIGVLLKACGLRVTSIKIDPYLNTDAGTMSPFEHGEVFVLDDGGEVDLDLGNYERFLDIKLTRDNNITTGKIYQHVIAKERKGDYLGKTVQVVPHITDAIQEWIERVAAIPVDGEDGPADVCVIELGGTIGDIESAPFIEALGQFSYRVGQGNFCLVHVSLVPVLNVVGEQKTKPTQHSVRGLRGLGLIPDILACRSTKALEENVKEKLAQFCHVPLENIFTLYDVPNIWHIPRLLKDQKAHLVISKVLNLASMLKNLLWRNGLPEPNYVPTYMCR

SEQ ID NO: 8445 - protein, 524 aa, Brassica napus
MKYVLVTGGVVSGLGKGVTASSIGVLLKACGLRVTSIKIDPYLNTDAGTMSPFEHGEVFVLDDGGEVDLDLGNYERFLDIKLTRDNNITTGKIYQHVIAKERKGDYLGKTVQVVPHITDAIQEWIERVAAIPVDGEEGPADICVIELGGTIGDIESAPFIEALGQFSYRVGTGNLCLVHVSLVPVLNVVGEQKTKPTQHSVRGLRGLGLIPDILACRSTKALEENVKEKLSQFCHVPLESIFTLYDVPNIWHIPLLLKDQKAHLAISKVLNLAGIVKEPSLEEWTSRAELCDNLHVPVRIAVVGKYTGLSDAYLSILKALLHASVACRKKLVVDWVPACDLEKETEKENPNAYKAAWKLLKGVDGVLVPGGFGDRGVEGKILAAKYARENKIPFLGICLGMQVAVIEFARSVLSLLDANSTEFKPDTKHPCIVFMPEGSRTHMGGTMRLGSRKSIFTVKDSKSAKLYGKKSFVDERHRHRYEVNPDMVERLEKAGLSFAAKDETGKRMEIVELPNHPFFIGAQF

SEQ ID NO: 8446 - protein, 601 aa, Citrus clementina
MKYVLVTGGVVSGLGKGVTASSIGVLLKACGLRVTCIKIDPYLNTDAGTMSPFEHGEVFVLDDGGEVDLDLGNYERFMDIKLTRDNNITTGKIYQSVIDKERKGDYLGKTVQVVPHITDEIQDWIERVAMIPVDGKEGPADVCVIELGGTIGDIESMPFIEALGQFSYRVGPGNFCLIHVSLVPVLNVVGEQKTKPTQHSVRGLRGQGLTPNILACRSTVALDDNVKGKLSQFCHVPEQNIITLYDVPNIWHIPLLLRDQKAHEAIFKVLNLQGTTKEPLLKEWTSRAEICDGLHEPVRIAMVGKYTGLSDAYLSILKALLHASVDLRKKLVIDWIPACDLEDATEKENPDAYKAAWKLLKGADGILVPGGFGNRGVQGKILAAKYAREHRIPYLGICLGMQVAVIEFARSVLNLRDANSTEFDPNTKNPCVIFMPEGSKTHMGGTMRLGSRRTYFQVKDCKSAKLYGNRTFIDERHRHRYEVNPDMIARLENAGLSFTGKDETSQRMEIVELPNHPYFIGVQFHPEYKSRPGKPSPLFLGLIAAACGQLDTLIQGSGSQGNLSAKLGNGIAMEKVYPKGTTKPAKVLSDGLYSYCNGVQV

SEQ ID NO: 8447 - protein, 526 aa, Arabidopsis lyrata
MASPSSPISLKNPRFFSSSPHKIFKTQPQTLILTTKFKTCSIICASSCTSISSSTTQQKQPKKQTHVSDNKREEDKEEEEEKEVSLREIWREVQGCNNWEGLLDPMNNHLRREIIRYGEFAQACYDSFDFDPHSKYCGSCKYHPSDFFSNLDLHLHKGYTITRYLYATSNINLPNFFQKSKLSSIWSQHANWMGYVAVATDEEEVGRLGRRDIVIAWRGTVTYLEWIYDLKDILCSANFGDDPSIKIELGFHDLYTKKEDSCKFSSFSAREQVLAEVKRLLEYYGTGEEGHEISITVTGHSLGASLALVSAYDIAELNLNHVPENNYKVPITVFSFSGPRVGNLRFKERCDELGVKVLRVVNVHDKVPSVPGIFANEKFQFQKYVEEKTSFPWSYAHVGVELALDHKKSPFLKQTKDLGCAHNLEALLHLVDGYHGKDEEAQKRFCLVTKRDIALVNKSCDFLRSEYHVPPCWRQDENKGMVKSSDGRWVLPDRPQLEPHRQEDIAHHLQQVLGKVNDDNFKPTTT

SEQ ID NO: 8448 - protein, 486 aa, Eutrema halophilum
MHKRKLFNNSTESETESNPCFRQQTRRREGIEVEEEVNLREIWREVQGCNNWEGLLDPMNNHLRREIIRYGEFAQACYDSFDFDPHSKYCGSCKYHPSDFFPNLDLNLHKGYTITRYLYATSNINLPNFFQRSKLSSIWSQHANWMGYVAVATNEEEVARLGRRDIVIAWRGTVTYLEWIYDLKDILCSANFGDDPLIKIELGFHDLYTKKEDSCKFSSFSAREQVLAEVKRLLEYYGTGEEGHEISITVTGHSLGAALALVSAYDIAELNLNHIPEKNYKVPISVFSFSGPRVGNLRFKERCEELGLKVLRVVNVHDKVPSVPGIFTNEKFQFQKYIEETTSFPWSYAHVGVELALDHKKSPFLKQTKDLGCAHNLEALLHLVDGYHGKEEGGEKKFCLVTKRDIALVNKSCDFLRSDYHVPPCWRQDENKGMVKNEDGRWILPDRPRLEPHQPEDITHHLQKVIGKFNDGDPKPTITVKRLGQN

SEQ ID NO: 8449 - protein, 542 aa, Eutrema halophilum
MASPSSPITLKNPIFFTSFPHNIFKTKPKTLILTTKIKTCSIICSTSCTSVNSSTTQQNLKQNQTLVSDNKREEEKALVKEEGKAALEVEEEVNLREIWREVQGCNNWEGLLDPMNNHLRREIIRYGEFAQACYDSFDFDPHSKYCGSCKYHPSDFFPNLDLNLHKGYTITRYLYATSNINLPNFFQRSKLSSIWSQHANWMGYVAVATNEEEVARLGRRDIVIAWRGTVTYLEWIYDLKDILCSANFGDDPLIKIELGFHDLYTKKEDSCKFSSFSAREQVLAEVKRLLEYYGTGEEGHEISITVTGHSLGAALALVSAYDIAELNLNHIPEKNYKVPISVFSFSGPRVGNLRFKERCEELGLKVLRVVNVHDKVPSVPGIFTNEKFQFQKYIEETTSFPWSYAHVGVELALDHKKSPFLKQTKDLGCAHNLEALLHLVDGYHGKEEGGEKKFCLVTKRDIALVNKSCDFLRSDYHVPPCWRQDENKGMVKNEDGRWILPDRPRLEPHQPEDITHHLQKVIGKFNDGDPKPTITVKRLGQN

SEQ ID NO: 8450 - protein, 528 aa, Eutrema parvulum
MASPLSPIALKNPRFFTSSPHNIFNTKPKTLILTTTMKSCCSIVYSSSCTSINSSTTQQKQPLVSDNKRQDDTLVKEEEEPELEEEVTLREIWREVQGCNNWEGLLDPMNEHLRREIIRYGEFAQACYDSFDFDPHSKYCGSCKYHPSDFFSNLDLNLHKGYTITRYLYATSNINLPNFFQRSKLSSIWSQHANWMGYIAVATDEEEVARLGRRDIIIAWRGTVTYLEWIYDLKDILCSANFGNDPLIKIELGFHDLYTKKEDSCKFSSVSAREKVLAEVKRLLEYYGTGEEGHEISITVTGHSLGAALALVSAYDIAEVNLNHIPENNYKVPVSVFSFSGPRVGNLRFKERCEELGVKVLRVINVHDKVPSVPGIFANEKSQFQKYIEDTTSFPWSYAHVGVELALDHKKSPFLKQTKDLGCAHNLEALLHLVDGYHGKGDGKRFCLVSKRDIALVNKSCDFLRSDYHVPPCWRQDENKGMVKNRDGRWVLPDRPRLEPHRPEDIAHHLQKVLGKFNDGDPKPTTTT

SEQ ID NO: 8451 - protein, 327 aa, Arabidopsis lyrata
MSRPLVFFFFLFLVLVVPCLSHGTGGDHDDDEAPHVESSDLKSKSLISVKIACLVIIFVLTFISGVSPYFLKWSQGFLVLGTQFAGGVFLATALMHFLSDADETFRDLLTAEGESELSPAYPFAYMLACAGFMLTMLADSVIAHIYLRTQNDLELQGEDKSNQTSATTETSIGDSILLIVALCFHSVFEGIAIGISETKSDAWRALWTITLHKIFAAIAMGIALLRMIPDRPLFSSITYSFAFAISSPIGVAIGIVIDATTQGSIADWIFAVSMSLACGVFVYVSVNHLLAKGYRPNKKVHVDEPSYKFLAVLFGVVVIAIVMIWDT

SEQ ID NO: 8452 - protein, 331 aa, Eutrema parvulum
MSRPILFLFFLFLVLVVPCLSHGAGGDHDDDEAPPAKSSDLRSRSLISVKIACLVIIFVLTFISGVSPYFLKWSQGFLVLGTQFAGGVFLATALMHFLSDADETFRDLLTAEGESEPSPAYPFAYMLACAGYMLTMFADSVIAHVYSKTQSSSSKDVELQGENKSNQGLASRESSVGDSILLIVALCFHSVFEGIAIGISETKSDAWRALWTITLHKIFAAIAMGIALLRMIPDRPLFSSITYSFSFAISSPIGVAIGIVIDATTQGSVADWIFAVSMSLACGVFMYVSVNHLLAKGYLPNNKVHVDEPRFKFLAVLFGVVVIAIVMIWDT

SEQ ID NO: 8453 - protein, 322 aa, Eutrema halophilum
MSRPLLFFFFLYLVLVVPCLSHGAGGDRDDDEAAPVKSSDLKSRSLISVKIGCLVIIFVLTFISGVSPYFLKWSQGFLVLGTQFAGGVFLATALMHFLSDADETFRDLLTAEGESKPSPAYPFAYMLACAGYMLTMFADSVISHVYSKTQSSSSNDLEVQKSNQSSVGDSILLIVALCFHSVFEGIAIGISETKSDAWRALWTITLHKIFAAIAMGIALLRMIPDRPLFSSITYSFSFAVSSPIGVAIGIVIDATTQGSVADWIFAVSMSLACGVFVYVSVNHLLAKGYLPNKKVHVDEPRFKFLAVLFGVVVIAIVMIWDT

SEQ ID NO: 8454 - protein, 336 aa, Brassica oleracea
  misc_feature (252)..(252): Xaa can be any naturally occurring amino acid
  misc_feature (311)..(311): Xaa can be any naturally occurring amino acid
ITDTHNPTLKFHMSRPLVFFFFFLFLVLVVPCLSHGGGGDHDDDEAPPAKSSDLKSKSLITVKIACLVIIFVLTFISGVSPYFLKWSQGFLVLGTQFAGGVFLATALMHFLSDADETFRDLLTAEGESEPSPAYPFAYMLACTGYMLTMLADSVIAHVYSKTPSKDVELQGEEKPNQGSGIGDSILLIVALCFHSVFEGIAIGISETKADAWRALWTITLHKVFAAIAMGIALLRMIPDRPLLSSIMYSFAXAISSPIGVAIGIVIDATTQGTVADWIFAVSMSFACGVFVYVSVNHLLAKGYLPNQKVNXDEPRFKFLAVLSGVVVIAIVMIWDT

SEQ ID NO: 8455 - protein, 302 aa, Brassica napus
HGGGGDHDDDEAPPAKTSDLKSKSLITVKIACLVIIFVLTFISGVSPYFLKWSQAFLVLGTQFAGGVFLATALMHFLSDADETFRDLLTAEGESEPSPAYPFAYMLACAGYMLTMLADSVIAHVYSKTPSKDVELQGAEKPNQGSGIGDSILLIVALCFHSVFEGIAIGISETKADAWRALWTITLHKVFAAIAMGIALLRMIPDRPLFSSIMYSFAFAISSPIGVAIGIVIDATTQGKVADWIFALSMSLACGVFVYVSVNHLLAKGYLPNKKVNVDEPRFKFLAVLSGVVVIAIVMIWDT

SEQ ID NO: 8456 - protein, 337 aa, Raphanus sativus
GQTHNPYTKQFHMSRRPLVFFFFLFLVLVVPCLSHGGGGDHDDDDAPHAKSTDLKSKSLITVKIACLVIIFVLTFVSGVSPYFLKWSQGFLVLGTQFAGGVFLATALMHFLPDADETFRDLLTKEGESEPSPAYPFAFMLACAGYMLTMLADSVIAHVYSKTPSKDVEELQGEEKPNQGSGIGDSILLIVALCFHSVFEGIAIGISESKADAWRALWTITLHKIFAAIAMGIALLRMIPDRPLFSTIIYSFAFAISSPIGVGIGIVIDATTQGTVADWIFAVSMSLACGVFVYVSVNHLLAKGYIPNKKVNVDQPSFKFLAVLSGVVVIAIVMIWDT

SEQ ID NO: 8457 - protein, 414 aa, Arabidopsis lyrata
MYVTRTLSQFRKYQKTLSEESPEGPFSGVLVITDEEAETEDTFCFGMCTRTKIEKLPLPQDKILSVVHLDSSGNRETSVKKVLFIPALDQPLSSNRYYVVHARGRYKGKVSVCSREIEKGVCCFPDILHDKKPKPLDPRNIYQTVKINRHHDRTFFGKSVAPDGTPPSFLKKKGWELRTSRSLHPRRPREALGLDDELRARLPAFGFPVSTIRSGSVIVGEWYCPFMFVKENCSLSYQMRKSMFYRITLSQYWERIYHCENNDAHNNIDENNDDNEEEVVSVEANVVREANYVKGMEAVKGEKEGHGGFHWYRQVQGPRGPGERRRKRGVSSPVGLSFVVVERMRRVMEEGGWVGGGRKVVRVERDEPIRISRRDWRRFGCYVLVESFGLRRADGVLLVKCVFRHTNRLRCNWE

SEQ ID NO: 8458 - protein, 428 aa, Eutrema halophilum
MYVTRTLSQFRKFQKTLSEESPEGPFSGVLVITDEEAETEDTFCFGICKRTKIEKLPFPQDKILSIVHRDSSGNRETSVKKVLFIPALDQPLSSNRYYVVHARGRHKGKVCVCSREIEKGLCCFPDILHDKKPKPLDPRNIYQTVKINRHHERTFFAKSVAPDGTPPSFLKKKGWELRTSRSLHPRRPREALGLDDELRARLPEFGFPISTIRSGSVIVGEWYCPFMFVKENCSVSHQMRKSMFYRMTLSQYWERIYHCENNNLNETNNNLDENNGENEEEVVRVHTNVVREANYVMGVEAVKGEKEGHGGFYWYRPVQGSRGPNERRRKTRLGSAVGLSFAVVERMRRVMEEGGWVGGGRKVVRVERDEQIRVSRRDFRDMNGNNDRDWRRFGCYVLVESFGLRRADGVLLVKCVFRHTQRLRCKWE

SEQ ID NO: 8459 - protein, 425 aa, Eutrema parvulum
MYVTRTLSQFRKYQKTLSEESPEGPFSGVLVITDEEAETEDTFCFGMCTRTKIEKLPFPQDKILSVVHTDSSGNRETSVKKVLFIPALDQPLSSNRYYVIHARGRHKGKVCVCSREIGKGLCCFPDILHDKKPKPLDPRNIYQTVKINRHHDRTFFAKSVAPEGTPPSFLKKKGWELRTSRSLHPRRPREALGLDDELRARLPKSDFPISTIRSGSVIVGEWYCPFMFVKENRSVSHQMRKSMFYRMTLSQYWERIYHCENSNLNETNNDLDENEEEVVRVDATVMREVNYVMGMEAVKGDKEEHGGFYWYRQVQCSLGPREKRRRKTGSGSAVGLSFAVVERMRRVMEEGGWVGGGRKVVRVERDEQLKDYKRDFRNMNGNNDRDWKRFGCYVLVESFGLRRADGVLLVKCVFRHTQRLICKWE

SEQ ID NO: 8460 - protein, 346 aa, Arabidopsis lyrata
MAVKSKLVSLLFLVATLSSAFAASFSDSDSDSDLLNELVSLRSTSESGVIHLDDHGISKFLTSASTPRPYSLLVFFDATQLHSKNELRLQELRREFGIVSASFLANNNGSEGTKLFFCEIEFSQSQSSFQLFGVNALPHIRLVSPSISNLRDESGQMDQSDYSRLAESMAEFVEQRTKLKVGPIQRPPLLSKPQIGVIVALIVIATPFIIKRVLKGETILHDSRLWLSGAIFIYFFSVAGTMHNIIRKMPMFLQDRNDPNKLVFFYQGSGMQLGAEGFAVGFLYTVVGLLLAFVTNVLVRVKNLTAQRLIMLLALFISFWAVKKVVYLDNWKTGYGIHPYWPSSWR

SEQ ID NO: 8461 - protein, 346 aa, Eutrema parvulum
MAINKRLLSLLFLLAAVSSIVAASFSDSDSDSDLINELVSLRSATESGVIHLDDHGISKFLTSVSTPRPYSILVFFDATQLHSKSELRLQELRREFGIVSASFLANNNGSDATKLFFCEIEFSQSQSSFQLFGVNALPHIRLVSHSISNLRDESGQMDQSDFSRLAESMAEFVEQRTKLTVGPIKRPPFLSKAQISVIIALIVIATPFIIKRILKGETLLHDRRLWLSGAIFIYFFSVAGTMHNIIRKMPMFLQDRNDPNKLVFFYQGSGMQLGAEGFAVGFLYTVVGLLLAFVTNVLVRVRNLNAQRLVMLLALFISFWAVKKVVYLDNWKTGYGIHPYWPSSWR

SEQ ID NO: 8462 - protein, 347 aa, Eutrema halophilum
MAINNNKLLSLLFLLASVSSIVSASFSDPDSDSDLINELVSLRSAAESGVIRLDDHGISKFLTSVSTPRPYSILVFFDATQLHSKSELRLQELRREFGIVSASFLANNNGSQGTKLFFCEIEFSKSQSSFQLFGVNALPHIRLVSPLTSNLRDESGQMDQSDYSRLAESMAEFVEQRTKLTVGPIKRPPLLSKSQISVIVALIVVSSPFIIKRILKGETLLHDRRLWLSGAIFIYFFSVAGTMHNIIRKMPMFLQDRNDPNKLVFFYQGSGMQLGAEGFAVGFLYTVVGLLLAFVTNVLVKVKNLNAQRLVMLFALFVSFWAVKKVVYLDNWKTGYGIHPYWPSSWR

SEQ ID NO: 8463 - protein, 346 aa, Raphanus sativus
MAINRKLVSLLFLLATVSSFASASFSDPDSDSDLVNELVSLRSNSESGVIHLDDNGISKFLISSPTPRPYSILVFFDATQLHSKTELRLQELRREFGLVSATFLANNNGSDLNKLFFCEIEFSRSQASFQRFGVNALPHIRLVSGSTSKLSDESGQMDQSDFSRLAESMAEFVEQRTKLTVGPIQRPPFLSKAQISVIVALIVIATPFVIKRILKGETLLHDRRLWLSGAIFIYFFSVAGTMHNIIRKMPMFLQDRNDPNKLVFFYQGSGMQLGAEGFAVGFLYTVVGLLLAFVTNVLVRVRNLNVQRLVMLVALFVSFWAVKKVVFLDNWKTGYGIHPYWPSSWR

SEQ ID NO: 8464 - protein, 347 aa, Brassica napus
MAINKKLVSLLFLLAAVSSFASASFSDSDSDSDSDLTNELVSLRSNSESGVIHLDDHGISKFLISSPTPRPYSILVFFDATQLHSKTELRLQELRREFGLVSANFLANNNGSDLNKLFFCEIEFSRSQSSFQRFGVNALPHIRLVSGSTSKLSDESGQMDQSDFARLAESMAEFVEQRTKLTVGPIQRPPFLSKAQISVIVAMIVIATPFVIKRILKGETLLHDRRLWLSGAIFIYFFSVAGTMHNIIRKMPMFLQDRNDPNKLVFFYQGSGMQLGAEGFAVGFLYTVVGLLLAFVTNVLVRVRNLNVQRLVMLVALFVSFWAVKKVVYLDNWKTGYGIHPYWPSSW

SEQ ID NO: 8465 - protein, 346 aa, Brassica napus
MAISKELLSLLLLVFYLSSIASSSFSDPDSDSDLTNELVSLRSNSESGVIHLDDHGISKFLISSPTPRPYSILVFFDATQLHSKTELRLQELRREFGLVSATFLANNNGSDLNKLFFCEIEFSRSQSSFQRFGVNALPHIRLVTGSTSKLSDESGQMDQSDFARLAESMAEFVEQRTKLTVGPIQRPPFLSKAQISVIVALIVIATPFVIKRILKGETLLHDHRLWLSGAIFIYFFSVAGTMHNIIRKMPMFLQDRNDPNKLVFFYQGSGMQLGAEGFAVGFLYTVVGLLLAFVTNVLVRVRNLNVQRLVMLVALVVSSWAVKQVVYLDNWKTGYGIHAYWPSSWQ

SEQ ID NO: 8466 - protein, 346 aa, Brassica rapa
MAIDKKLLSLLLLVSSLSSIASASFSDPDSDSDLTNELASLRSNSESGVIHLDDHGISKFLISSPTPRPYSILVFFDATQLHSKTELRLQELRREFGLVSATFLANNNGSDLNKLFFCEIEFSRSQSSFQRFGVNALPHIRLVTASTAKLSDESGQMDQSDFARLAESMAEFVEQRTKLTVGPIQRPPFLSKAQISVIVAMIVIATPFVIKRILRGETLLHDHRLWLSGAIFIYFFSVAGTMHNIIRKMPMFLQDRNDPNKLVFFYQGSGMQLGAEGFAVGFLYTVVGLLLAFVTNVLVRVRNLNVQRLVMLVALVVSSWAVKQVVYLDNWKTGYGIHPYWPSSWQ

SEQ ID NO: 8467 - protein, 346 aa, Brassica napus
MAIDKKLLSLLLLVSSLSSIASASFSDPDSDSDLTNELASLRSNSESGVIHLDDHGISKFLISSPTPRPYSILLFFDATQLHSKTELRLQELRREFGLVSATFLANNNGSDLNKLFFCEIEFSRSQSSFQRFGVNALPHIRLVTGSTAKLSDESGQMDQSDFARLAESMAEFVEQRTKLTVGPIQRPPFLSKAQISVIVAMIVIATPFVIKRILRGETLLHDHRLWLSGAIFIYFFSVAGTMHNIIRKMPMFLQDRNDPNKLVFFYQGSGMQLGAEGFAVGFLYTVVGLLLAFVTNVLVRVRNLNVQRLVMLVALVVSSWAVKQVVYLDNWKTGYGIHPYWPSSWQ

SEQ ID NO: 8468 - protein, 346 aa, Brassica napus
MAISKELLSLLLLVFYLSSIASSSFSDPDSDSDLTNELVSLRSNSESGVIHLDDHGISKFLISSPTPRPYSILVFFDATQLHSKTELRLQELRREFGLVSATFLANNNGSDLNKLFFCEIEFSRSQSSFQRFGVNALPHIRLVTGSTSKLSDESGQMDQSDFARLAESMAEFVEQRTKLTVGPIQRPPFLSKAQINVIVAMFVIATPFVIKRILKGETLLHDHRLWLSGAIFIYFFSVAGTMHNIIRKMPMFLQDRNDPNKLVFFYQGSGMQLGAEGFAVGFLYTVVGLLLAFVTNVLVRVRNLNVQRLVMLVALVVSSWAVKQVVYLDNWKTGYSIHPYWPSSWQ

SEQ ID NO: 8469 - protein, 346 aa, Brassica napus
MAIDKKLLSLLLLVSSLSSIASASFSDPDSDSDLTNELASLRSNSESGVIHLDDHGISKFLISSPAPRPYSILVFFDATQLHSKTELRLQELRREFGLVSATFLANNNGSDLNKLFFCEIEFSRSQSSFQRFGVNALPHIRLVTASTAKLSDESGQMDQSDFARLAESMAEFVEQRTKLTVGPIQRPPFLSKAQISVIVAMIVIATPFVIKRILRGETLLHDHRLWLSGAIFIYFFSVAGTMHNIIRKMPMFLQDRNDPNKLVFFYQGSGMQLGAEGFAVGFLYTVVGLLLAFVTNVLVRVRNLNVQRLVMLVALVVSSWAVKQVVYLDNWKTGYGIHPYWPSSWQ

SEQ ID NO: 8470 - protein, 348 aa, Raphanus sativus
  misc_feature (21)..(21): Xaa can be any naturally occurring amino acid
MAINKKLLSLILLVSSLSSIXSSSSFSDPDSDSDLTNELVSLRSNSESGVIHLDDHGISKFLISSPTPRPYSILVFFDATQLHSKTELRLQELRREFHLLSATFLAANNNGSDLNKLFFCEIEFSQSQSSFKRFNVNALPHIRLVTASTSKLTDESGQMDQSDFSRLAESMAEFVEQRTKLTVGPIQRPPLLSKPQISVIVAMIVVATPFVIKRILRGETLLHDHRLWLSGAIFVYFFSVAGTMHNIIRKMPMFLQDRNDPNKLVFFYQGSGMQLGAEGFAVGFLYTVVGLLLAFVTNVLVRVGNVNVQRLVMLVALVVSSWAVKQVVYLDNWKTGYGIHPYWPSSWQ

SEQ ID NO: 8471 - protein, 696 aa, Arabidopsis lyrata
MTLHRSLVFFFLFLSCFSLSSWALPLCSDSRAPSEVNSTLSFCPYKGKTCCNSMEDSSLMKQFQAMNISDKGCASVVKSILCAKCDPFSSDLFRDNSDQQSVPILCNSTSSANSTEDFCSETWETCQNVSISGSLFAASLQGRAGAPANNNASKLADVWQSKTDFCSAFGGASSNETVCFSGEPVALTDNDTTPDKPPSGLCLEKIGNGSYLNMVPHPDGSNRAFFSTQPGIVFLAGIPDQDSGGVLDVDPSSPFVDLTDEIHFDTEFGMMGMAFHPKFAQNGRYFASFNCDKSKWPGCTGRCSCNSDVNCDPSKLTPDSGSQPCQFQTVIAEYTANGTSSDPSKAKNAKPTEVRRIFTMGLPFTSHHAGQILFGPDGYLYFMMGDGGGGADPYNFSQNKKSLLGKIMRLDVDNIPSASEISKMGLWGNYSIPKDNPFREDKELEPEIWAIGLRNPWRCSFDSSRPSYFMCADVGQDTYEEVDLITKGGNYGWRVYEGPDLFQPEASPGGNTSIKSLNPIFPVMGYNHSEVDSSGKSASITGGYFYRSETDPCIAGMYVYADLYGNGVWAGIETPANSGNFVTNRTTFSCAGDSPMKCSDSPGTSGLSLGYVFSFGEDNNKDIYLLTSNGVYRVVRPSRCNLTCSKENSTAARRKPGPSSSPSSSPSSCYKHINGFHGSFVVLFVSLSLILLGLLN

SEQ ID NO: 8472 - protein, 695 aa, Eutrema halophilum
MTLHRSLVFFFLFLSCFALSSWALPLCSDSRAPLEVNSTLSFCPYKGKTCCDTMEDSNLNKQFQAMNISDKGCASIVKSILCAKCDPFSSDLFRDNSDQQSVPILCNSTSSANSTKDFCSETWETCQNVSISGSLFAASLQGRVGAPANNNASKLADLWQSKTDFCSSFGGASSNETVCFSGEPVTLNDTTPDKPPPGLCLEKIGNGSYLNMVPHPDGSNRAFFSTQPGIVFLAGLPDQDSGGVLDVDPSSPFVDLTDEVHFDTEFGMMGMAFHPKFAQNGRFFASFNCDKSKWPGCTGRCSCNSDVNCDPSKLTPDSGSQPCQFQTVIAEYTTNGTSSDPSKAKNAKPTEVRRIFTMGLPFTSHHAGQILFGPSDGYLYFMMGDGGGGADPYNFAQNKKSLLGKIMRLDVDNIPSASEISKMGLWGNYSIPKDNPFREDKELEPEIWAVGLRNPWRCSFDSSRPSYFMCADVGQDTYEEVDLITKGGNYGWRVYEGPDLFHPESSPGGKTSAKSVNSIFPVMGYNHSEVDSSGKSASITGGYFYRSETDPCIAGMYLYADLYGNGVWAGIETPANSGNFVSNRTTFSCAGDSPMKCSDSPGSTGLTLGYIFSFGEDNNKDIYLLTSNGVYRVVRPSRCNLTCSKENTTAARRNPSPSSSPSSSASSCYRHMNGFHGSSVVLLVSLSLILLVLLV

SEQ ID NO: 8473 - protein, 695 aa, Eutrema parvulum
MTLHRSLLFFFLFLSCFGLSSWALPLCSDSRAPLELNSTLSFCPYKGKTCCDTKEDSNLNKQFQAMNISDKGCASVVKSILCAKCDPFSSDLFRDNSDEQSVPILCNSTDSVNSTKNFCSETWDTCQNVSISGSLFAPSLLGRAGAPTNTNASKLADLWQSKTDFCSAFGGASSNETICFSGQPVTLSDTTPDKPPPGLCLEKIGNGSYLNMVPHPDGSNRAFFSTQPGIVFLAGIPDQDSGGVLDVDPSSAFVDLTDEVHFDTEFGMMGMAFHPKFAQNGRFFASFNCDKSKWSGCTGRCSCNSDVNCDPSKLTPDSGSQPCQFQTVIAEYSTNGTSSDPSKAKNAKPTEVRRIFTMGLPFTSHHAGQILFGPSDGYLYFMMGDGGGGADPYNFSQNKKSLLGKIMRLDVDNIPSDSEISKMGLWGNYSVPKDNPFREDKELEPEIWAVGLRNPWRCSFDSSRPSYFMCADVGQDTYEEVDLITKGGNYGWRVYEGLDLFHPESSPGGNTSAKSLNPIFPVMGYNHSEVDSSGKSASITGGYFYRSETDPCVAGMYLYADLYGNGVWAGIETPASSGNFVSNRITFSCAGDSPMKCSDSPGTSGLSLGYIFSFGEDNNKDIYLLTSNGVYRVVRPSRCNLTCSKENSTAARRSPSPSISPSSSSSSCYRHMNCFHGSLVVSLVSLSLILLALLV

SEQ ID NO: 8474 - protein, 689 aa, Brassica napus
MILHRSLVIFFLCILCSTLSSLALPLCSDSRAPLEGNSTLSFCPYKGKTCCDTKEDSNLNKQFQSMNISDKACASVVKSILCSRCDPFSSELFRDHSDQLSVPILCSNTSSANSTKDFCSETWETCQNISITGSLFAPSLQGQAGAPVNTNVSKLSDLWQSKTDFCSAFASSNETICFSGEPVTLNDTTPEKPPPGLCLEKIGNGSYLNMVPHPDGSNRAFFSTQPGVVFLAGLQDQDSGGVLDVDPSSPFVDLTDEVHFDTSFGMMGMAFHPKFAQNGRFFASFNCDKSKWPGCTGRCSCNSDVNCDPSKITPDSGSQPCQFQTVIAEYSANGTSSDPSKAKNAKPTEVRRIFTMGLPFTSHHAGQILFGPSDGYLYFMMGDGGGGADPYNFSQNKKSLLGKIMRLDVDNIPSASDISKRGLWGNYSIPKDNPFREDKELEPEIWAVGLRNPWRCSFDSSRPSYFMCADVGQDTYEEVDLITKGGNYGWRVYEGPELFQPESSPGGNTSAKSINTIFPVMGYNHSEVDSSGKSASITGGYFYRSETDPCIDGMYLYADLYGNGVWAGIETPANSGNFVSHRITFSCASDSPMKCDDSPGTSGLSLGYIFSFGEDNNKDIYLLTSNGVYRVVRPSRCNLTCSKENSTVARRNPGPSVSPSSSSSSCYMHMNGFHGILVSLSLILLALLV

SEQ ID NO: 8475 - protein, 339 aa, Arabidopsis lyrata
MSMLMAVKTTSLCCSSLNLRASPTFRRNPRAARLMNPTARIQTRIHRLIEEQGIVLMPGCYDALSAAIVQQTGFSAGFISGYALSASLLGKPDFGLLTPPEMAATARSVCASAPNIPIIADADTGGGNALNVQRTVKDLIAAGASGCFLEDQAWPKKCGHMRGKQVIPAEEHAAKIASARDAIGDSEFFLVARTDVRATSAKSGLEDAIARVNLYMEAGADASFVEAPRDDDELKEIGKRTKGYRVCNMIEGGVTPLHTPVELKEMGFHLIVHPLTALYASTRALVDVLKTLKENGSTRDHLQKMATFEEFNSLVDLDSWFELEARYSNLRNALGTTKS

SEQ ID NO: 8476 - protein, 338 aa, Eutrema halophilum
MSMLMALKTTSLCSTLNLTPSPRIQTNPRAARSVNPTARIQTRIHRLIEDQGIVLMPGCYDALSAAIVQQTGFSAGFISGYALSASLLGKPDFGLLTPPEMAATARSVCASAPNIPIIADADTGGGNALNVQRTVKDLIAAGAAGCFLEDQAWPKKCGHMRGKQVISAEEHAAKIASARDAIGDSDFFLVARTDVRATSAKSGLEDAIARVNLYMEAGADASFVEAPRDDDELKEIGKRTKGYRVCNMIEGGVTPLHTPEELKEMGFHLIVHPLTALYASTRALVDVLKTLKENGSTRDHLEKMATFEEFNTLVDLESWFELEARYSNLRNALGTTKS

SEQ ID NO: 8477 - protein, 340 aa, Eutrema parvulum
MSMLMAVKTTSLCSTLNLTASPGIRSTNPRAARSVNPTARVQTRIHRVIEEQGIILMPGCYDALSAAIVQQTGFSAGFISGYALSASLLGKPDFGLLTPPEMAATARSVCASAPNIPIIADADTGGGNALNVQRTVKDLIAAGAAGCFLEDQAWPKKCGHMRGKQVISAEEHAAKIASARDAIGDSDFFLVARTDTRATSAKSGLEDAIARVNLYMEAGADASFVEAPRDDDELKEIGKRTKGFRVCNMIEGGVTPLHTPEELKEMGFHLIVHPLTALYASARALVDVLKTLKENGTTRDHLQKMATFEEFNSLVDLESWFELEARYSNLRNALGTTTKS

SEQ ID NO: 8478 - protein, 340 aa, Eutrema halophilum
MSMLMAAKTTSLCSTLNLTASPRIRTTNPRAARSVNPTARIQTRIHRLIEDQGIILMPGCYDALSAAIVQQTGFSAGFISGYALSASLLGKPDFGLLTPPEMAATARSVCASAPNIPIIADADTGGGNALNVQRTIKDLIAAGAAGCFLEDQAWPKKCGHMRGKQVISAEEHAAKIASARDAIGDSDFFLVARTDARATSAKSGLEDAIARVNLYMEAGADASFVEAPRDDDELKEIGKRTKGFRVCNMIEGGVTPLHTPEELKEMGFHLIVHPLTALYASTRALVDVLKTLKEKGTTRDHLQKMATFEEFNSLVDLESWFELEARYSNLRNALGTTTKS

SEQ ID NO: 8479 - protein, 340 aa, Brassica napus
MSMLMAVKPTSLCNTLNLTASPRFPRTNPRAARLVNPTARIQTRIHRLIQDQGIILMPGCYDALSAAIVQQTGFSAGFISGYALSASLLGKPDFGLLTPPEMAATARSVCASAPNIPIIADADTGGGNALNVQRTVKDLIAAGAAGCFLEDQAWPKKCGHMRGKQVISAEEHAAKIASARDAIGDSDFFLVARTDARATSAKSGLEDAIARVNLYMEAGADASFVEAPRDDEELKEIGKRTKGFRVCNMIEGGVTPLHTPEELKEMGFHLIVHPLTALYASARALVDVLKTLKENGTTRGHLEKMATFEEFNSLVDLESWFELEARYSNLRNALGTTTKS

SEQ ID NO: 8480 - protein, 340 aa, Brassica rapa
MSMLMAVKPTSLCNTLNLTASPRSPRTNPRAARLVNPTARIQTRIHRLIQDQGIILMPGCYDALSAAIVQQTGFSAGFISGYALSASLLGKPDFGLLTPPEMAATARSVCASAPYIPIIADADTGGGNALNVQRTVKDLIAAGAAGCFLEDQAWPKKCGHMRGKQVISAEEHAAKIASARDAIGDSDFFLVARTDARATSAKSGLEDAIARVNLYMEAGADASFVEAPRDDDELKEIGKRTKGFRVCNMIEGGVTPLHTPEELKEMGFHLIVHPLTALYASARALVDVLKTLKENGTTRGHLEKMATFEEFNSLVDLESWFELEARYSNLRNALGTTTKS

SEQ ID NO: 8481 - protein, 340 aa, Brassica napus
MSLLMAVKPTSLCNTLNLTASPRSPRTNPRAARLVNPTARIQTRIHRLIQEQGSILMPGCYDALSAAIVQQTGFSAGFISGYALSASLLGKPDFGLLTPPEMAATARSVCASAPNIPIIADADTGGGNALNVQRTVKDLIAAGAAGCFLEDQAWPKKCGHMRGKQVISAEEHAAKIASARDAIGDSDFFLVARTDARATSAKSGLEDAIARVNLYMEAGADASFVEAPRDDDELKEIGKRTKGFRVCNMIEGGVTPLHTPEELKEMGFHLIVHPLTALYASARALVDVLKTLKENGTTRGHLEKMATFEEFNSLVDLESWFELEARYSNLRNALGTTTKS

SEQ ID NO: 8482 - protein, 344 aa, Raphanus sativus
MSMMLTAVKTPSLCNNTLNLTASPRFPQRANPPRAARSVNPTARIQTRIHRLIQDQGIILMPGCYDALSAAIVQQTGFSAGFISGYALSASLLGKPDFGLLTPPEMAATARSVCASAPNIPIIADADTGGGNALNVQRTVKDLIAAGAAGCFLEDQAWPKKCGHMRGKQVISAEEHAAKIASARDAIGDSDFFLVARTDARATSAKSGLEDAIARVNLYMEAGADASFVEAPRDDDELKEIGKRTKGFRVCNMIEGGVTPLHTPEELKEMGFHLIVHPLTALYASARALVDALKTLKENGTTRGHLEKMATFEEFNSLVDLESWFELEARYSNLRNALGTTTKS

SEQ ID NO: 8483 - protein, 337 aa, Eutrema halophilum
MSMLMAVKSTSLCNSNTSVSARIRQNPRAVRSVYPTVRMQSRVHRLIEEQGAVLIPGVYDALSAAIVQQTGFSAALISGYALSASILGKPDFGLITPPEMAAAARSVCAAAPNIPIIADADTGGGNALNVQRTVKDLIAAGAAGCFLEDQAWPKRCGHMRGKEVIPAEEHAAKIASARDAIGDSDFFLIARTDARALSAKTGLSDAIDRANLYMEAGADASFVEAPRDDDELKEIGKRTKGYRLCNMLEGGRTPLHTPDELKEMGFHLIAHPLTSLYASTRALVDVLKILKEKGTTKDHLEKMITFEEFNRLVNLDSWYELETKYSNLRNALGTTKS

SEQ ID NO: 8484 - protein, 336 aa, Arabidopsis lyrata
MSMLMAAKSTSLYSSNPTISARIGQNPRAVRSVYPTVRMQSRVHRLIEEQGAVLIPGVYDALSAAIVQQTGFSAALISGYALSAVTLGKPDFGLITPPEMAATARSVCAAAPTIPIIADADTGGGNALNVQRTVKDLIAAGAAGCFLEDQAWPKRCGHMRGKEVIPAEEHAAKIASARDAIGDADFFLIARTDARALSAKTGLSDAIDRANLYMEAGADASFVEAPRDDDELKEIGRRTKGYRLCNMLEGGRTPLHTPDELKEMGFHLIAHPLTSLYASTRALVDVLKILKDKGTTKDHLEKMITFEEFNSLLDLDSWYELETKYSNLRNALGTTK

SEQ ID NO: 8485 - protein, 337 aa, Eutrema parvulum
MSMLMAAKSTSLYNSNPSISARIQQNTRAVRWAYPTVRMQSRVHRLIEEQGAVLIPGVYDALSAAIVQQTGFSAALISGYALSASILGKPDFGLITPPEMAAAARSVCAAAPNIPIIADADTGGGNALNVQRTVKDLIAAGAAGCFLEDQAWPKRCGHMRGKEVIPAEEHAAKIASARDAIGNSDFFLIARTDARALSAKTGLSDAIDRANLYVEAGADASFVEAPRDDDELKEIGKRTKGYRLCNMLEGGHTPLHTPDELKEMGFHLIAHPLTSLYASTRALVDVLKILKEKGTTKDHLEKMITFEEFNRLVNLDSWYELETKYSNLRNALGTTKP

SEQ ID NO: 8486 - protein, 336 aa, Unknown
  Sequence found in Organisms: Arabidopsis thaliana, Arabidopsis lyrata
MSMLMAAKSTSLFSSNPTISAKIGQNPRGVRSVYPTVRMQSRVHRLIEEQGAVLIPGVYDALSAAIVQQTGFSAALISGYALSAVTLGKPDFGLITPPEMAATARSVCAAAPKIPIIADADTGGGNALNVQRTVKDLIAAGAAGCFLEDQAWPKRCGHMRGKEVIPAEEHAAKIASARDAIGDADFFLIARTDARALSAKTGLSDAIDRANLYMEAGADASFVEAPRDDDELKEIGRRTKGYRLCNMLEGGRTPLHTPDELKEMGFHLIAHPLTSLYASTRALVDVLKILKEKGTTKDHLEKMITFEEFNRLVNLDSWYELETKYSNLRNALGETK

SEQ ID NO: 8487 - protein, 364 aa, Theobroma cacao
MPYKPHIQNPTKTLYNFPTHQIFQLLTWKMSTITMMAAKAPSLPQLNLKASTFRSRKTKSSHPTVRMQTRIHRLIEDQGIVLMPGCYDALSAAIVQQSGFTAGFISGYALSASLLGKPDLGLLTPPEMAATARTVCAAAPVIPMIADADTGGGNALNVQRTIKDLIAAGAAGCFLEDQAWPKKCGHMHGKQVIPAEEHAAKIASARDAIGDSDFFLVARTDARATSAKTGLSDAISRANLYMEAGADACFVEAPRNDDELKEIGRQTKGYRVCNMIEGGVTPLHTPEELQAMGFHLIVHSLTTVYASARALVDVLKILKENGTTRDHLQKMATFEEFNQLVKLESWFELEARYSKLKSAVGVKS

SEQ ID NO: 8488 - protein, 352 aa, Gossypium hirsutum
LPASKMSTMTTIMLMPPKATSLQHSNFKPSTLRSRSSPTKSSYPTVRMQTRFHRLIEDQGIVLMPGCYDALSAAIVQQSGFTAGFISGYALSASLLGKPDFGLLTPPEMAATARTVCAAAPMIPIIADADTGGGNALNVQRTVRDLIAAGAAGCFLEDQAWPKKCGHMRGKQVIPAEEHAAKIASARDAIGDSDFFLVARTDARATSAKTGLSDAIARANLYMEAGADACFVEAPRNDDELKEIGRHTKGYRVCNMIEGGVTPLHTPEELRAMGFHLIVHPLTALYASARALVDVLKNLKENGTTRDHLHKMATFEEFNQLVKLDSWFELEALYSNQKSPMRVNHDNEGRNM

SEQ ID NO: 8489 - protein, 336 aa, Brassica napus
MSMLMAAKSTSLCYSNPSISSRTKQNPRAVRYAYPTVRMQSRVHRLIEEQGAVLIPGVYDALSAAIVQQTGFSAALISGYALSASILGKPDFGLITPPEMAAAARSVCSAAPGIPILADADTGGGNALNVQRTVKDLIAAGAAGCFLEDQAWPKRCGHMRGKEVIPAEEHAAKIASARDAIGDSDFFLIARTDARALSAKTGLSEAIDRANLYMEAGADASFVEAPRDDDELKEIGKRTKGYRVCNMLEGGRTPLHTPDELKEMGFHLIAHPLTSLYASTRALVDVLKILKEKGTTKDHLAKMITFEEFNRLVNLGEWYELETKYSNLRNALGTNN

SEQ ID NO: 8490 - protein, 336 aa, Brassica napus
MSMLMAAKSTSLCYSNPSISSRTKQNPRVVRYAYPTVRMQSRVHRLIEEQGAVLVPGVYDALSAAIVQQTGFSAALISGYALSASILGKPDFGLITPPEMAAAARSVCSAAPGIPILADADTGGGNALNVQRTVKDLIAAGAAGCFLEDQAWPKRCGHMRGKEVIPAEEHAAKIASARDAIGDSDFFLIARTDARALSAKTGLSDAIDRANLYMEAGADASFVEAPRDDDELKEIGKRTKGYRLCNMLEGGRTPLHTPDELKEMGFHLIAHPLTSLYASTRALVDVLKILKEKGTTKDHLEKMITFEEFNRLVNLGEWYELETKYSNLRNALGTHN

SEQ ID NO: 8491 - protein, 286 aa, Brassica napus
ILMPGCYDALSAAIVQQTGFSAGFISGYALSASLLGKPDFGLLTPPEMAATARSVCASAPNIPIIADADTGGGNALNVQRTVKDLIAAGAAGCFLEDQAWPKKCGHMRGKQVISAEEHAAKIASARDAIGDSDFFLVARTDARATSAKSGLEDAIARVNLYMEAGADASFVEAPRDDDELKEIGKRTKGFRVCNMIEGGVTPLHTPEELKEMGFHLIVHPLTALYASARALVDVLKTLKENGTTRGHLEKMATFEEFNSLVDLESWFELEARYSNLRNALGTTTKS

SEQ ID NO: 8492 - protein, 223 aa, Brassica rapa
  misc_feature (12)..(12): Xaa can be any naturally occurring amino acid
  misc_feature (205)..(205): Xaa can be any naturally occurring amino acid
MSMLMAAKSTSXCYSNPSISSRTKQNPRAVRYAYPTVRMQSRVHRLIEEQGAVLIPGVYDALSAAIVQQTGFSAALISGYALSASILGKPDFGLITPPEMAAAARSVCSAAPGIPILADADTGGGNALNVQRTVKDLIAAGAAGCFLEDQAWPKRCGHMRGKEVIPAEEHAAKIASARDAIGDSDFFLIARTDARALSAKTGLSXAIDRANLYMEAGADASLR

SEQ ID NO: 8493 - protein, 337 aa, Raphanus sativus
  misc_feature (289)..(289): Xaa can be any naturally occurring amino acid
  misc_feature (318)..(318): Xaa can be any naturally occurring amino acid
  misc_feature (329)..(330): Xaa can be any naturally occurring amino acid
MSMLMAAKSTSLCYSNHSISSRTKQNPRAVVIRAYPTVRMQSRVHRLIEEQGAVLVPGVYDALSAAIVQQTGFSAALISGYALSASILGKPDFGLITPPEMAAAARSVCAAAPGIPILADADTGGGNALNVQRTVKDLIAAGAAGCFLEDQAWPKRCGHMRGKEVIPAEEHAAKIASARDAIGDSDFFLIARTDARALSAKTGLSDAIDRANLYMEAGADASFVEAPRDDDELKEIGKRTKGYRLCNMLEGGRTPLHTPDELKEMGFHLIAHPLTSLYASTRALVDVLXILKDKGTTKDHLEKMITFEEFNRLVNLGXWYELETKYSNXXNALGTHN

SEQ ID NO: 8494 - protein, 307 aa, Arabidopsis lyrata
MGDNNPNRPEAERLLGIAEKLLESRDLNGSKEFAILAQETEPLLEGTDQILAVVDVLLSSSSENRIKNKPNWYKILQIEDPNESSTDNDLIKKQYRRLALLLHPDKNRFPFADQAFRFVLDAWEVLSTPSKKSQFDRDLNLIFTKVDLNTQKSKKKTTTNEKMATFWTACPYCYSLHEYPRVYQEYCIRCQNCQRAFHAAIIPQLPPLVPGKDEYYCCWGFFPMGFVGGKGGEAAIANGVDAAKFPNWMPPLFSSGGVAAPPSVNGGGYGVSFDGWSGGAAKRDNVGVNLDGTPKKRGRGRPKKNPV

SEQ ID NO: 8495 - protein, 159 aa, Arabidopsis lyrata
MRADNDHALGNSVEICKDESKPHQCLEENWEDAELKVPENGKNNNNVCELFYDTRSGDEWDANEAGKKVRDISHDCDANVDSPDKKDPVFYMDKNVTACDLPEIVVCYKENTYHVVKDICVDEGVPVQEKFLFGEKDSVKSSSKGFDESRQNKCESFRK

SEQ ID NO: 8496 - protein, 141 aa, Arabidopsis thaliana [sequence omitted]

SEQ ID NO: 8497 - protein, 141 aa, Arabidopsis thaliana
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDEIKVDKETLEMLASLGMSDTLGISAVDPQQAMAPIPAFGGGRAPRRY

SEQ ID NO: 8498 - protein, 138 aa, Arabidopsis lyrata
MGRVRTKTVKKSSRQVIEKYYSRMTLDFHTNKKILEEVAIIPSKRLRNKIAGFSTHLMKRIQKGPVRGISLKLQEEERERRMDFVPDESAIRTDEIKVDKETLEMLASLGMSDTPGISAVEPQTMAPIPAFGRAPRRY

SEQ ID NO: 8499 - protein, 137 aa, Eutrema parvulum
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDEIKVDKETLEMLASLGMSDIPGFSEVEPQAMAPAAFGRPPRRF

SEQ ID NO: 8500 - protein, 136 aa, Unknown
  Sequence found in Organisms: Brassica napus, Brassica rapa
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDEIKVDKETLEMLASLGMSDVPGVSVVEPQAVAPAFGRPPRRY

SEQ ID NO: 8501 - protein, 138 aa, Arabidopsis lyrata
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDDVKVDKETLEMLASLGMSDTRGISQVETQQAMAPAVFGRPARRY

SEQ ID NO: 8502 - protein, 136 aa, Brassica juncea
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDEIKVDKETLEMLASLGMSDVPGVSVVEPLAAAPAFGRPPRRY

SEQ ID NO: 8503 - protein, 136 aa, Brassica oleracea
  misc_feature (68)..(68): Xaa can be any naturally occurring amino acid
MGRVRTKTVKKSSRQVIEKYYSRMTLDFHTNKKILEEVAIIPSKRLRNKIAGFSTHLMKRIQKGPVRXISLKLQEEERERRMDFVPDESAIKTDEIKVDKETLEMLASLGMSDVPGVSVVEPQAVAPAFGRPPRRY

SEQ ID NO: 8504 - protein, 135 aa, Brassica napus
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDVIKVDKETLEMLASLGMSDTSGISEVEPQAAPAFSRPPRRF

SEQ ID NO: 8505 - protein, 135 aa, Brassica juncea
GRVRTKTVKKSSRQVIEKYYSRMTLDFHTNKKILEEVAIIPSKRLRNKIAGFSTHLMKRIQKGPVRGISLKLQEEERERRMDFVPDESAIKTDEIKVDKETLEMLASLGMSDVPGVSVVEPQTVAPAFGRPPRRY

SEQ ID NO: 8506 - protein, 135 aa, Unknown
  Sequence found in Organisms: Brassica napus, Brassica oleracea
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDVIKVDKETLEMLASLGMSDTSGISEVEPQAAPSFSRPPRRF

SEQ ID NO: 8507 - protein, 135 aa, Unknown
  Sequence found in Organisms: Brassica napus, Brassica rapa
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDVIKVDKETLEMLASLGMSDTSGISEVEPQAAPTFSRPPRRF

SEQ ID NO: 8508 - protein, 138 aa, Cleome gynandra
MGRVRTKTVKKSSRQVIEKYYSKMTLDFHTNKKILEEVAIIPSKRLRNKIAGFSTHLMKRIQKGPVRGISLKLQEEERERRMDFVPDESAIKTDEIKVDKETLEMLASLGMSDIPGLSEVEPQAMAPSNVFGRPGRRY

SEQ ID NO: 8509 - protein, 138 aa, Cleome gynandra
MGRVRTKTVKKSSRQVIEKYYSKMTLDFHTNKKILEEVAIIPSKRLRNKIAGFSTHLMKRIQKGPVRGISLKLQEEERERRMDFVPDESAIKTDEIKVDKETLEMLASLGMSDLPGLSEVEPQAMAPSNVFGRPGRRY

SEQ ID NO: 8510 - protein, 138 aa, Cleome spinosa
MGRVRTKTVKKSSRQVIEKYYSKMTLDFHTNKKILEEVAIIPSKRLRNKIAGFSTHLMKRIQKGPVRGISLKLQEEERERRMDFVPDESAIKTDEIKVDKETLEMLASLGMSDIPGLSEVEPQAMAPTNLFGRPGRRY

SEQ ID NO: 8511 - protein, 137 aa, Raphanus sativus
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDEIKVDKETLEMLASLGMSDVAGVSVVEPLAVAPAFGGRPQRRF

SEQ ID NO: 8512 - protein, 138 aa, Unknown
  Sequence found in Organisms: Thellungiella halophila, Eutrema halophilum
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDEIKVDKETLQMLASLGMSDIPGFSVVEPQAMAPGNVFGRPGRRF

SEQ ID NO: 8513 - protein, 134 aa, Brassica juncea
GRVRTKTVKKSSRQVIEKYYSRMTLDFHTNKKILEEVAIIPSKRLRNKIAGFSTHLMKRIQKGPVRGISLKLQEEERERRMDFVPDESAIKTDVIKVDKETLEMLASLGMSDTSGISEVEPQAAPTFSRPPRRF

SEQ ID NO: 8514 - protein, 138 aa, Cleome spinosa
MGRVRTKTVKKSSRQVIEKYYSRMTLDFHTNKKILEEVAIIPTKRLRNKIAGFSTHLMQRIQKGPVRGISLKLQEEERERRMDFVPDESAIKTDEIKVDKETLEMLASLGMSDLPGLSEVEPQAMAPSNLFGRPGRRY

SEQ ID NO: 8515 - protein, 138 aa, Cleome spinosa
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDEIKVDKETLEMLSSLGMSDLPGLSEVEPQAMAPVNMFGRPGRRF

SEQ ID NO: 8516 - protein, 137 aa, Raphanus sativus
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDEIKVDKETLEMLASLGMSDVAGVSVVEPLTVAPAFGGRPQRRF

SEQ ID NO: 8517 - protein, 136 aa, Eutrema parvulum
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDEIKVDKETLEMLACLGMSDIPGFSEVEPQAMAPTIGRPGRRF

SEQ ID NO: 8518 - protein, 136 aa, Unknown
  Sequence found in Organisms: Brassica napus, Brassica juncea, Brassica oleracea, Brassica rapa
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDVIKVDKETLEMLASLGMADTPGFSEVETQAPAPAFGRPPRRF

SEQ ID NO: 8519 - protein, 139 aa, Raphanus sativus
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDDVKVDKETLEMLASLGMSDVSGFSQVETQAAVAPGNAFGRGGRRF

SEQ ID NO: 8520 - protein, 140 aa, Arabidopsis thaliana
MGRVRTKTVKKSSRQVIEKYYSRMTLDFHTNKKILEEVAIIPSKRLRNKIAGFSTHLMKRIQKGPVRGISLKLQEEERERRMDFVPDESAIKIDDVKVDKETLEMLASLGMSDIAGISQVETQQAMAPAVFGRPAGRYQR

SEQ ID NO: 8521 - protein, 139 aa, Brassica napus
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDDVKVDKETLEMLASLGMSDVSGFSQVETQAAVVPSNAFGRGGRRF

SEQ ID NO: 8522 - protein, 139 aa, Eutrema parvulum
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDHIEVDKETLDMLASLGMSDMPGVVKVDPVSAAPVAAFGLGRGRRY

SEQ ID NO: 8523 - protein, 139 aa, Arabidopsis lyrata
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDHIEVDKETLEMLASLGMSELPGVVKVDPAAAAPVAAFGLGRGRRY

SEQ ID NO: 8524 - protein, 135 aa, Brassica juncea
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDVIKVDKETLEMLASLGMADTPGVSEVETQAAPTFNRPPRRF

SEQ ID NO: 8525 - protein, 135 aa, Brassica juncea
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDVIKVDKETLEMLASLGMSDAHGFSEVEAQAAPSFARPPRRF

SEQ ID NO: 8526 - protein, 138 aa, Unknown
  Sequence found in Organisms: Brassica napus, Brassica juncea
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDDVKVDKETLEMLASLGMSDVSGFSQVEAQAVVQSNAFGRGGRRF

SEQ ID NO: 8527 - protein, 138 aa, Brassica rapa
  misc_feature (122)..(122): Xaa can be any naturally occurring amino acid
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDDVKVDKETLEMLASLGMSDVSGFSQVEXQAVVQSNAFGRGGRRF

SEQ ID NO: 8528 - protein, 139 aa, Brassica napus
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDDVKVDKETLEMLASLGMSDVSGFSQVETQAAVVPSNTFGRGGRRF

SEQ ID NO: 8529 - protein, 135 aa, Raphanus sativus
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDVIKVDKETLEMLASLGMSDAHGFSEVEAQAAPSFSRPPRRF

SEQ ID NO: 8530 - protein, 137 aa, Brassica napus
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDRIEVDKETLDMLASLGMGDLPGVVKVEPVSAAPIAGFGRGRRF

SEQ ID NO: 8531 - protein, 139 aa, Unknown
  Sequence found in Organisms: Citrus sinensis, Citrus clementina
MGRVRTKTVKKSSRQVIERYYSRMTLDFHTNKKILEEVAIIPSKRLRNKIAGFSTHLMKRIQKGPVRGISLKLQEEERERRMDFVPDESAIKTDEIKVDKETLDMLAALGMSDISGLVEVEPQSMIAPPVFGRGGGRRY

SEQ ID NO: 8532 - protein, 137 aa, Brassica rapa
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDRIEVDKETLDMLASLGMGDMPGVVKVEPVSAAPIAGFGRGRRF

SEQ ID NO: 8533 - protein, 139 aa, Eucalyptus grandis
MGRVRTKTVKKSSRQVIERYYSRMTLDFHTNKKILEEVAIIPSKRLRNKIAGFSTHLMKRIQKGPVRGISLKLQEEERERRMDFVPEESAIKTNEIKVDKETLDMLASLGMSDIPGLVEVEPQVMMPPQAFGRGGPRRY

SEQ ID NO: 8534 - protein, 136 aa, Raphanus sativus
MGRVRTKTVKKSSRQVIEKYYSRMTLDFHTNKKILEEVAIIPSKRLRNKIAGFSTHLMKRIQKGPVRGISLKLQEEERERRMDFVPDESAIRTDLIKVDKETLEMLASLGMGDTPGVSIVETQAPAPTFNRPPRRF

SEQ ID NO: 8535 - protein, 136 aa, Raphanus sativus
MGRVRTKTVKKSSRQVIEKYYSRMTLDFHTNKKILEEVAIIPSKRLRNKIAGFSTHLMKRIQKGPVRGISLKLQEEERERRMDFVPDESAIRTDVIKVDKETLEMLASLGMGDTPGVSIVETQAPAPTFNRPPRRF

SEQ ID NO: 8536 - protein, 136 aa, Raphanus sativus
MGRVRTKTVKKSSRQVIEKYYSRMTLDFHTNKKILEEVAIIPSKRLRNKIAGFSTHLMKRIQKGPVRGISLKLQEEERERRMDFVPDESAIRTDVIKVDKETLEMLASLGMGDTPGVSIVETQAPATTFNRPPRRF

SEQ ID NO: 8537 - protein, 141 aa, Cucurbita pepo
MGRVRTKTVKKSSRQVIERYYSKMTLDFHTNKKILEEVAIIPSKRLRNKIAGFSTHLMKRIQKGPVRGISLKLQEEERERRMDFVPDESAIKIDEIKVDKETLDMLAAFGMSDIPGLVEVEPQAMAPLQAFGRGAGGPRRY

SEQ ID NO: 8538 - protein, 141 aa, Cucumis sativus
MGRVRTKTVKKSSRQVIEKYYSKMTLDFHTNKKILEEVAIIPSKRLRNKIAGFSTHLMKRIQKGPVRGISLKLQEEERERRMDFVPDESAIKIDEIKVDKETLDMLAAFGMSDIPGLVEVEPQAMIPPQAFGRGAGGPRRY

SEQ ID NO: 8539 - protein, 141 aa, Momordica charantia
MGRVRTKTVKKSSRQVIERYYSRMTLDFHTNKKILEEVAIIPSKRLRNKIAGFSTHLMKRIQKGPVRGISLKLQEEERERRMDFVPDESAIKIDEIKVDKETLDMLAAFGMSDIPGLVEVEPQAMIPPQAFGRGAVGPRRY

SEQ ID NO: 8540 - protein, 136 aa, Brassica napus
GRVRTKTVKKSSRQVIEKYYSRMTLDFHTNKKILEEVAIIPSKRLRNKIAGFSTHLMKRIQKGPVRGISLKLQEEERERRMDFVPDESAIKTDRIEVDKETLDMLASLGMGDMPGVVKVEPVSAAPIAGFGRGRRF

SEQ ID NO: 8541 - protein, 139 aa, Citrus sinensis
MGRVRTKTVKKSSRQVIERYYSRMTLDFHTNKKILEEVAIIPSKRLRNKIAGFSTHLMKRIQKGPVRGISLKLQEEERERRMDFVPDESAIKTDEIKVDKETLDMLAALGMSDISGLVEVEPQSMITPPVFGRGGGRRY

SEQ ID NO: 8542 - protein, 137 aa, Brassica oleracea
  misc_feature (59)..(59): Xaa can be any naturally occurring amino acid
MGRVRTKTVKKSSRQVIEKYYSRMTLDFHTNKKILEEVAIIPSKRLRNKIAGFSTHLMXRIQKGPVRGISLKLQEEERERRMDFVPDESAIKTDRIEVDKETLDMLASLGMGDMPGVVKVEPVSAAPIAGFGRGRRF

SEQ ID NO: 8543 - protein, 141 aa, Unknown
  Sequence found in Organisms: Cucumis melo, Citrullus lanatus
MGRVRTKTVKKSSRQVIERYYSKMTLDFHTNKKILEEVAIIPSKRLRNKIAGFSTHLMKRIQKGPVRGISLKLQEEERERRMDFVPDESAIKIDEIKVDKETLDMLAAFGMSDIPGLVEVEPQAMIPPQAFGRGAGGPRRY

SEQ ID NO: 8544 - protein, 139 aa, Eutrema halophilum
MGRVRTKTVKKSSRQVIEKYYSRMTLDFHTNKKILEEVAIIPSKRLRNKIAGFSTHLMKRIQKGPVRGISLKLQEEERERRMDFVPDESAIRTDHIAVDKETLDMLASLGMSDMPGVVKVDPVSAAPVAAFGFGRGRKF

SEQ ID NO: 8545 - protein, 74 aa, Raphanus sativus
MGRVRTKTVKKSSRQVIEKYYSRMTLDFHTNKKILEEVAIIPSKRLRNRIAGFSTHLMKRIQKGPVRGISLKLQ

SEQ ID NO: 8546 - protein, 137 aa, Raphanus sativus
MGRVRTKTVKKSSRQVIEKYYSRMTLDFHTNKKILEEVAIIPSKRLRNKIAGFSTHLLKRIQKGPVRGISLKLQEEERERRMDFVPDESAIKTDRIEVDKETLDMLASLGMADMPGVVKVDPVSAAPVAAFGRGRRF

SEQ ID NO: 8547 - protein, 78 aa, Brassica juncea
MGRVRTKTVKKSSRQVIEKYYSRMTLDFHTNKKILEEVAIIPSKRLRNKIAGFSTHLMKRIQKGPVSWYLVQASRGRA

SEQ ID NO: 8548 - protein, 142 aa, Tropaeolum majus
MGRVRTKTVKKSSRQVIEKYYSKMTLDFHTNKKILEEVAIIPSKRLRNKIAGFSTHLMKRIQKGPVRGISLKLQEEERERRMDFVPDESAIRTDEIKVDKETLDMLAALGMSDLPGLSEVDLQASIPAPIFGRAGAGGPRRY

SEQ ID NO: 8549 - protein, 141 aa, Tropaeolum majus
MGRVRTKTVKKSSRQVIEKYYSKMTLDFHTNKKILEEVAIIPSKRLRNKIAGFSTHLMKRIQKGPVRGISLKLQEEERERRMDFVPDESAIRTDEIKVDKETLEMLAALGMSDIPGLSEVDPLASMPATGYSRPGPGPRRY

SEQ ID NO: 8550 - protein, 142 aa, Tropaeolum majus
MGRVRTKTVKKSSRQVIEKYYSKMTLDFHTNKKILEEVAIIPSKRLRNKIAGFSTHLMKRIQKGPVRGISLKLQEEERERRMDFVPDESAIRTDEIKVDKETLDMLAALGMSDLPGLSEVDLQASNPAPIFGRAGAGGPRRY

SEQ ID NO: 8551 - protein, 140 aa, Eucalyptus grandis
MGRVRTKTVKKSSRQVIERYYSRMTLDFHTNKKVLEEVAIIPSKRLRNKIAGFSTHLMKRIQKGPVRGISLKLQEEERERRMDFVPDVSAIKTEEINVDKETLDMLASLGMSDIPGLVEVQPQVMMPAQAFGRGGPGRRY

SEQ ID NO: 8552 - protein, 132 aa, Brassica juncea
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDHIEVDKETLDMLASLGMGDMPGVVKVDPVSAAPVAAFG

SEQ ID NO: 8553 - protein, 141 aa, Cucurbita pepo
MGRVRTKTVKKSSRQVIERYYSKMTLDFHTNKKILEEVAIIPSKRLRNKIAGFSTHLMKRIQKGPVRGISLKLQEEERERRMDFVPDESAIKINEIKVDKETLDMLAAFGMSDIPGLVEVEPQAMNLPQAFGRGAGGPRRY

SEQ ID NO: 8554 - protein, 140 aa, Populus trichocarpa
MGRVRTKTVKKSSRQVIERYYSKMTLDFHTNKKILEEVAIIPSKRLRNKIAGFSTHLMKRIQKGPVRGISLKLQEEERERRMDFVPEESAIKIQEIKVDKETIDMLAALGMSDFPGIVEVEPQPMVPTQGFGRGGGARRY

SEQ ID NO: 8555 - protein, 141 aa, Linum usitatissimum
MGRVRTKTVKKSSRQVIERYYSKMTLDFHTNKKILEEVAIIPSKRLRNKIAGFSTHLMKRIQKGPVRGISLKLQEEERERRMDFVPEESAIRTDEIKVDKETKEMLAALGMADIGGIVEVDPIAVSAPPFGFGRGAGRGRY

SEQ ID NO: 8556 - protein, 124 aa, Brassica napus
SSRQVIEKYYSRMTLDFHTNKKILEEVAIIPSKRLRNKIAGFSTHLMKRIQKGPVRGISLKLQEEERERRMDFVPDESAIKTDVIKVDKETLEMLASLGMSDTSGISEVEPQAAPTFSRPPRRF

SEQ ID NO: 8557 - protein, 137 aa, Tamarix hispida
MGRVRTKTVKKSSRQVIEKYYSRMTLDFHTNKKILEEVAIIPSKRLRNKIAGFSTHLMKRIQKGPVRGISLKLQEEERERRMDFVPAESAIKTDSIGVDQETIDMLATLGMSEIPGVYKAEPDVAAPLPAFGRGRRF

SEQ ID NO: 8558 - protein, 143 aa, Humulus lupulus
MGRVRTKTVKKSSRQVIERYYSRMTLDFHTNKKILEEVALIPTKRLRNKIAGFSTHLMKRIQKGPVRGISLKLQEEERERRMDFVPDESAIKTDEIKVDKETIDMLAALGMSDLPGLTEVEPQVVIPTQGFGRGSGGGPGRRY

SEQ ID NO: 8559 - protein, 144 aa, Scabiosa columbaria
MGRVRTKTVKKSSRQVIERYYSKMTLDFHTNKKILEEVAIIPSKRLRNKIAGFSTHLMKRIQKGPVRGISLKLQEEERERRMDFVPDESAIKTDNIEVDKETLEMLASLGMSEMPGVTKQAEDQGTAAPPAAYGRGGPGFNRRY

SEQ ID NO: 8560 - protein, 140 aa, Malus domestica
MGRVRTKTVKKSSRQVIERYYSRMTLDFHTNKKILEEVAIIPSKRLRNKIAGFSTHLMKRIQKGPVRGISLKLQEEERERRMDFVPEESAIKTDEISVDKETLDMLSSLGMADMPGVKRVDPEAQTQNLGGFGRGGPRRY

SEQ ID NO: 8561 - protein, 127 aa, Brassica juncea
VKKSSRQVIEKYYSRMTLDFHTNKKILEEVAIIPSKRLRNKIAGFSTHLMKRIQKGPVRGISLKLQEEERERRMDFVPDESAIKTDVIKVDKETLEMLASLGMSDAHGFSEVEAQAAPSFARPPRRF

SEQ ID NO: 8562 - protein, 144 aa, Castanea mollissima
MGRVRTKTVKKSSRQVIERYYSKMTLDFHTNKKILVEVAIIPSKRLRNKIAGFSTHLMKRIQKGPVRGISLKLQEEERERRMDFVPEESAIKTDLIKVDKETLDMLASLGMSDMPGLEEVELQPVVPAQVFGRGAGGAGGPRRY

SEQ ID NO: 8563 - protein, 143 aa, Cannabis sativa
MGRVRTKTVKKSSRQVIERYYSRMTLDFHTNKKILEEVALIPTKRLRNKIAGFSTHLMKRIQKGPVRGISLKLQEEERERRMDFVPDESAIKTDEIKVDKETIDMLAALGMSDLPGLTEVEPQVVIPTQGFGRGGGGGPGRKY

SEQ ID NO: 8564 - protein, 143 aa, Euphorbia peplus
MGRVRTKTVKKSSRQVIERYYSKMTLDFHTNKKILEEVAIIPSKRLRNKIAGFSTHLMKRIQKGPVRGISLKLQEEERERRMDFVPEESAIKIDEIKVDKETIEMLAALGMSDVPGLVEVEPQPLIAPQGFGRGLAGGFGRRG

SEQ ID NO: 8565 - protein, 144 aa, Scabiosa columbaria
MGRVRTKTVKKSSRQVIERYYSKMTLDFHTNKKILEEVAIIPSKRLRNKIAGFSTHLMKRIQKGPVRGISLKLQEEERERRMDFVPDESAIKTDVIEVDKETLEMLASLGMSEIPGVRKQSDEQTTVAPVAAYGRGGPGFNRRY

SEQ ID NO: 8566 - protein, 142 aa, Cirsium arvense
MGRVRTKTVKKSSRVVIERYYGKMTLDFHTNKKILEEVAIIPSKRLRNKIAGFSTHLMKRIQKGPVRGISLKLQEEERERRMDFVPDESAIKTDLIEVDKETIEMLSALGMADLPGVVKASVEPQALPSLPAFGRGGAPRRY

SEQ ID NO: 8567 - protein, 141 aa, Mesembryanthemum crystallinum
MGRVRTKTVKKSSRQVIERYYSKMTLDFHTNKKVLEEVAIIPSKRLRNKIAGFSTHLMRRIQKGPVRGISLKLQEEERERRMDFVPEESAIKTSHIEVDKETLEMLASLGMGDLPGISEMAAAPAAIAAPTGFGRGGPRRY

SEQ ID NO: 8568 - protein, 141 aa, Mesembryanthemum crystallinum
MGRVRTKTVKKSSRQVIERYYSRMTLDFHTNKKALEEVAIIPSKRLRNKIAGFSTHLMRRIQKGPVRGISLKLQEEERERRMDFVPAESAIRTDSIPVDPETIEMLAALGMSDLPGVVKTEAEAMAPAPAFGRGAGGPRRY

SEQ ID NO: 8569 - protein, 137 aa, Eutrema halophilum
MGCVRTNTLKKSSRQVIEKYYSCMTLDFHTNKKILKEVAIIPSNRLRNKIAGFSTHLMKHIQKGPVRGISLKLQEEERERRMDFVPDESAIKTDEIKVDKETLEMLASLRISEIPGFSQVEPQAMAPVRISRPREKI

SEQ ID NO: 8570 - protein, 141 aa, Aquilegia formosa
MGRVRTKTVKKSSRQVIERYYSRMTLDFHTNKKILEEVAIIPSKRLRNKIAGFSTHLMKRIQRGPVRGISLKLQEEERERRMDFVPEESAININEIEVDKETMDMLAALGMSDLPGVSRVVETTVAAAPAFARGGGAGRRL

SEQ ID NO: 8571 - protein, 140 aa, Glycine max
MGRVRTKTVKKSSRQVIERYYSRMTLDFHTNKKVLEEVAIIPSKRLRNKIAGFSTHLMKRIQKGPVRGISLKLQEEERERRMDFVPDVSAIRTDQIEVDKETLDMLAALGMSEVPGIVQVDPVAVQAPLGFGRGGPGRRY

SEQ ID NO: 8572 - protein, 138 aa, Fagopyrum esculentum
MGRVRTKLVKKSSRQVIEKYYSRMTLDFHTNKKVLEEVAIIPTKRLRNKIAGFSTHLMKRIQKGPVRGISLKLQEEERERRMDFVPEESAIKTDSIAVDPETIEMIAALGMSDLPGIIEAKPETMAPPPFASRGPRRY

SEQ ID NO: 8573 - protein, 139 aa, Malus domestica
MGRVRTKTVKKSSRQVIERYYSRMTLDFHTNKKILEEVAIIPSKRLRNKIAGFSTHLMKRIQKGPVRGISLKLQEEERERRMDFVPEESAIKIDEISVDKETLDMLSALGMADMPGVKRVDPEAQTQNLGYGRGAPRRY

SEQ ID NO: 8574 - protein, 144 aa, Fagus grandifolia
MGRVRTKTVKKSSRQVIERYYSRMTLDFHTNKKILEEVAIIPSKRLRNKIAGFSTHLMKRIQKGPVRGISLKLQEEERERRMDFVPDESAIKIDEIKVDKETIDMLAALGMSEIPGLVEAELQPVVPAQAFGRGAGGPGGPRRY

SEQ ID NO: 8575 - protein, 144 aa, Solanum tuberosum
MGRVRTKTVKKSSRQVIERYYSKMTLDFHTNKKILEEVAIIPSKRLRNKIAGFSTHLMKRIQKGPVRGISLKLQEEERERRMDFVPDESAIKTDLIEVDKETLDMLSSLGMSDLPGVVKQAAEPQAVAALPTFGRGAGGFGRKY

SEQ ID NO: 8576 - protein, 139 aa, Glycine max
MGRVRTKTVKKSSRQVIERYYSRMTLDFHTNKKVLEEVAIIPSKRLRNKIAGFSTHLMKRIQKGPVRGISLKLQEEERERRMDFVPDVSAIRTDQIEVDKETLDMLAALGMSEVPGVVQVDPVAVQAPLGFGRGAGRRY

SEQ ID NO: 8577 - protein, 138 aa, Fragaria vesca
MGRVRTKTVKKSSRQVIERYYSRMTLDFHTNKKVLEEVAIIPSKRLRNKIAGFSTHLMKRIQKGPVRGISLKLQEEERERRMDFVPDESAIKTDDIAVDKETLDMLTALGMADIPGLRESTELQAAPVGYGRGGPRRY

SEQ ID NO: 8578 - protein, 142 aa, Acacia harpophylla
MGRVRTKTVKKSSRQVIEKYYSRMTLDFHTNKKILEEVALIPSKRLRNKIAGFSTHLMKRIQKGPVRGISLKLQEEERERRMDFVPDVSAIKTDQIEVDKETLDMLNALGMSDIPGVVQVDPTPVPQVGFGRGGFGGGARRY

SEQ ID NO: 8579 - protein, 143 aa, Lotus japonicus
MGRVRTKTVKKSSRQVIERYYSRMTLDFHTNKKILEEVALIPSKRLRNKIAGFSTHLMKRIQKGPVRGISLKLQEEERERRMDFVPDESAIKTDHIAVDKETLEMLAALGMAEIPGVVQVDPVPVQQIAYGRGAGAGAPGRRY

SEQ ID NO: 8580 - protein, 143 aa, Carica papaya
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDHIEVDKETMDMLAALGMSEIPGVVKVDPVAAPVQSMGFGRGAGGVGRRY

SEQ ID NO: 8581 - protein, 142 aa, Populus trichocarpa
MGRVRTKTVKKSSRQVIERYYSKMTLDFHTNKKILEEVAIIPSKRLRNKIAGFSTHLMKRIQKGPVRGISLKLQEEERERRMDFVPEESAIKIHEIKVDKETIDMLAALGMSDVPGLVEVEPQPMLPTQGFGRGGGARRFLS

SEQ ID NO: 8582 - protein, 142 aa, Primula obconica
MGRVRTKTVKKSSRQVIERYYSKMTMDFHTNKKILEEVAIIPSKRLRNKIAGFSTHLMKRIQKGPVRGISLKLQEEERERRMDFVPDESAINIEKIEVDKETMEMLATLGMGDLPGVFKAVEEQQPVASFNRGGGPGAPRRY

SEQ ID NO: 8583 - protein, 141 aa, Theobroma cacao
MGRVRTKTVKKSSRQVIENYYSRMTLDFHTNKKIVGEVALIPTKRLRNKIAGFSTHLIKRIQKGPVRGISLKLQEEERERRMDFVPDESAINTDEIKVDKETLDMLSALGMADIPGLVEVEPQAMIAPPVFGGPGGAGRRY

SEQ ID NO: 8584 - protein, 141 aa, Linum usitatissimum
MGRVRTKTVKKSSRQVIERYYSKMTLDFHTNKKILEEVAIIPSKRLRNKIAGFSTHLMKRIQKGPVRGISLKLQEEERERRMDFVPEESAIRTDKIEVDKETIEMLTALGMADCPGIVEVDPVAVSAPQFGFGRGAGRGRY

SEQ ID NO: 8585 - protein, 140 aa, Vigna unguiculata
MGRVRTKTVKKSSRQVIERYYSRMTLDFHTNKKVLEEVAIIPSKRLRNKIAGFSTHLMKRIQKGPVRGISLKLQEEERERRMDFVPEVSAIRTDQIEVDKETIDMLAALGMSDVPGVVKVDPVPVQAPLAFGRGAGGRRY

SEQ ID NO: 8586 - protein, 140 aa, Vigna unguiculata
MGRVRTKTVKKSSRQVIERYYSRMTLDFHTNKKVLEEVAIIPSKRLRNKIAGFSTHLMKRIQKGPVRGISLKLQEEERERRMDFVPEVSAIRTDQIEVDKETIDMLAALGMSDVPGVVKVDPIPVQAPLAFGRGAGGRRY

SEQ ID NO: 8587 - protein, 140 aa, Cyamopsis tetragonoloba
MGRVRTKTVKKSSRQVIERYYSRMTLDFHTNKKILEEVALIPSKRLRNKIAGFSTHLMKRIQKGPVRGISLKLQEEERERRMDFVPEVSAIKTDQIEVDKETLDMLAALGMSEIPGVVQVDPVPVQPQLGFGRGAPGRRY

SEQ ID NO: 8588 - protein, 143 aa, Nuphar advena
  misc_feature (126)..(126): Xaa can be any naturally occurring amino acid
MGRVRTKTVKKSSRQVIERYYSRMTLDFHTNKKILEEVAIIPSKRLRNKIAGFSTHLMKRIQRGPVRGISLKLQEEERERRMDFVPEESAIKTDPIEVDKETIEMLAALGMADLPGVVKQADASAXGGGGYGKPGGGYQGRRI

SEQ ID NO: 8589 - protein, 141 aa, Elaeis guineensis
MGRVRTKTVKKSSRQVIERYYSRMTLDFHTNKKILEEVAIIPSKRLRNKIAGFSTHLMRRIQRGPVRGISLKLQEEERERRMDFVPDESAIKVDHIEVDKETIEMLASLGMADLPGVEKQADSPAIPVYSGRPGGYGGRRS

SEQ ID NO: 8590 - protein, 137 aa, Linum usitatissimum
MGRVRTKTVKKSSRQVIERYYSKMTLDFHTNKKILEEVAIIPSKRLRNKIAGFSTHLMKRIQKGPVRGISLKLQEEERERRMDFVPEQSAINTDRIEVDKETLDMLSALGMSGVEGIVVVEPGTVAPVYGFGRGRRF

SEQ ID NO: 8591 - protein, 137 aa, Linum usitatissimum
MGRVRTKTVKKSSRQVIERYYSKMTLDFHTNKKILEEVAIIPSKRLRNKIAGFSTHLMKRIQKGPVRGISLKLQEEERERRMDFVPEQSAINIDRIEVDKETLEMLGALGMSGVEGIVVVEPGTVAPVYGFGRGRRF

SEQ ID NO: 8592 - protein, 144 aa, Unknown
  Sequence found in Organisms: Solanum lycopersicum, Petunia hybrida
MGRVRTKTVKKSSRQVIERYYSKMTLDFHTNKKILEEVAIIPSKRLRNKIAGFSTHLMKRIQKGPVRGISLKLQEEERERRMDFVPDESAIKTDLIEVDKETLDMLSALGMSDLPGVVKQAAEPQAVAALPTFGRGAGGFGRKY

SEQ ID NO: 8593 - protein, 139 aa, Citrullus lanatus
MGRVRTKTVKKSSRQVIERYYSRMTLDFHTNKKILEEVAIIPSKRLRNKIAGFSTHLMKRIQKGPVRGISLKLQEEERERRMDFVPDVSAIKTDQIEVDKETLDMLSALGMNDIPGLVQVDPTVPQQVGFGLGGRGRRY

SEQ ID NO: 8594 - protein, 135 aa, Vigna unguiculata
MGRVRTKTVKKSSRQVIERYYSRMTLDFHTNKKLLEEVAIIPSKRLRNKIAGFSTHLMKRIQKGPVRGISLKLQEEERERRMDFVPDVSAINTDHIEVDKETMEMLHSLGINDVSGIVQVDPVPVQPTFAFNRRY

SEQ ID NO: 8595 - protein, 144 aa, Solanum phureja
MGRVRTKTVKKSSRQVIERYYSKMTLDFHTNKKILEEVAIIPSKRLRNKIAGFSTHLMKRIQKGPVRGISLKLQEEERERRMDFVPDESAIKIDLIEVDKETLDMLSSLGMSDLPGVVKQAAEPQAVAALPTFGRGAGGFGRKY

SEQ ID NO: 8596 - protein, 144 aa, Silene vulgaris
MGRVRTKTVKKSSRQVIEKYYSKMTLDFHTNKKVLEEVAIIPSKRLRNKIAGFSTHLMRRIQKGPVRGISLKLQEEERERRMDFVPDVSAIRTDLIEVDRETLDMLAALGMSDLPGLSEVAPESAAFAIPAGGFGRGAAGPRRY

SEQ ID NO: 8597 - protein, 143 aa, Hevea brasiliensis
MGRVRTKTVKKSSRQVIERYYSKMTLDFHTNKKILEEVAIIPSKRLRNKIAGFSTHLMKRIQKGSVRGISLKLQEEERERRMDFVPEESAIKIDEIKVDKETIDMLAALGMSDIPGLVEFEPQPLVPPQVFGRGQAGAPGRRF

SEQ ID NO: 8598 - protein, 144 aa, Lotus japonicus
MGRVRTKTVKKSSRQVIERYYSRMTLDFHTNKKILEEVALIPSKRLRNKIAGFSTHLMKRIQKGPVRGISLKLQEEERERRMDFVPDESAIKTDHIAVDKETLEMLAALGMAEIPGVVQVDPVAVQQIPFTRGGGAGGGAGRRY

SEQ ID NO: 8599 - protein, 143 aa, Helianthus annuus
MGRVRTKTVKKSSRVVIERYYGKMTLDFHTNKKILEEVAIIPSKRLRNKIAGFSTHLMKRIQKGPVRGISLKLQEEERERRMDFVPDESAIKTDLIEVDKETIEMLNALGMGDLPGVVKASVEPQALPSVPAFGRGGGATRRY

SEQ ID NO: 8600 - protein, 143 aa, Lippia dulcis
MGRVRTKTVKKSSRQVIEKYYSKMTLDFHTNKKILEEVSIIPTKRLRNKIAGFSTHLMKRIQKGPVRGISLKLQEEERERRMDFVPDESAIKTDVIEVDKETIDMLASLGMADIPGVVKQTIEPQGAVAPTYGRGAAGFGRRY

SEQ ID NO: 8601 - protein, 146 aa, Platanus occidentalis
MGRVRTKTVKKSSRQVIERYYSRMTLDFHTNKKILEEVAIIPSKRLRNKIAGFSTHLMKRIQKGPVRGISLKLQEEERERRMDFVPDESAIKTDLIEVDKETIDMLNALGMSDLPGVVKQAEPALAPAPAFGRGSGGIGGGPGRRY

SEQ ID NO: 8602 - protein, 142 aa, Beta vulgaris
MGRVRTKTVKKSSRQVIERYYSRMTLDFHTNKKVLEEVAIIPSKRLRNKIAGFSTHLMKRIQKGPVRGISLKLQEEERERRMDFVPAESAIKVDSIPVDPETIDMLAALGMSELPGIVKAEPEVMAPAPAFGRGAGGLGRRY

SEQ ID NO: 8603 - protein, 142 aa, Manihot esculenta
MGRVRTKTVKKSSRQVIERYYSKMTLDFHTNKKILEEVAIIPSKRLRNKIAGFSTHLMKRIQKGSVRGISLKLQEEERERRMDFVPEESAIKIDEIKVDKETIDMLAALGMSDIPGLVEFEPQPLVPPQVFGRGPAGAPRRF

SEQ ID NO: 8604 - protein, 142 aa, Carthamus tinctorius
MGRVRTKTVKKSSRVVIERYYGKMTLDFHTNKKILEEVAIIPSKRLRNKIAGFSTHLMERIQKDPVRGISLKLQEEERERRMDFVPDESAIKTDLIEVDKETIEMLTALGMADLPGVVKASVEPQALPSLPAFGRGGAPRRY

SEQ ID NO: 8605 - protein, 143 aa, Helianthus annuus
MGRVRTKTVKKSSRQVIERYYSKMTLDFHTNKKILEEVAIIPSKRLRNKIAGFSTHLMKRIQKGPVRGISLKLQEEERERRMDFVPDESAIKVDRIEVDKETIELLASLGMSEMPGIVLKEDTPVVSAGIPGGYGGARGGRRY

SEQ ID NO: 8606 - protein, 140 aa, Catharanthus roseus
MGRVRTKTVKKSSRQVIERYYSKMTLDFHTNKKVLGEVAIIPSKRLRNKIAGFSTHLMKRIQKGPVRGISLKLQEEERERRMDFVPDESAIKTDRIEVDKETIDLLATLGMSDLPGIVLKEDEAPVMVAPPMGFGGRRRY

SEQ ID NO: 8607 - protein, 141 aa, Tabernaemontana elegans
MGRVRTKTVKKSSRQVIERYYSKMTLDFHTNKKILTEVAIIPSKRLRNKIAGFSTHLMKRIQKGSVRGISLKLQEEERERRMDFVPDESAIKTDRIEVDKETIDLLATLGMSDLPGIVLKEEQAPVMVAPPMAYGGGRRRY

SEQ ID NO: 8608 - protein, 141 aa, Gossypium hirsutum
MGRVRTKTVKKSSRQVIERYYSRMTLDFHTNKKIIEEVAIIPSKRLRNKIAGFSTHLMKRIQRGPVRGISLKLQEEERERRMDFVPDESAIKVDQIEVDKETLDMLSVLGMSDIPGLVKVDPVAVVPQIGFGRGGGPGRRF

SEQ ID NO: 8609 - protein, 139 aa, Quercus alba
MGRVRTKTVKKSSRQVIERYYSKMTLDFHTNKKILVEVAIIPSKRLRNKIAGFSTHLMKRIQKGPVRGISLKLQEEERERRMDFVPEESAIKTDLINKETLDMLASLGMSDMPGLEEVELQPVIPAQVFGRGAGGPRRY

SEQ ID NO: 8610 - protein, 139 aa, Quercus alba
MGRVRTKTVKKSSRQVIERYYSKMTLDFHTNKKILVEVAIIPSKRLRNKIAGFSTHLMKRIQKGPVRGISLKLQEEERERRMDFVPEESAIKTDLINKETLDMLASLGMSDMPGLEEVELQPVIPAQVFGRGTGGPRRY

SEQ ID NO: 8611 - protein, 141 aa, Linum usitatissimum
MGRVRTKTVKKSSRQVIERYYSKMTLDFHTNKKILEEVAIIPSKRLRNKIAGFSTHLMKRIQKGPVRGISLKLQEEERERRMDFVPEESAIRTDKIEVDKETIEMLTALGMADCPGIVEVDPIAVSVPQFGFGRGAGRGRY

SEQ ID NO: 8612 - protein, 146 aa, Platanus occidentalis
MGRVRTKTVKKSSRQVIERYYSRMTLDFHTNKKILEEVAIIPSKRLRNKIAGFSTHLMKRIQKGPVRGISLKLQEEERERRMDFVPDESAIKTDLIEVDKETIDMLSALGMSDLPGVVKQAEPTLAPAPAFGRGAAGVGGGPGRRY

SEQ ID NO: 8613 - protein, 145 aa, Unknown
  Sequence found in Organisms: Nicotiana benthamiana, Nicotiana tabacum
MGRVRTKTVKKSSRQVIEKYYSKMTLDFHTNKKILEEVAIIPSKRLRNKIAGFSTHLMKRIQKGPVRGISLKLQEEERERRMDFVPDESAIKTDLIEVDKETLDMLSALGMSDLPGVVKQAAEPQAVAALPTYGRGAGGFGGRKY

SEQ ID NO: 8614 - protein, 146 aa, Senecio madagascariensis
MGRVRTKTVKKSSRQVIERYYSKMTLDFHTNKKILEEVAIIPSKRLRNKIAGFSTHLMKRIQKGPVRGISLKLQEEERERRMDFVPDESAIKVDHIEVDKETIDLLASLGMSDLPGIVLKEDTPAVAATIPGAYGGARGGAARTRY

SEQ ID NO: 8615 - protein, 139 aa, Malus domestica
MGRVRTKTVKKSSRQVIERYYSRMTLDFHTNKKILEEVAIIPSKRLRNKIAGFSTHLMKRIQKGPVRGISLKLQEEERERRMDFVPEESAIKIDEISVDKETIDMLSALGMADMPGVKRVDPEAQSQNLGFVRGGPRRY

SEQ ID NO: 8616 - protein, 139 aa, Cucurbita pepo
MGRVRTKTVKKSSRQVIERYYSRMTLDFHTNKKILEEVAIIPSKRLRNKIAGFSTHLMKRIQKGPVRGISLKLQEEERERRMDFVPDVSAIKTDQIEVDRETLDMLSALGMTDIPGLVQVDPTVPQQVAFGLGGRGRRY

SEQ ID NO: 8617 - protein, 144 aa, Solanum lycopersicum
MGRVRTKTVKKSSRQVIERYYSKMTLDFHTNKKILEEVAIIPSKRLRNKIAGFSTHLMKRIQKGPVRGISLKLQEEERERRMDFVPDESAIKTDLIEVDKETLDMLSALGMSDLPGVVKQAAEPQAVAALPSYGRGGGGFGRKY

SEQ ID NO: 8618 - protein, 143 aa, Tripterygium wilfordii
MGRVRTKTVKKSSRQVIERYYPRMTMDFHTNKKLLEEVAIIPSKRLRNKIAGFSTHLMKRIQKGPVRGISLKLQEEERERRMDFVPDVSAIKTEQIEVDKETIDMLAALGMSDIPGIVQVEPAAAPAAPMGFGRGAGGPGRRF

SEQ ID NO: 8619 - protein, 144 aa, Solanum melongena
MGRVRTKTVKKSSRQVIERYYSKMTLDFHTNKKILEEVAIIPSKRLRNKIAGFSTHLMKRIQKGPVRGISLKLQEEERERRMDFVPDESAIKIDLIEVDKETLDMLSALGMSDLPGVVKQAAEPQAVAALPTFGRGAGGFGRKY

SEQ ID NO: 8620 - protein, 144 aa, Unknown
  Sequence found in Organisms: Solanum melongena, Solanum tuberosum, Solanum phureja
MGRVRTKTVKKSSRQVIERYYSKMTLDFHTNKKILEEVAIIPSKRLRNKIAGFSTHLMKRIQKGPVRGISLKLQEEERERRMDFVPDESAIKTDLIEVDKETLDMLSALGMSDLPGVVKQAAEPQAVAALPTYGRGAGGFGRKY

SEQ ID NO: 8621 - protein, 144 aa, Arachis hypogaea
MGRVRTKTVKKSSRQVIERYYSRMTLDFHTNKKVLEEVALIPSKRLRNKIAGFSTHLMKRIQKGPVRGISLKLQEEERERRMDFVPDVSAIDTQHIEVDKETIDMLQSLGMSDIPGITQVDPVPVQQIPFGRPGAGFGGAQRRY

SEQ ID NO: 8622 - protein, 144 aa, Petunia hybrida
MGRVRTKTVKKSSRQVMERYYSKMTLDFHTNKKILEEVAIIPSKRLRNKIAGFSTHLMKRIQKGPVRGISLKLQEEERERRMDFVPDESAIKTDLIEVDKETLDMLSALGMSDLPGVVKQAAEPQAVAALPTFGRGAGGFGRKY

SEQ ID NO: 8623 - protein, 139 aa, Cajanus cajan
MGRVRTKTVKKSSRQVIERYYSRMTLDFHTNKKVLEEVAIIPSKRLRNKIAGFSTHLMKRIQKGPVRGISLKLQEEERERRMDFVPDVSAIATDHIEVDKETLDMLAALGMSEIPGVVQVDPVPVAAPLPFARGAGRRF

SEQ ID NO: 8624 - protein, 139 aa, Fragaria vesca
MGRVRTKTVKKSSRQVIERYYSRMTLDFHTNKKVLEEVAIIPSKRLRNKIAGFSTHLMKRIQKGPVRGISLKLQEEERERRMDFVPDESAIKTDDIAVDKETLDMLTALGMGDIPGVRVESTDLQAAPVGYGRGGPRRY

SEQ ID NO: 8625 - protein, 145 aa, Nicotiana tabacum
MGRVRTKTVKKSSRQVIERYYSKMTLDFHTNKKILEEVAIIPSKRLRNKIAGFSTHLMKRIQKGPVRGISLKLQEEERERRMDFVPDESAIKTDLIEVDKETLDMLSALGMSDLPGVVKQAAEPQVVAALPTYGRGAGGFGGRKY

SEQ ID NO: 8626 - protein, 144 aa, Nicotiana tabacum
  misc_feature (19)..(19): Xaa can be any naturally occurring amino acid
  misc_feature (107)..(107): Xaa can be any naturally occurring amino acid
  misc_feature (129)..(129): Xaa can be any naturally occurring amino acid
MGRVRTKTVKKSSRQVIEXYYSKMTLDFHTNKKILEEVAIIPSKRLRNKIAGFSTHLMKRIQKGPVRGISLKLQEEERERRMDFVPDESAIKTDLIEVDKETLDMLXALGMSDLPGVVKQAAEPQAVAXLPTYGRGAGGFGRKY

SEQ ID NO: 8627 - protein, 145 aa, Zostera marina
MGRVRTKTVKKSSRQVIERYYSRMTLDFHTNKKVLEEVAIIPSKRLRNKIAGFSTHLMKRIQRGPVRGISLKLQEEERERRMDFVPDESAIKSDGIEVDKETIEMLASLGMPDLPGVIKQADATQAIGAPFGAGGVRGGRGGGRY

SEQ ID NO: 8628 - protein, 144 aa, Unknown
  Sequence found in Organisms: Euphorbia peplus, Euphorbia esula
MGRVRTKTVKKSSRQVIERYYSKMTLDFHTNKKILEEVAIIPSKRLRNKIAGFSTHLMKRIQKGPVRGISLKLQEEERERRMDFVPEESAIKIDEIKVDKETIDMLAALGMSDFPGLVEVEPTPMIAPQGFGRGGPAGGFQRRG

SEQ ID NO: 8629 - protein, 142 aa, Chelidonium majus
MGRVRTKTVKKSSRQVIERYYSRMTLDFHTNKKILEEVAIIPSKRLRNKIAGFSTHLMKRIQRGPVRGISLKLQEEERERRMDFVPEESAIKTDVIEVDKETIDMLAALGMSDLPGVVKAETALAPPPPFARGGAGGQGRRY

SEQ ID NO: 8630 - protein, 144 aa, Silene vulgaris
MGRVRTKTVKKSSRQVIEKYYSKMTLDFHTNKKVLEEVAIIPSKRLRNKIAGFSTHLMRRIQKGPVRGISLKLQEEERERRMDFVPDVSAIRTDLIEVDRETIEMLAALGMSDLPGLSEVAPETSLSALPAGGFGRGAGAPRRY

SEQ ID NO: 8631 - protein, 144 aa, Silene vulgaris
MGRVRTKTVKKSSRQVIEKYYSKMTLDFHTNKKVLEEVAIIPSKRLRNKIAGFSTHLMRRIQKGPVRGISLKLQEEERERRMDFVPDVSAINTELIAVDRETIEMLAALGMSDLPGLSEVAPETVNLAVPGAGFGRGAGGPRRY

SEQ ID NO: 8632 - protein, 143 aa, Manihot esculenta
MGRVRTKTVKKSSRQVIERYYSKMTLDFHTNKKILEEVAIIPSKRLRNKIAGFSTHLMKRIQKGSVRGISLKLQEEERERRMDFVPEESAIKIDEIKVDKETIDMLAALGMSDIPGLVEFEPQPLVPSQVFGRGPAGAPGRRF

SEQ ID NO: 8633 - protein, 89 aa, Flaveria ramosissima
MTLDFHTNKKILEEVAIIPSKRLRNKIAGFSTHLMKRIQKGPVRGISLKLQEEERERRMDFVPDESAIKTDRIEVDKETIELLASLGSE

SEQ ID NO: 8634 - protein, 141 aa, Amsonia hubrichtii
MGRVRTKTVKKSSRQVIERYYSKMTLDFHTNKKILTEVAIIPSKRLRNKIAGFSTHLMKRIQKGPVRGISLKLQEEERERRMDFVPDESAIKTDRIEVDKETIDLLATLGMNELPGIVLKEQEAPLMAAPPMAFGGGRRRY

SEQ ID NO: 8635 - protein, 143 aa, Primula obconica
MGRVRTKTVKKSSRQVIERYYSKMTMDFHTNKKILEEVAIIPSKRLRNKIAGFSTHLMKRIQKGPVRGISLKLQEEERERRMDFVPDESAINIEKIEVDKETMEMLATLGMGDLPGVFKAVEEQQSVQPVGFGRGGPGGPRRY

SEQ ID NO: 8636 - protein, 140 aa, Acacia harpophylla
MGRVRTKTVKKSSRQVIEKYYSRMTLDFHTNKKILEEVALIPSKRLRNKISGFSTHLMKRIQKGPVRGISLKLQEEERERRMDFVPDVSAIKTDLIEVDKETLDMLNALGMNDILGIVKVDPVPVQQTLGFGRCFGGARR

SEQ ID NO: 8637 - protein, 143 aa, Lactuca sativa
MGRVRTKTVKKSSRVVIERYYGKMTLDFHTNKKILEEVAIIPSKRLRNKIAGFSTHLMKRIQKGPVRGISLKLQEEERERRMDFVPDESAIKTDLIEVDKETIEMLVALGMGDLPGVVKAVVEPQAVPAGPGFGRGGGFTRRY

SEQ ID NO: 8638 - protein, 141 aa, Prunus persica
MGRVRTKTVKKSSRQVIERYYSKMTLDFHTNKKILEEVAIIPSKRLRNKIAGFSTHLMKRIQKGPVRGISLKLQEEERERRMDYVPEQSAIRTEEIKVDKETLDMLAALGMADLPGVSEAEPQVMIPSQGYGRGPQGGRRF

SEQ ID NO: 8639 - protein, 142 aa, Theobroma cacao
MGRVRTKTVKKSSRQVIERYYSRMTLDFHTNKKIIEEVAIIPSKRLRNKIAGFSTHLMKRIQKGPVRGISLKLQEEERERRMDFVPDESAIKVDQIEVDKETLDMLSVLGMADIPGLVKVDPVAVPVPQIGFGRGGGPGRRF

SEQ ID NO: 8640 - protein, 142 aa, Gossypium hirsutum
MGRVRTKTVKKSSRQVIERYYSRMTLDFHTNKKIIEEVAIIPSKRLRNKIAGFSTHLMKRIQKGPVRGISLKLQEEERERRMDFVPDESAIKVDQIEVDKETLDMLSVLGMADIPGLVKVDPVAVAVPQIGFGRGGGPGRRF

SEQ ID NO: 8641 - protein, 142 aa, Gossypium hirsutum
MGRVRTKTVKKSSRQVIERYYSRMTLDFHTNKKIIEEVAIIPSKRLRNKIAGFSTHLMKRIQKGPVRGISLKLQEEERERRMDFVPDESAIKVDQIEVDKETLDMLSVLGMGDIPGLVKVDPVAVSVPQVGFGRGGGPGRRF

SEQ ID NO: 8642 - protein, 147 aa, Taraxacum officinale
MGRVRTKTVKKSSRLVIERYYSKMTLDFHTNKKILEEVAIIPSKRLRNKIAGFSTHLMKRIQKGPVRGISLKLQEEERERRMDFVPDESAIKTDRIEVDKETIDLLASLGMSDLPGIVVKEDTPLAATIPGAYGGGRGGFGGGARRY

SEQ ID NO: 8643 - protein, 142 aa, Heritiera littoralis
MSRVRTKTVKKSSRQVIEKYYSRMTLDFHTNKKIIEEVAIIPSKRLRNKIAGFSTHLMKRIQKGSVRGISLKLQEEERERRMDFVPDESAIKVDQIEVDEETLDMLSVLGMSDIPGLVKVDPVAVPAPQLGFGRGGGPGRRF

SEQ ID NO: 8644 - protein, 754 aa, Jatropha curcas
MCCPERGGLNDYSFAGTRSQILVDRDPINTSFEEWARPGHFSSTIAKGPDTTTWIWNLHADAHDFDSHTSDLEEISRKVFSAHFGQLSIIFLWLSGMYFHGARFSNYEAWLSDPTHIGPSAQVVWPIVGQEILNGDVGGGFRGIQITSGFFQLWRASGITSELQLYCTAIGALVFATLMLFAGWFHYHKAAPKLAWFQDVESMLNHHLAGLLGLGSLSWAGHQVHVSLPINQFLNAGVDPKEIPLPHEFILNRDLLAQLYPSFAEGATPFFTLNWSKYSEFLTFRGGLDPVTGGLWLTDIAHHHLAIAILFLIAGHMYKTNWGIGHGIKDILEAHKGPFTGQGHKGLYEILTTSWHAQLSLNLAMLGSLTIVVAHHMYSMPPYPYLATDYGTQLSLFTHHMWIGGFLIVGAAAHAAIFMVRDYDPTTRYNDLLDRVLRHRDAIISHLNWVCIFLGFHSFGLYIHNDTMSALGRPQDMFSDTAIQLQPVFAQWIQNTHALAPGATASTSLTWGGGDLVAVGGKVALLPIPLGTADFLVHHIHAFTIHVTVLILLKGVLFARSSRLIPDKANLGFRFPCDGPGRGGTCQVSAWDHVFLGLFWMYNSISVVIFHFSWKMQSDVWGSISDQGVVTHITGGNFAQSSITINGWLRDFLWAQASQVIQSYGSSLSAYGLFFLGAHFVWAFSLMFLFSGRGYWQELIESIVWAHNKLKVAPATQPRALSIIQGRAVGVTHYLLGGIATTWAFFLARIIAVG

SEQ ID NO: 8645 - protein, 141 aa, Elaeis guineensis
MGRVRTKTVKKSSRQVIERYYSRMTLDFHTNKKILEEVAIIPSKRLRNKIAGFSTHLMRRIQRGPVRGISLKLQEEERERRMDFVPDESAIKVDHIEVDKETMEMLTSLGMADLPGVEKQADAPAVPIYSGRPGGYGGRRL

SEQ ID NO: 8646 - protein, 135 aa, Glycine max
MGRVRTKTVKKSSRQVIERYYSRMTLDFHTNKKLLEEVAIIPSKRLRNKIAGFSTHLMKRIQKGPVRGISLKLQEEERERRMDFVPDVSAINTDHIEVDKETLDMLHSLGINDIPGITQVDPVPVQQAFPFTRRY

SEQ ID NO: 8647 - protein, 139 aa, Fagopyrum esculentum
MGRVRTKLVKKSSRQVIEKYYSRMTLDFHTNKKLLEEVAIIPTKRLRNKIAGFSTHLMKRIQKGPVRGISLKLQEEERERRMDYVPEESAIKTDIISVDAETIEMIAALGMADIPGIVKAEPESMAPPPFARGGGGRRY

SEQ ID NO: 8648 - protein, 138 aa, Fagopyrum esculentum
MGRVRTKLVKKSSRQVIEKYYSRMTLDFHTNKKLLEEVAIIPTKRLRNKIAGFSTHLMKRIQKGPVRGISLKLQEEERERRMDYVPEESAIKTDLISVDAETIEMIAALGMADIPGIVKAEPESMAPPPFARGGGRRY

SEQ ID NO: 8649 - protein, 146 aa, Flaveria ramosissima
MGRVRTKTVKKSSRQVIERYYSKMTLDFHTNKKILEEVAIIPSKRLRNKIAGFSTHLMKRIQKGPVRGISLKLQEEERERRMDFVPDESAIKTDRIEVDKETIDLLASLGMSELPGIVLKEDTPAMSSSSSRGYGGGRGGIWWWWK

SEQ ID NO: 8650 - protein, 144 aa, Ricinus communis
MGRVRTKTVKKSSRQVIERYYSKMTLDFHTNKKILEEVAIIPSKRLRNKIAGFSTHLMKRIQKGPVRGISLKLQEEERERRMDFVPEVSAIKTDQIEVDKETIDMLAALGMGDMPGLVQVDPVAAVPVAQFGFGRGAGGPGRRF

SEQ ID NO: 8651 - protein, 144 aa, Cryptomeria japonica
MGRVRTKTVKKSSRQVIERYYSRMTLDFHTNKKIVEEVAIIPSKRLRNKIAGFSTHLMKRIQRGPVRGISLKLQEEERERRMDFVPEESAIKTDVIEVDKETIDMLASLGMSDLPGVVKQADPPVGGGFRPGGFQAGGAPGRRL

SEQ ID NO: 8652 - protein, 139 aa, Cucumis sativus
MGRVRTKTVKKSSRQVIERYYSRMTIDFHTNKKILEEVAIIPSKRLRNKIAGFSTHLMKRIQKGPVRGISLKLQEEERERRMDFVPDVSAIKTEQIEVDKETLDMLSALGMNDIPGLVQVDPTVPQQVGFGLGGRGRRY

SEQ ID NO: 8653 - protein, 144 aa, Vitis vinifera
MGRVRTKTVKKSSRQVIERYYSRMTLDFHTNKKILEEVAIIPSKRLRNKIAGFSTHLMKRIQKGPVRGISLKLQEEERERRMDFVPDESAIKTDVIKVDKETIDMLSALGMAELPGVVETEPEVVAPAMVFGRGGAGGAGGRRY

SEQ ID NO: 8654 - protein, 144 aa, Arachis hypogaea
MGRVRTKTVKKSSRQVIERYYSRMTLDFHTNKKVLEEVALIPSKRLRNKIAGFSTHLMKRIQKGPVRGISLKLQEEERERRMDFVPDVSAIDIQHIEVDKETIDMLQSLGMSDVPGITQVDPVPVQQIPFGRPGAGFGGAQRRY

SEQ ID NO: 8655 - protein, 656 aa, Arabidopsis lyrata
MKEAIRMVLESIYDPEFPDTSHFRSGQGCHSVLRRIKEEWGISRWFLEFDIRKCFHTIDRHRLIQILKEEIDDPKFFYSIQKVFSAGRLVGVERGPYSVPHSVLLSALPGNIYLHKLDQEIGRIRQKYEIPIVQRVRSVLLRTGRRIDDQENPGEEASFNAPQDNRAIIVGSVKSMQRKAAFHSLVSSWHTPPTSTLRLRGDQKRPFVFPPSSALAVFLNKPSSLLCAAFLIEAAGLTPKAEFYGGERCNNNWAMRDLLKYCKRKGLLIELGGEAILVIRSERGLARKQAPLKTHYLIRICYARYADDLLLGIVGAVELLIEIQKRIAHFLQSGLNLWVGSAGSTTIAARSTVEFLGTVIREVPPRTTPIQFLRELEKRLRVKHRIHITACHLRSAIHSKFRNLGDSIPIKQLTKGMSKTGSLQDGVQLAETLGTAGVRSPQVSVLWGTVKHIRQGSRGISFLHSSGRSNASSDVQQVVSRSGTHARKLSLYTPPGRKAAGEGGGHWAGSISSEFPIKIEAPIKKILRRLRDRGIISRRRPWPIHVACLTNVSDEDIVNWSAGIAISPLSYYRCRDNLYQVRTIVDHQIRWSAIFTLAHKHKSSAPNIILKYSKDSNIVNQEGGKILAEFPNSIELGKLGPGQDLNKKEHSTTSLV

SEQ ID NO: 8656 - protein, 118 aa, Ricinus communis
MSEFSPICIYLVISPLVSLIPLGVPFPFASNSSTYPEKLSAYECGFDPSGDARSRFDIRFYLVSILFIILDPEVTFFFPWAVPPNKIDLFGFWSMMAFLLILTIGSLYEWKRGASDRE

SEQ ID NO: 8657 - protein, 125 aa, Ricinus communis
MPTLNQLIRHGREEKRRTDRTRASDQCPQKQGVRPRVSTRTPKKPNSALRKIAKVRLSNRHDIFAHIPGEGHNLQEHSMVLIRGGRVKDSPGVKSHCIRGVKDLLGIPDRRRGRSKYGAEKPKSI

SEQ ID NO: 8658 - protein, 272 aa, Ricinus communis
MIVLEWLFLTISPCDAAEPWQLGSQDAASPMMQGIMDLHHDIFFFLILILVFVLRILVRALWHFHYQKNPIPQRIVHGTTIEILRTIFPSIIPMFIAIPSFALLYSMDEVIVDPAITIKAIGHQWYRTYEYSDYNSSDEQSLTFDSYTIPEDDLEFGQSRLLEVDNRVVVPAKTHLRIIVTSADVPHSWAVPSSGVKCDAVPGRLNQISISVQREGVYYGQCSEICGTNHAFMPIVVEAVPGKDYGDWVSNQLIPQTGGAESYHSPPSGSGD

SEQ ID NO: 8659 - protein, 125 aa, Oryza sativa
MPTKNQLIRHGREEKQRTDRTRASDQCPQKQGVCLRVSTRTPKKPNSALRKIAKVRLSNRHDIFAHIPGEGHNSQEHSIVLVRGGRVKDSPGVKSHRIRGVKDLLGIPDRRKGRSKYGAERPKSK

SEQ ID NO: 8660 - protein, 155 aa, Oryza sativa
MDNIFFGVYNARNGYESATVLQGIRIDLAINGYESAFLSEFAPICIYLVISPLVSLIPLGVPFPFASNSSTYPEKLSAYECGFDPSGDARSRFDIRFYPVPILFIIPDLEVTFFFPWAVPPNKIDLFGSWSMMAFLLILTIGFLYEWKRGASDRE

SEQ ID NO: 8661 - protein, 118 aa, Citrullus lanatus
MSEFAPICIYLVISPLVSLIPLGVPFPFASNSSTYPEKLSAYECGFDPSGDARSRFDIRFYLVSILFIILDPEVTFSFPWAVPLNKIDLFGSWSMMAFLLILTIGFLYEWKRGASDRE

SEQ ID NO: 8662 - protein, 125 aa, Theobroma cacao
MPTLNQLIRHGREEKRRTDRTRASDQCPQKQGVCPRVSTRTPKKPNSALRKIAKVRLSNRHDIFAYIPGEGHNSQEHSMVLIRGGRVKDLPGVKSHCIRGVKDLLGIPDRRRGRSKYGAEKPKSR

SEQ ID NO: 8663 - protein, 125 aa, Medicago truncatula
MPTLNQLIRHGREEKRRTDRTRASDQCPQKQGVRPRVFKRTPKKPNSAQRKIAKVRLSNRHDIFAHIPGEGHNSQEHSTVLIRGGRVKDLPGVKSHCIRGVKDLLGIPDRRRGRSKYGAEKPKSI

SEQ ID NO: 8664 - protein, 125 aa, Unknown
  Sequence found in Organisms: Sorghum bicolor, Brachypodium distachyon, Setaria italica
MPTKNQLIRHGREEKRRTDRTRASDQCPQKQGVCLRVSTRTPKKPNSALRKIAKVRLSNRHDIFAHIPGEGHNSQEHSIVLVRGGRVKDSPGVKSHRIRGVKDLLGIPDRRKGRSKYGAERPKSK

SEQ ID NO: 8665 - protein, 206 aa, Vitis vinifera
MRRLFLEQYHKRIFLSTPITSFFPFLSYIVVTPLMLGFEKDFSCHSNLGPIRIPPLFPFPPAPFPRNEKDDGTLELYYISTSCLPKILLLQLVGHRVFQISRVLSGFPMLLLPYQFGRSGINRLNIFCGSLVLTLMCGILSRLAFGITSCSGWNSSQNPSTSPTLLPPTLYRTFLETEWFHAPSSIGYSSSFVSFFSMSVSISSQD

SEQ ID NO: 8666 - protein, 118 aa, Vitis vinifera
MSEFAPICIYLVISPLVSLIPLGVPFPFASNSSTYPEKLSAYECGFDPFGDARSRFDIRFYLVSILFIIPDPEVTFSFPWAVPPNKIDPFGSWSMMAFLLILTIGSLYEWKRGASDRE

SEQ ID NO: 8667 - protein, 118 aa, Sorghum bicolor
MSEFAPICIYLVISPLVSLIPLGVPFPFASNSSTYPEKLSAYECGFDPSGDARSRFDIRFYPVPILFIIPDPEVTFSFPWAVPPNKIDLFGSWSMMAFLLILTIGSLYEWKRGASDRE

SEQ ID NO: 8668 - protein, 118 aa, Cannabis sativa
MSEFAPICIYLVISLLVSLIPLGVPFPFASNSSTYPEKLSAYECGFDPFGDARSRFDIRFYLVSILFIILDPEVTFSFPWAVPLNKIDPFGSWSMMAFLLILTIGSLYEWKRGASDRE

SEQ ID NO: 8669 - protein, 118 aa, Lotus japonicus
MSEFAPICIYLVISLLVSLIPLGLPFPLASNSSTYPEKLSAYECGFDPFGDARSRFDIRFYLVSILFIIPDPEVTFSFPWAVPPNKIDPFGSWSMMAFLLILTIGSLYEWKRGASDRE

SEQ ID NO: 8670 - protein, 265 aa, Cannabis sativa
MIESQRHSYHLVDPSPWPISGSLGALATTVGGVMYMHSFQGGATLLSLGIIFILYTMFVWWRDVLRESTLEGHHTKVVQLGLRYGFLLFIVSEVMFFFAFFWAFFHSSLAPTVEIGGIWPPKGIGVLDPWEIPFLNTLILLSSGAAVTWAHHAILAGKEKRAVYALVATVLLALVFTGFQGMEYYQAPFTISDSIYGSTFFLATGFHGFHVIIGTLFLIICGIRQYLGHLTKEHHVGFEAAAWYWHFVDVVWLFLFVSIYWWGGI

SEQ ID NO: 8671 - protein, 125 aa, Cucumis sativus
MPTLNQLIRHGREEKRRTDRTRASDQCPQKQGVRPRLATRTPKKPNSAPRKIAKVRLSNRHDIFAHIPGEGHNLQEHSMVLIRGGRVKDSPGVKSHCIRGVKDLLGIPDRRRGRSKYGAEKPKSI

SEQ ID NO: 8672 - protein, 125 aa, Malus domestica
MPTLNQLIRHGREEKRRTDRTRASDQCPQKQGVCPRVSTRTPKKPNSAPRKIAKVRLSNRHDIFAHIPGEGHNLQEHSMVLIRGGRVKDLPGVKFHCIRGVKDLLGIPDRRRGRSKYGAEKPKSR

SEQ ID NO: 8673 - protein, 131 aa, Solanum lycopersicum
MPTLNQLIRHGREEKWRTDRTRALDQCPQKQGLCPRVSMRTPKKPNSALRKIAKVRLSNRHDIFAHIPDEGHNLQEHSMVLIRGGRVKDLPGVKFHCIRGVKDLLGIPDRRRGRSKYGAEKHKIDMNGRCL

SEQ ID NO: 8674 - protein, 119 aa, Lotus japonicus
MSEFAPICIYLVISLLVSLIPLGLPFPLASNSSTYPEKLSAYECGFDPFGDARSRFDIRFYLVSILFIIPDPEVTFSFPWAVPPNKIDPFGSWSMMAFLLILTIGSLYEWKGVLRIGSN

SEQ ID NO: 8675 - protein, 337 aa, Arabidopsis lyrata
MAGKEETNVSAQGSLTREATEIWKSELESRRLQVDSLEAELVDVKAYLEFGSEEDARKELGVLSGRVRSTATMLRYLRSKARILAIPDDLPNVSCGVEQIELKGLNFLEKDGGSSSSGGASNTSPETRRYRGSLGIEDGAYTNEMLQSIEMVTDVLDSLVRRVTAAESETAVQKERALLGEEEISRKTIQIENLSLKLEEMERFAYGTNSVLNEMRERIEELVEETMRQREKAVENEEELCRVKREFESLKSYVSTFTNVRETLLSSERQFKTIEELFERLVTKTTQLEGEKAQKEVEVQKLMEENVKLTALLDKKEAQLLALNEQCKVMALSASNI

SEQ ID NO: 8676 - protein, 333 aa, Eutrema parvulum
MACKEGTNISAQESLTGEATEIWKSELESRRFQVDSLEAELLNVKAYLDFGSEEDARKELGVLLGRVRTTATMLRYLKSKARILAIPDLAHLSCGVEQMELKGLNFLEKDGGSSSCEDTLTEVRRHRGSLGIEDGAYTSEMLQSIEMVTDVLESLVRRVTAAESETAVQKEMVLLGEEELSRKTVQIENLSIKLEEMERFAHGTNSVLNEMRERIEDLVEETMRQREKAVENEEELCRVKREFESLKTYVSTFTNVRETLLSSERQFKTIEELFERLVTKTTQLEGEKAQKEVEVQKLMEENVKLTALLDKKEAQLLALNEQCKVMALSASNI

SEQ ID NO: 8677 - protein, 318 aa, Arabidopsis lyrata
MAGREDTNASAQEFLNREATEIWKSELESRRLQVDSLEAELVDVNAYLEFGSEEDARKELGVLSGRVRSTATMLRYLRSKAGNLAIPDLANVSSGKDGGSSSEGERNTRRYHGSLGVEDGAYTNEMLQSIEMVTDVLESLVRRVTAAESETAVQKEKALLGEEEISRKTVQIENLSSKLEEMERFAHGTNSVLNEMRERIEELVEETMRQREKAKENEEELWRVKREFESLKSYVSTFTNVRETLLSSERQFKTIEELFERLVTKTTQLEGEKAQKEVEVQKLMEENVKLTALLDKKEAQLLALNEQCKVMALSASNI

SEQ ID NO: 8678 - protein, 322 aa, Eutrema halophilum
MACKEDTNSSAQESLTKEESELESHRFQVDSLEAELLNVKAYLEFGSEEDARKELVDLSGRVRETATILRYLRSKARILAIPSLAHVEQMGLKGLDLVEKDGDSSSSEDAARRHRDGSSGVEDGAYTSEMLQSIEMVTDVLESLVRRVTAAESETAVQKEMVLLGEEELSRKTVQIENLSSKLQEMERFAHGTNSVLNEMRERIEELVEETMRQREKAVENEEELCRVKREFESLKSYVSTFTNVRETLLSSERQFKTIEELFERLVTKTTQLEGEKAQKEVEVQKLMEENVKLTALLDKKEAQLLALNEQCKVMALSASNI

SEQ ID NO: 8679 - protein, 321 aa, Brassica napus
MACKEDTNASAQESLTREDSEICRTELESRRFQVDSLEAELMDVKACLEFGSEEDARKELGVLSGRVRTTATMLRYLRSKATVLAIPDLSQMVLKDGGGSSSCEDTLSEARRHCGGSLGIEDGAYTSEMLQSIEMVTNVLEFLVKRVSVAESETAVQKEMVLLGEEELSKKTVQIENLAVKLQEMERFAHGTNSVLSEMRERIEELVEETMRQREKAVENEEELCRVKREFESLKSYVSTFTNVRETLLSSERQFKTIEELFERLVSKTTQLEEEKAQKEVEVQKLMEENVKLTALLDKKEAQLLALNEQCKVMALSASNI

SEQ ID NO: 8680 - protein, 192 aa, Arabidopsis lyrata
MSSVCGKLDFQDADFDISSPTQCSKGSKHTSFTASEDSQESDGDETGYIDPTAYEETAVQDFGKSTLSPNSLDDEDKDENLTTQTPIVLIPAIKGSREKHGLSLRKSSVSWAADVYDPPPSIASHTVTRSKKQQQKSKSKDNHRKTGKKGQKSKDNSSSRGGSSKDKKQASRKHSRDKFEWVTQMPIVAASS

SEQ ID NO: 8681 - protein, 245 aa, Arabidopsis lyrata
MAPRGRRKKPGLMREDAARDRMRVFGFHERVISESIKELLEVYGEDQWFLIEDDSYGPLLAICLEKQAEKDKQLAEVQAYQLPENQDEEMAEEEQPNQLAEEEQEEEKEQEQDMQIEYGRDQADKLSINSDAVMDPSPAALHLGEALADYAQGSVGGVENLHCGWLSSEEETDPEEETDPKEKETEPEEEETNPKEKETEPEEDSDGDDDEIIQLTPEPLCEELQELLREVRGQKRRKKETRWDK

SEQ ID NO: 8682 - protein, 131 aa, Arabidopsis thaliana
MTFKRRNGGRNKHNRGHVNPIRCSNCGKCCPKDKAIKRFIVRNIVEQAAIRDVQEASVYEGYTLPKLYAKTQYCVSCAIHSHVVRVRSRTNRRVRTPPPRFTRRKEDTPKPGQPGQAPRPAGPGAAAAPRV

SEQ ID NO: 8683 - protein, 131 aa, Arabidopsis lyrata
MTFKRRNGGRNKHNRGHVKPIRCSNCGKCCPKDKAIKRFIVRNIVEQAAIRDVQEASVYEAYTLPKLYAKTQYCVSCAIHSHVVRVRSRTNRRVRTPPPRFARRKEDTPKPGQPGQAPRPAGPGAAAAPRA

SEQ ID NO: 8684 - protein, 131 aa, Arabidopsis lyrata
QTFKRRNGGRNKHNRGHVKPIRCSNCGKCCPKDKAIKRFIVRNIVEQAAIRDVQEASVYEAYTLPKLYAKTQYCVSCAIHSHVVRVRSRTNRRVRTPPPRFARRKEDTPKPGQPGQAPRPAGPGPAAAPRV

SEQ ID NO: 8685 - protein, 130 aa, Unknown
  Sequence found in Organisms: Thellungiella halophila, Eutrema halophilum
MTFKRRNGGRNKHNRGHVNPIRCSNCGKCCPKDKAIKRFIVRNIVEQAAIRDVQEASVYDGYTLPKLYAKMQYCVSCAIHSHVVRVRSRTNRRVRTPPPRFARRKEDTPKPGQPGQAPRPAGGAPAAPRA

SEQ ID NO: 8686 - protein, 130 aa, Arabidopsis lyrata
MTFKRRNGGRNKHNRGHVNPIRCSNCGKCCPKDKAIKRFIVRNIVEQAAIRDVQEASVYEAYTLPKLYAKMQYCVSCAIHSHVVRVRSRTNRRVRTPPPRFARRKEDTPKPGQPGQAPRPAGGAPAAPRA

SEQ ID NO: 8687 - protein, 130 aa, Arabidopsis thaliana
MTFKRRNGGRNKHNRGHVKPIRCSNCGKCCPKDKAIKRFIVRNIVEQAAIRDVQEASVYEGYTLPKLYAKTQYCVSCAIHSHVVRVRSRTNRRVRTPPPRFARRKEDTPKPAQPGQAPRPAGGAPAAPRA

SEQ ID NO: 8688 - protein, 131 aa, Raphanus sativus
MTFKRRNGGRNKHNRGHVNPIRCSNCGKCCPKDKAIKRFIVRNIVEQAAIRDVQEASVYDGYTLPKLYAKTQYCVSCAIHSHVVRVRSRTNRRVRTPPPRFVRRKEDAPKPGQPGQAARPAGGAPAAAARA

SEQ ID NO: 8689 - protein, 130 aa, Raphanus sativus
MTFKRRNGGRNKHNRGHVNPIRCSNCGKCCPKDKAIKRFIVRNIVEQAAIRDVQEASVYDGYTLPKLYAKTQYCVSCAIHSHVVRVRSRTNRRVRTPPPRFVRRKEDAPKPGQPGQAPRPAGAGAAAPRT

SEQ ID NO: 8690 - protein, 129 aa, Unknown
  Sequence found in Organisms: Brassica napus, Brassica juncea, Brassica oleracea, Brassica rapa
MTFKRRNGGRNKHNRGHVKPIRCSNCGKCCPKDKAIKRFIVRNIVEQAAIRDVQEASVYDGYTLPKLYAKTQYCVSCAIHSHVVRVRSRTNRRVRTPPPRFVRRKEDAPKPGQPGQAPRPAGAAAAPRA

SEQ ID NO: 8691 - protein, 131 aa, Unknown
  Sequence found in Organisms: Thellungiella halophila, Eutrema halophilum
MTFKRRNGGRNKHNRGHVNPIRCSNCGKCCPKDKAIKRFIVRNIVEQAAIRDVQEASVYDGYTLPKLYSKVQYCVSCAIHSHVVRVRSRTNRRVRTPPPRFARRKEDAPKPGQPGQAPRPAGAGPGAAPRV

SEQ ID NO: 8692 - protein, 130 aa, Brassica juncea
MTFKRRNGGRNKHNRGHVNPIRCSNCGKCCPKDKAIKRFIVRNIVEQAAIRDVQEASVYDGYTLPKLYAKTQYCVSCAIHSHVVRVRSRTNRRVRTPPPRFVRRKEDAPKPGQPGQAPRPAGAGAAAPRA

SEQ ID NO: 8693 - protein, 130 aa, Unknown
  Sequence found in Organisms: Brassica napus, Brassica rapa
MTFKRRNGGRNKHNRGHVNPIRCSNCGKCCPKDKAIKRFLVRNIVEQAAIRDVQEASVYDGYTLPKLYAKMQYCVSCAIHSHVVRVRSRTNRRVRTPPPRFARRKEDTPKPGQPGQAPRPAGGAPAAPRA

SEQ ID NO: 8694 - protein, 130 aa, Raphanus sativus
MTFKRRNGGRNKHNRGHVNPIRCSNCGKCCPKDKAIKRFIVRNIVEQAAIRDVQEASVYDGYTLPKLYAKTQYCVSCAIHSHVVRVRSRTNRRVRTPPPRFVRRKEDAPKPGQPGQAPRPAGGAPAAPRT

SEQ ID NO: 8695 - protein, 130 aa, Unknown
  Sequence found in Organisms: Brassica napus, Brassica juncea, Brassica rapa
MTFKRRNGGRNKHNRGHVKPIRCSNCGKCCPKDKAIKRFIVRNIVEQAAIRDVQEASVYDGYTLPKLYAKTQYCVSCAIHSHVVRVRSRTNRRVRTPPPRFVRRKEDAPKPGQPGQAPRPAGAGAAAPRA

SEQ ID NO: 8696 - protein, 130 aa, Brassica juncea
MTFKRRNGGRNKHNRGHVNPIRCSNCGKCCPKDKAIKRFLVRNIVEQAAIRDVQEASVYDGYTLPKLYSKMQYCVSCAIHSHVVRVRSRTNRRVRTPPPRFARRKEDTPKPGQPGQAPRPAGGAPAAPRA

SEQ ID NO: 8697 - protein, 130 aa, Brassica juncea
MTFKRRNGGRNKHNRGHVNPIRCSNCGKCCPKDKAIKRFIVRNIVEQAAIRDVQEASVYDGYTLPKLYAKTQYCVSCAIHSHVVRVRSRTNRRVRTPPPRFVRRKEDAPKPGQPGQAPRPAGAGTAAPRA

SEQ ID NO: 8698 - protein, 130 aa, Unknown
  Sequence found in Organisms: Brassica napus, Brassica oleracea
MTFKRRNGGRNKHNRGHVNPIRCSNCGKCCPKDKAIKRFLVRNIVEQAAIRDVQEASVYDGYTLPKLYAKMQYCVSCAIHSHVVRVRSRTNRRVRTPPPRFARRKEDTPKPGQPGQPPRPAGGAPAAPRA

SEQ ID NO: 8699 - protein, 130 aa, Brassica napus
MTFKRRNGGRNKHNRGHVNPIRCSNCGKCCPKDKAIKRFLVRNIVEQAAIRDVQEASVYDGYTLPKLYAKMQYCVSCAIHSHVVRVRSRTNRRVRTPPPRFARRKEDAPKPGQPGQAPRPAGGAPAAPRA

SEQ ID NO: 8700 - protein, 129 aa, Raphanus sativus
MTFKRRNGGRNKHNRGHVNPIRCSNCGKCCPKDKAIKRFIVRNIVEQAAIRDVQEASVYDGYTLPKLYAKTQYCVSCAIHSHVVRVRSRTNRRVRTPPPRFVRRKEDAPKPGQPGQAPRPAGAGAAPRA

SEQ ID NO: 8701 - protein, 130 aa, Raphanus sativus
MTFKRRNGGRNKHNRGHVNPIRCSNCGKCCPKDKAIKRFLVRNIVEQAAIRDVQEASVYDGYTLPKLYSKVQYCVSCAIHSHVVRVRSRTNRRVRTPPPRFARRKEDTPKPGQPGQAPRPAGGAPAAPRT

SEQ ID NO: 8702 - protein, 130 aa, Unknown
  Sequence found in Organisms: Brassica napus, Brassica juncea, Brassica oleracea, Brassica rapa
MTFKRRNGGRNKHNRGHVKPIRCSNCGKCCPKDKAIKRFIVRNIVEQAAIRDVQEASVYDGYTLPKLYAKTQYCVSCAIHSHVVRVRSRTNRRVRTPPPRFVRRKEDAPKPGQPGQAARPAGGAPAAPRA

SEQ ID NO: 8703 - protein, 129 aa, Brassica juncea
TFKRRNGGRNKHNRGHVNPIRCSNCGKCCPKDKAIKRFLVRNIVEQAAIRDVQEASVYDGYTLPKLYAKMQYCVSCAIHSHVVRVRSRTKRRVRTPPPRFARRKEDTPKPGQPGQAPRPAGGAPAAPRA

SEQ ID NO: 8704 - protein, 130 aa, Unknown
  Sequence found in Organisms: Brassica juncea, Brassica rapa
MTFKRRNGGRNKHNRGHVKPIRCSNCGKCCPKDKAIKRFIVRNIVEQAAIRDVQEASVYDGYTLPKLYAKTQYCVSCAIHSHVVRVRSRTNRRVRTPPPRFVRRKEDAPKPGQPGQAPRPAGGAPAAARA

SEQ ID NO: 8705 - protein, 130 aa, Brassica juncea
MTFKRRNGGRNKHNRGHVNPIRCSNCGKCCPKDKAIKRFIVRNIVEQAAIRDVQEASVYDGYTLPKLYAKMQYCVSCAIHSHVVRVRSRTNRRVRTPPPRFVRRKEDAPKPGQPGQAARPAGGAPAAPRA

SEQ ID NO: 8706 - protein, 130 aa, Raphanus sativus
MTFKRRNGGRNKHNRGHVNPIRCSNCGKCCPKDKAIKRFIVRNIVEQAAIRDVQEASVYDGYTLPKLYAKTQYCVSCAIHSHVVRVRSRTNRRVRTPPPRFVRRKEDAPKPGQPGQAARPAGGAPAAARA

SEQ ID NO: 8707 - protein, 130 aa, Brassica napus
MTFKRRNGGRNKHNRGHVKPIRCSNCGKCCPKDKAIKRFIVRNIVEQAAIRDVQEASVYDGYTLPKLYAKTQYCVSCAIHSHVVRVRSRTNRRVRTPPPRFVRRKEDAPKPGQPGQAARPAGGAPAAARA

SEQ ID NO: 8708 - protein, 124 aa, Brassica juncea
MTFKRRNGGRNKHNRGHVNPIRCSNCGKCCPKDKAIKRFLVRNIVEQAAIRDVQEASVYDGYTLPKLYAKMQYCVSCAIHSHVVRVRSRTNRRVRTPPPRFARRKEDTPKPGQPGQAPRPAGGA

SEQ ID NO: 8709 - protein, 130 aa, Brassica rapa
MTFKRRNGGRNKHNRGHVNPIRCSNCGKCCPKDKAIKRFLVRNIVEQAAIRDVQEASVYDGYTLPKLYAKMQYCVSCAIHSHVVRVRSSTNRRVRTPPPRFARRKEDAPKPGHPGQAPRPAGGAPAAPRA

SEQ ID NO: 8710 - protein, 129 aa, Brassica napus
TFKRRNGGRNKHNRGHVNPIRCSNCGKCCPKDKAIKRFLVRNIVEQAAIRDVQEASVYDGYTLPKLYAKMQYCVSCAIHSHVVRVRSSTNRRVRTPPPRFARRKEDAPKPGQPGQAPRPAGGAPAAPRA

SEQ ID NO: 8711 - protein, 76 aa, Brassica napus
GRVTLAADTHTHSSPEERSLSRRRRAKKMTFKRRNGGRNKHNRGHVKPIRCSNCGKCCPKDHQEVYREEHCGAGCY

SEQ ID NO: 8712 - protein, 129 aa, Brassica juncea
MTFKRRNGGRNKHNRGHVNPIRCSNCGKCCPKDKAIKRFLVRNIVEQAAIRDVQEASVYDGYTLPKLYSKMQYCVSCAIHSHVVRVRSRTNRRVRTPPPRFVRRKDDAPKPGQPGQAPRPAGGAPAARA

SEQ ID NO: 8713 - protein, 139 aa, Eutrema parvulum
MTFKRRNGGRNKHNRGHVKPIRCSNCGKCCPKVLTNSPPGTLWSRLPLEMFRKPASTMGTHCRSCMRRRNTVSHVPSILTLLESDPAPTVGFVLRRRVLPDARRMLPSQDSLVRLLVLQDLELELHRVPEASAYLNFSF

SEQ ID NO: 8714 - protein, 129 aa, Cleome spinosa
MTFKRRNGGRNKHNRGHVNFIRCSNCGKACPKDKAVKRFIVRNIVEQAAIRDVQEASVYDGYALPKLYAKLQHCISCAIHSHVVRVRSRTNRRVRTPPQRFARRREDMPKPGQPGQAPRVPGAGAAPRT

SEQ ID NO: 8715 - protein, 129 aa, Cleome spinosa
MTFKRRNGGRNKHNRGRCQFIRCSNCGKCCPKDKAVKRFIVRNIVEQAAIRDVQEASVYDGYTLPKLYAKMQYCISCAIHSHVVRVRSRTNRRVRTPPQRFARRREDMPKPGQPGQAPRVPGAGAAPRT

SEQ ID NO: 8716 - protein, 69 aa, Brassica napus
MTFKRRNGGRNKHNRGHVKPIRCSNCGKCCPKDKAIKRFIVRNIVEQAAIRDVQEASVYDGYTLPNVVR

SEQ ID NO: 8717 - protein, 129 aa, Arachis hypogaea
MTFKRRNGGRNKHGRGHVKFIRCSNCGKCCPKDKSIKRFLVRNIVEQAAVRDVQEACVYEQYTLPKLYVKMQYCVSCAIHSHVVRVRSRTDRRNREPPQRFARRRDDAPRPGQPGQAPRPAGAGAAPRV

SEQ ID NO: 8718 - protein, 127 aa, Zostera marina
MTFKRRNGGRNKHGRGHVNFIRCSNCGKCCPKDKAIKRFLVRNIVEQAAVRDVQEACVYEGYTLPKLYAKMQYCVSCAIHSHVVRVRSRENRRNREPPQRFRRKDDTNKPGQPPRPAGAPGAPPPRQ

SEQ ID NO: 8719 - protein, 129 aa, Euonymus alatus
MTFKRRNGGRNKHGRGHVKFIRCSNCGKCCPKDKAIKRFLVRNIVEQAAVRDIQEAGVYEQYTLPKLYAKMQYCVSCAIHSHVVRVRSRTNRRVREPPQRFIRRRDDMPKPGQPGQAPRPAGAGNPVRA

SEQ ID NO: 8720 - protein, 129 aa, Fagus grandifolia
MTFKRRNGGRNKHGRGHVKFIRCSNCGKCCPKDKAIKRFLVRNIVEQAAVRDVQEACVYDQYVLPKLYAKMQYCVSCAIHSHVVRVRSRTNRRKREPPQRFQRRREDTPRPGQPGQAPRPAGAGNPARA

SEQ ID NO: 8721 - protein, 126 aa, Eschscholzia californica
MTFKRRNGGRNKHGRGHVKFIRCSNCGKCCPKDKAIKRFLVRNIVEQAAVRDVQEACVYEGYTLPKLYAKMQYCVSCAIHSHVVRVRSRTDRRNRAPPQRFRRKEDTPKPAQAPRPAATTANPPRA

SEQ ID NO: 8722 - protein, 132 aa, Arachis hypogaea
MTFKRRNGGRNKHGRGHVKFIRCSNCGKCCPKDKSIKRFLVRNIVEQAAVRDVQEACVYEQYTLPKLYVKMQYCVSCAIHSHVVRVRSRTDRRNREPPQRFARRRDDAPRPGQPGQAPRPIGVGAGAGAARA

SEQ ID NO: 8723 - protein, 132 aa, Chelidonium majus
MTFKRRNGGRNKHGRGHTKFIRCSNCGKCCPKDKAIKRFLVRNIVEQAAVRDVQEACVYDGYTLPKLYAKMQYCVSCAIHSHVVRVRSRTNRRNRDPPQRFRRRDDMPKPGQAARPAGGAPAAAAAAQPARV

SEQ ID NO: 8724 - protein, 131 aa, Unknown
  Sequence found in Organisms: Cannabis sativa, Humulus lupulus
MTFKRRNGGRNKHGRGHVKFIRCSNCGKCCPKDKAIKRFLVRNIVEQAAVRDVQEACVYDGYTLPKLYAKMQYCVSCAIHSHVVRVRSRENRRVREPPQRFRRREDTARPGGAPGQAGQRPAGGAPAAART

SEQ ID NO: 8725 - protein, 131 aa, Eschscholzia californica
MTFKRRNGGRNKHGRGHVKFIRCSNCGKCCPKDKAIKRFLVRNIVEQAAVRDVQEACVYEGYTLPKLYAKMQYCVSCAIHSHVVRVRSRTDRRKRDPPQRFRRKEDGPKPGQAPRPAAAAGAGATAIPPRP

SEQ ID NO: 8726 - protein, 130 aa, Cucurbita pepo
MTFKRRNGGRNKHGRGHVKFIRCSNCGKCCPKDKAIKRFLVRNIVEQAAVRDVQEACVYDQYTLPKLYAKMQYCVSCAIHSHVVRVRSRTDRRKRDPPQRFIRRREDAPKPGQPGQAPRVGAGPGAPPRA

SEQ ID NO: 8727 - protein, 132 aa, Arachis hypogaea
MTFKRRNGGRNKHGRGHVKFIRCSNCGKCCPKDKSIKRFLVRNIVEQAAVRDVQEACVYEQYTLPKLYVKMQYCVSCAIHSHVVRVRSRTDRRNREPPQRFARRRDDAPRPGQPGQAPRPIGAGAGAGAARP

SEQ ID NO: 8728 - protein, 131 aa, Cucurbita pepo
MTFKRRNGGRNKHGRGHVKFIRCSNCGKCCPKDKAIKRFLVRNIVEQAAVRDVQEACVYDQYTLPKLYAKMQYCVSCAIHSHVVRVRSRTDRRKREPPQRFIRRRDDMPKPGQPGQAPRVGAGAGAPPPRP

SEQ ID NO: 8729 - protein, 130 aa, Unknown
  Sequence found in Organisms: Medicago truncatula, Trigonella foenum-graecum
MTFKRRNGGRNKHGRGHVKFIRCSNCGKCCPKDKAIKRFLVRNIVEQAAVRDVQEACVYDQYTLPKLYVKMQYCVSCAIHSHVVRVRSRTDRRKREPPQRFIRRRDDAPRPGQPGQAPRPAGPGAPPARA

SEQ ID NO: 8730 - protein, 129 aa, Unknown
  Sequence found in Organisms: Cucumis sativus, Cucumis melo, Citrullus lanatus
MTFKRRNGGRNKHGRGHVKFIRCSNCGKCCPKDKAIKRFLVRNIVEQAAVRDVQEACVYDQYTLPKLYAKMQYCVSCAIHSHVVRVRSRTDRRNRQPPQRFIRRREDQAKPGQPGQAPRPVGAGNPARV

SEQ ID NO: 8731 - protein, 124 aa, Amborella trichopoda
MTFKRRNGGRNKHGRGHVNFIRCSNCGKCCPKDKAIKRFLVRNIVEQAAVRDVQEACVYDGYTLPKLYAKMQYCVSCAIHSHVVRVRSRTDRRNREPPQRFRRRDDAPKPGQAPRPAGAAPARP

SEQ ID NO: 8732 - protein, 129 aa, Malus domestica
MTFKRRNGGRNKHGRGHVKFIRCSNCGKCCPKDKAIKRFLVRNIVEQAAVRDVQEACVYEQYTLPKLYAKMQYCVSCAIHSHVVRVRSRTNRRNREPPQRFIRRRDDAPRPGQPGQAPRPAGAGVPART

SEQ ID NO: 8733 - protein, 128 aa, Beta vulgaris
MTFKRRNGGRNKHGRGHVNFIRCSNCGKCCPKDKAIKRFIVRNIVEQAAVRDVQEACVYDGYVLPKLYTKMQYCVSCAIHSHVVRVRSVTNRRNRDPPQRFPRRKEDTPRPGAPGARPAGAPAAGARA

SEQ ID NO: 8734 - protein, 129 aa, Arachis hypogaea
MTFKRRNGGRNKHGRGHVKFIRCSNCGKCCPKDKSIKRFLVRNIVEQAAVRDVQEACVYEQYTLPKLYVKMQYCVSCAIHSHVVRVRSRTDRRNREPPQRFARRRDDAPRPGQPGQAPRPAGVGAAPRA

SEQ ID NO: 8735 - protein, 130 aa, Arachis hypogaea
MTFKRRNGGRNKHGRGHVKFIRCSNCGKCCPKDKSIKRFLVRNIVEQAAVRDVQEACVYEQYTLPKLYVKMQYCVSCAIHSHVVRVRSRTDRRNREPPQRFARRRDDAPRPGQPGQAPRPAGGVGAAPRA

SEQ ID NO: 8736 - protein, 105 aa, Cajanus cajan
MTFKRRNGGRNKHGRGHVKFIRCSNCGKCCPKDKAIKRFLVRNIVEQAAVRDVQEACVYEQYTLPKLYVKMQYCVSCAIHSHVVRVRSRTDRRKRDPPQRFIRRR

SEQ ID NO: 8737 - protein, 129 aa, Glycine max
MTFKRRNGGRNKHGRGHVKFIRCSNCGKCCPKDKAIKRFLVRNIVEQAAVRDVQEACVYEQYTLPKLYVKMQYCVSCAIHSHVVRVRSRTDRRKREPPQRFIRRRDDAPRPGQPGQAPRPAGVGAPARA

SEQ ID NO: 8738 - protein, 133 aa, Silene vulgaris
MTFKRRNGGRNKHGRGHVKFIRCSNCGKCCPKDKAIKRFLVRNIVEQAAIRDVQEACVYDGYTLPKLYAKTQYCVSCAIHSHVVRVRSRTDRRNREPPKRFMRRRDDTPKPGQPGQPGQAPRPAAGVGNPVRA

SEQ ID NO: 8739 - protein, 131 aa, Humulus lupulus
MTFKRRNGGRNKHGRGHVKFIRCSNCGKCCPKDKAIKRFLVRNIVEQAAVRDVQEACVYDGYTLPKLYAKMQYCVSCAIHSHVVRVRSRENRRVREPPQRFRRREDTARPGGAPGQAGQRPAGGAPAATRT

SEQ ID NO: 8740 - protein, 675 aa, Theobroma cacao
MGDLRVCYPNGDISREDRLCPSPFPSPPFSLSLSNPGQPCSIARESWDSAEETARRIVWSVQPTLDADRKRKEIVEYVQRLIQDGLGYQVFPYGSVPLKTYLPDGDIDLTTLSSPAIEDTLVSDVHAILRGEEHNQKAPYRVKDVHCIDAEVKLVKCLVQDIVVDISFNQLGGLCTLCFLEQIDRLVGKDHLFKRSIILIKAWCYYESRILGAHHGLISTYALETLVLYIFHLFHSSLTGPIAVLYRFLDYFSKFDWENYCISLNGPVCKSSLPDIVAEVPENVGNNPLLSEEFLRKCINMFSVPSKGVETNSRLFPLKHLNIIDPLKENNNLGRSVNRGNYYRIRSAFKYGAHKLEQILILPRERIPDELVKFFANTLERHGSNHLTGMQNLPSTSDARGYDHLAGIFGDSESLKSLLDLTGDYDGQFWSLLYGQYCHLFSVSSPVSPHLQNENHWETIEQSIPLKQDLYSQRDSNGILGSQFCFSKPPVAVHTALDSEDKKKRGTGTYIPSIKYRSNRERHSSGRGIFQASRAYSQLQRYTNNKGSATVQQEMALSQEGSHELSPKEYPALGPVKFGPPNTHPPYPSVWGLCAASGLNCPPERFESESSSLELQSTNMPEDNALPDPCTCGSTPSVMIPAAQSAKPVLESNQESDAGLSYHLKNEHDFPPLSL

SEQ ID NO: 8741 - protein, 129 aa, Cucurbita pepo
MTFKRRNGGRNKHGRGHVKFIRCSNCGKCCPKDKAIKRFLVRNIVEQAAVRDVQEACVYDQYTLPKLYAKMQYCVSCAIHSHVVRVRSRTDRRNRQPPQRFIRRRDDQPKPGQPGQAPRPAGAGVPARV

SEQ ID NO: 8742 - protein, 129 aa, Malus domestica
MTFKRRNGGRNKHGRGHVKFIRCSNCGKCCPKDKAIKRFLVRNIVEQAAVRDVQEACVYEQYTLPKLYAKMQYCVSCAIHSHVVRVRSRTNRRNREPPQRYIRRRDDAPRPGQPGQAPRPAGAGVPART

SEQ ID NO: 8743 - protein, 129 aa, Phaseolus coccineus
MTFKRRNGGRNKHGRGHVKFIRCSNCGKCCPKDKAIKRFLVRNIVEQAAVRDVQEACVYEQYTLPKLYVKMQYCVSCAIHSHVVRVRSRTNRRKRDPPQRFIRRRDDAPRPGQPGQAPRPAGAGAPVRT

SEQ ID NO: 8744 - protein, 129 aa, Cyamopsis tetragonoloba
MTFKRRNGGRNKHGRGHVKFIRCSNCGKCCPKDKAIKRFLVRNIVEQAAVRDVQEACIYDQYTLPKLYVKMQYCVSCAIHSHVVRVRSRTDRRKRDPPQRFIRRRDDTPRPGQPGQAPRPAGVGAPARA

SEQ ID NO: 8745 - protein, 124 aa, Vitis vinifera
MTFKRRNGGRNKHGRGHVKFIRCSNCGKCCPKDKAIKRFLVRNIVEQAAVRDVQEACVYDTYTLPKLYAKMQYCVSCAIHSHVVRVRSRTDRRKRDPPQRFRRRDDMPKPGQAPRPAGAAAARP

SEQ ID NO: 8746 - protein, 125 aa, Liriodendron tulipifera
MTFKRRNGGRNKHGRGHVNFIRCSNCGKCCPKDKAIKRFLVRNIVEQAAVRDVQEACVYDGYTLPKLYAKMQYCVSCAIHSHVVRVRSRTARRNRDPPPRFRRRDDMPKPGQAPRPAGVANPVRP

SEQ ID NO: 8747 - protein, 128 aa, Momordica charantia
MTFKRRNGGRNKHGRGHVKFIRCSNCGKCCPKDKAIKRFLVRNIVEQAAVRDVQEACVYDQYTLPKLYAKMQYCVSCAIHSHVVRVRSRTDRRKRDPPQRFIRRRDDAPKPGQPGQAPRVGAGTAPRT

SEQ ID NO: 8748 - protein, 130 aa, Pisum sativum
MTFKRRNGGRNKHGRGHVKFIRCSNCGKCCPKDKAIKRFLVRNIVEQAAVRDVQEACVYDQYTLPKLYVKMQYCVSCAIHSHVVRVRSRTDRRKRDPPQRFIRRRDDAPRPGQPGQAPRPAGPGAPPART

SEQ ID NO: 8749 - protein, 129 aa, Glycine max
MTFKRRNGGRNKHGRGHVKFIRCSNCGKCCPKDKAIKRFLVRNIVEQAAVRDVQEACVYEQYTLPKLYVKMQYCVSCAIHSHVVRVRSRTDRRKREPPQRFIRRRDDAPRPGQPGQAPRPAGVGAPART

SEQ ID NO: 8750 - protein, 129 aa, Phaseolus coccineus
MTFKRRNGGRNKHGRGHVKFIRCSNCGKCCPKDKAIKRFLVRNIVEQAAVRDVQEACVYEQYTLPKLYVKMQYCVSCAIHSHVVRVRSRTNRRKRDPPQRFIRRRDDAPRPGQPGQAPRPAGAGPPVRT

SEQ ID NO: 8751 - protein, 130 aa, Cicer arietinum
MTFKRRNGGRNKHGRGHVKFIRCSNCGKCCPKDKAIKRFLVRNIVEQAAVRDVQEACVYDQYTLPKLYVKMQYCVSCAIHSHVVRVRSRTDRRKRDPPQRFVRRRDDAPRPGQPGQAPRPAVAGAAPART

SEQ ID NO: 8752 - protein, 130 aa, Cicer arietinum
MTFKRRNGGRNKHGRGHVKFIRCSNCGKCCPKDKAIKRFLVRNIVEQAAVRDVQEACVYDQYTLPKLYVKMQYCVSCAIHSHVVRVRSRTDRRKRDPPQRFVRRRDDAPRPGQPGQAPRPAVAGAAPVRV

SEQ ID NO: 8753 - protein, 129 aa, Lotus japonicus
MTFKRRNGGRNKHGRGHVKFIRCSNCGKCCPKDKAIKRFLVRNIVEQAAVRDVQEACVYDQYTLPKLYVKMQYCVSCAIHSHVVRVRSRTDRRKRDPPQRFIRRRDDAPRPGQPGQAPRPAGVGAPPRA

SEQ ID NO: 8754 - protein, 129 aa, Prunus persica
MTFKRRNGGRNKHGRGHVKFIRCSNCGKCCPKDKAIKRFLVRNIVEQAAVRDVQEACVYEQYTLPKLYAKMQYCVSCAIHSHVVRVRSRTNRRNREPPQRFIRRRDDAPRPGQPGQGPRPAGAPVPART

SEQ ID NO: 8755 - protein, 130 aa, Glycine max
MTFKRRNGGRNKHGRGHVKFIRCSNCGKCCPKDKAIKRFLVRNIVEQAAVRDVQEACVYEQYTLPKLYVKMQYCVSCAIHSHVVRVRSRTDRRKREPPQRFIRRRDDAPRPGQPGQGPRPAGTAAAPVRT

SEQ ID NO: 8756 - protein, 132 aa, Euonymus alatus
MTFKRRNGGRNKHGRGHVKFIRCSNCGKCCPKDKAIKRFLVRNIVEQAAVRDIQEAGVYEQYTLPKLYAKVQYCVSCAIHSHVVRVRSRTNRRIREPPQRFIRRRDDLPKPGQPGQPGQAPRPAGAGNPARA

SEQ ID NO: 8757 - protein, 132 aa, Malus domestica
MTFKRRNGGRNKHGRGHVKFIRCSNCGKCCPKDKAIKRFLVRNIVEQAAVRDVQEACVYDGYTLPKLYAKMQYCVSCAIHSHVVRVRSRENRRNREPPQRFRRREDTPRPGAPGAPGQGPRPVGAGAPAPRP

SEQ ID NO: 8758 - protein, 130 aa, Prunus persica
MTFKRRNGGRNKHGRGHVKFIRCSNCGKCCPKDKAIKRFLVRNIVEQAAVRDVQEACVYDAYTLPKLYAKMQYCVSCAIHSHVVRVRSRENRRNREPPQRFRRREDTPRPAAPGAPGQAPRPAGAPAARP

SEQ ID NO: 8759 - protein, 131 aa, Humulus lupulus
MTFKRRNGGRNKHGRGHVKFIRCSNCGKCCPKDKAIKRFLVRNIVEQAAVRDVQEACVYDGYTLPKLYAKMQYCVSCAIHSHVVRVRSRENRRIREPPQRFRRREDTARPGGAPGQPGQRPAGGAPAAART

SEQ ID NO: 8760 - protein, 130 aa, Zostera marina
MTFKRRNGGRNKHGRGHVNFIRCSNCGKCCPKDKAIKRFLVRNIVEQAAVRDVQEACVYEGYTLPKLYAKMLYCVSCAIHAHVVRVRSRTNRRNRDPPQRFRRRDDTNKPGQVPPGGAPRPVGVVTAPRT

SEQ ID NO: 8761 - protein, 232 aa, Arabidopsis lyrata
MDALGGCGGAGGFWGWNGFEQRRKKKSSGDRDRKRNTGSSDSVDVSRDAGGYRFPLKQAVTAGALTFTGDTIAQLSGRWKKRTALKQSSSELDEGELWNIFSEHDWIRALRMSSYGFLLYGPGSYAWYQFLDHSLPKPTATNLVLKVLLNQVILGPSVIAVIFAWNNLWLGKLSELGNKYQKDALPTLLYGFRFWVPVSILNFWVVPLQARVAFMSMGSVFWNFYLSSTMSK

SEQ ID NO: 8762 - protein, 232 aa, Unknown
  Sequence found in Organisms: Thellungiella halophila, Eutrema halophilum
MDALGGCGGAGGFWGWNSFDHRRKKKSSGDRGNQRKSGSSDSVDVSRDGGYRFPLKQAVTAGALTFTGDTIAQLSGRWKKRNALKQSSSDKPDEEELWNIFSEHDWVRALRMSSYGFLLYGPGSYAWYQYLDHSLPKPTAKNLVLKVLLNQVILGPSVIAVIFAWNNLWLGKLSELGNKYQKDALPTLLYGFRFWVPVSILNFWVVPLQARVAFMSMGSVFWNFYLSSTMSK

SEQ ID NO: 8763 - protein, 232 aa, Eutrema parvulum
MDALGGCGGAGGFWGWNGFNHGRKKRSSGDRGNQRKSGSSDSVDVSRDAGYRFPLKQAVTAGALTCTGDTIAQLSGRWKKRTALKQSSSDKPDEEELWKIFSEHDWVRALRMSTYGFLLYGPGSYAWYQYLDHSLPKPTAKNIVLKVLLNQVILGPSVIAVIFAWNNLWLGKLSELGNKYQKDALPTLLYGFRFWVPVSILNFWVVPLQARVAFMSMGSVFWNFYLSSTLSK

SEQ ID NO: 8764 - protein, 238 aa, Raphanus sativus
FVMDALGGCGGANGFWGWNGFNQRRKKKNNSSGDRRNQRNSGSSDSVDVSRDSSGYRFPLKQAVTAGALTFTGDTIAQLSGRWKKRAAALKQSSSDKPDEEELWNIFSEHDWVRALRMSSYGFLLYGPGSYAWYQYLDRSLPKPTATNIVLKVVLNQVILGPSVIAVIFAWNNLWLGKISELGNKYQKDALPTLLYGLRFWVPVSILNFWVVPLQARVAFMSMGSVFWNFYLSSTLSN

SEQ ID NO: 8765 - protein, 229 aa, Brassica napus
MDALGGFWGLNGFNHRRKKNNSSGDRRNQRKSGSSDSVDVSRDAAGYQFPLKQAVTAGALTFTGDTIAQLSGRWKKRAAALKQSSSDKPDQEELWNLFSEHDWVRALRMSTYGFLLYGPGSYAWYQYLDRSLPKPTATNIVLKVLLNQVILGPSVIAVIFAWNNLWLGKISELGNKYQKDALPTLLYGFRFWVPVSILNFWVVPLQARVAFMSMGSVFWNFYLSSTLSN

SEQ ID NO: 8766 - protein, 230 aa, Brassica napus
MDALGGFWGLNGFNHRRKKNNSSGDRRNQRKSGSSDSVDVSRDAAGYQFPLKQAVTAGALTFTGDTIAQLSGRWKKRAAALKQSSSSDKPDQEELWNLFSEHDWVRALRMSTYGFLLYGPGSYAWYQYLDRSLPKPTATNIVLKVLLNQVILGPSVIAVIFAWNNLWLGKISELGNKYQKDALPTLLYGFRFWVPVSILNFWVVPLQARVAFMSMGSVFWNFYLSSTLSN

SEQ ID NO: 8767 - protein, 235 aa, Brassica oleracea
KRNHFVMDALGGFWGLNGFNHRRKKNNSSGDRRNQRKSGSSDSVDVSRDAAGYQFPLKQAVTAGALTFTGDTIAQLSGRWKKRAAALKQSSSGKPDQEELWNLFSEHDWVRALRMSTYGFLLYGPGSYAWYQYLDRSLPKPTATNIVLKVLLNQVILGPSVIAVIFAWNNLWLGKISELGNKYQKDALPTLLYGFRFWVPVSILNFWVVPLQARVAFMSMGSVFWNFYLSSTLSN

SEQ ID NO: 8768 - protein, 245 aa, Brassica rapa
  misc_feature (12)..(12): Xaa can be any naturally occurring amino acid
VGLLGFQNEKGXNHFVMDALGGFWGLNGFNHRRKKNNSSGDRRNQRKSGSSDSVDVSRDAAGYQFPLKQAVTAGALTFTGDTIAQLSGRWKKRAAALKQSSSDKPDQEELWNLFSEHDWVRALRMSTYGFLLYGPGSYAWYQYLDRSLPKPTATNIVLKVLLNQVILGPSVIAVIFAWNNLWLGKISELGNKYQKDALPTLLYGFRFWVPVSILNFWVVPLQARVAFMSMGSVFWNFYLSSTLSK

SEQ ID NO: 8769 - protein, 164 aa, Arabidopsis lyrata
MAMEVATPAPAPIPSERNIVLAPATTTTTATVETHKKNRIQVSNTKKPLFFYVNLAKRYIQQHNEVELSALGMAITTVVTISEILKNNGLATEKKVLTSTVGMKDETKGRMVQKAKIEIVLGKSDKFDSLVPPVTNGKTPEEEASAETEASVEAQENVAAATEV

SEQ ID NO: 8770 - protein, 161 aa, Eutrema parvulum
MAMEVATPAPAPIPAPERNIVLAPAVTAAVETHKKNRIQVSNTKKPLFFYVNLAKRYIQQHNEVELSALGMAITTVVTISEILKNNGLATEKKVLTSTVGMKDETKGRMVQKAKIEIVLGKSDKFDSLVPPVTNGKTPEEEANAETEAAVEAQEEAAATEA

SEQ ID NO: 8771 - protein, 161 aa, Eutrema halophilum
MAMEVATPAPAPIPAPERNIVLAPATTAIAETHKKNRIQVSNTKKPLFFYVNLAKRYIQQHNEVELSALGMAITTVVTISEILKNNGLATEKKVLTSTVGMKDETKGRMVQKAKIEIVLGKSDKFDSLVPPVTNGKTPEEEANADTEAAVEAQEEAAATEA

SEQ ID NO: 8772 - protein, 157 aa, Brassica napus
MAMEVATPAPAPITAPERNIILAPATVETHKKNRIQVSNTKKPLFFYVNLAKRYMQQHNEVELSALGMAITTVVTISEILKNNGLATEKKVLTSTVGMKDETKGRMVQKAKIEIVLGKSDKFDSLVPPVTNGKTPEEVAKAETEAAVEVQEAAATEA

SEQ ID NO: 8773 - protein, 157 aa, Brassica napus
MAMEVATPAPAPINAPERNIILAPATVETHKKNRIQVSNTKKPLFFYVNLAKRYMQQHNEVELSALGMAITTVVTISEILKNNGLATEKKVLTSTVGMKDETKGRMVQKAKIEIVLGKSDKFDSLVPPVTNGKTPEEVAKAETEAAVEVQEAAATEA

SEQ ID NO: 8774 - protein, 161 aa, Brassica napus
MAMEVATPAFAPITSPEINIVLAATAKKASVETHKKNRIQVSNTKKPLFFYVNLAKRYIQQHNEVELSALGMAITTVVTISEILKNNGLATEKKVLTSTVGMKDETKGKMVQKAKIEIVLGKSAKFDSLVPPVTNDKTPEEVAKAETEAAVEVQEAAATEA

SEQ ID NO: 8775 - protein, 160 aa, Brassica juncea
MAMEVATPAPAPLTAPERNIVLVPSVKATAESHKKNRIQVSNTKKPLFFYVNLAKRYMQQHNEVELSALGMAITTVVTISEILKNNGLATEKKVLTSTVGMKDETKGRMVQKAKIEIVLGKSDKFDSLVPPVTNGKTPEEVAKAETEAAVEVQEAAATEA

SEQ ID NO: 8776 - protein, 164 aa, Brassica napus
MAMEVATPAFAPITSPEINIVLAAAAPAAKKASVETHKKNRIQVSNTKKPLFFYVNLAKRYIQQHNEVELSALGMAITTVVTISEILKNNGLATEKKVLTSTVGLRDETKGKMVQKAKIEIVLGKSAKFDSLVPPVTNGKTPEEVAKAETEAAVEVQEAAATEA

SEQ ID NO: 8777 - protein, 157 aa, Raphanus sativus
MAMQIATPAPAPITAPEINIILTPAKTETHKKNRIQVSNTKKPLFFYVNLAKRYIQQHNEVELSALGMAITTVVTISEILKNNGLATEKKVLTSTVGMKDETKGKMVQKAKIEIVLGKSDKFDSLVPPVTNGKTPEEVAKAETEAAVEVQEAAATQV

SEQ ID NO: 8778 - protein, 161 aa, Brassica napus
MAMEVATPAPAPLTAPERNIVLVPSVKATAESHKKNRIQVSNTKKPLFFYVNLAKRYMQQHNEVELSALGMAITTVVTISEILKNNGLAIEKKVLTSTVGMKDETKGRMVQKAKIEIVLGKSDKFDSLVPPVTNGKTPEEVAKAETDAAIEAQEEAAATEA

SEQ ID NO: 8779 - protein, 162 aa, Brassica napus
MEVATPAFAPITSPEINIVLAAAAPAAKKASVETHKKNRIQVSNTKKPLFFYVNLAKRYIQQHNEVELSALGMAITTVVTISEILKNNGLATEKKVLTSTVGLRDETKGKMVQKAKIEIVLGKSAKFDSLVPPVTNGKTPEEVAKAETEAAVEVQEAAATEA

SEQ ID NO: 8780 - protein, 184 aa, Raphanus sativus
NSRSNEPERSERTFPLRKRVKEERVIRRTMAMEVATPAPAPLTAPERNIILAPSAKATTTVETHKKNRIQVSNTKKPLFFYVNLAKRYMQQHNEVELSALGMAITTVVTISEILKNNGLAIEKKVLTSTVGVKDESKGRMVHKAKIEIVLGKSDKFDSLVPPVTNGKTPEEAAKAETDAVIEAQ

SEQ ID NO: 8781 - protein, 463 aa, Arabidopsis lyrata
MGRACLPRWRLGRLMAGLQVILGLLVITVSLSCLFRFHSAGYFLHNEDVCNNIYTIKEVSNEGFDIKALHDRVDEVLEKMDNLYEKLEKTVKEMEKSKDGSKKEMKKFLEDEVMKPFYYAHIGLRQIRLPKPEGIRNSTEKEEPLINKFLIEEIRQYITPKENRVGKINMFGTERVYNTIGHACALMKIELEKYMDYDVGAYCDDDWNLAQKLMLNGCDPLPRRRCLTRASMTYQKPYPINESLWKLPDDRNVRWGNYQCRNFACLSSKNPKRGYTKCSGCFEMEKEGDKWVKNSTLLVDFMIEDVLRVKPGEIRLGLDYGVGTGTFAARMREKNVTIVTTALNLGAPFNEMIALRGLIPLYLSLNQRLPFFDNTMDMIHTAGLMDGWIDLLLMDFVLYDWDRVLRPGGLLWIDRFFCKKKDLDDYMYMFLQFRYKKHKWAVSPKSKDEVYLSALLEKPPRAI

SEQ ID NO: 8782 - protein, 463 aa, Eutrema halophilum
MGRSCLPRWRLGRVMAGLQVILGLLVITVSLSCLYRFHSSGYFLHNEDICRNIYTIKDVNHQGFDLKALHDRVGEVLEKMDNLYEKLEKTVKEMEKSKDGSKKEMKKFLEDEVMKPFYSAHIGLRQIRLPKPEGIRNSTEKEEPLINKFLIEEIKQYITPKENRVGKINMFGTERVYNTIGHACVLMKMELEKYMDYDVGAYCDDDWNLAQRLIVNGCDPLPRRRCLTRASMTYQKPYPINESLWKLPDDRNVRWGNYQCRNFACLSSKNPKRGYTKCSGCFEMEKEIGKWVKNSSLLVDFTIDDVLRVKQGEIRIGLDYGVGTGTFAARMREKNATFVTTALNLGAPFNEMIALRGLIPLYISVNQRLPFFDNTMDMIHTAGLMDGWIDLLLMDFVLYDWDRVLRPGGLLWIDRFFCKKKDLDDYMYMFLQFRYKKHKWAISPKSKDEVYLSALLEKPPRAI

SEQ ID NO: 8783 - protein, 463 aa, Eutrema parvulum
MGRSCLPKCRLGRLMAGLQVVFGLLLITVSLSCLYRFHSAGYFLHNEDTCRNIYRIKEVNSEGFDLKALRDRVDEVLQKMDNLYEKLDKTVKEMEKSKDGSKKEIKKFLEDEVMKPFYYAHIGLRQIRLPNPEGIRNSTEKEEPLINKFLIEEIRKYITPKENRVGKINMFGTERVYNTIGHACVLMKMELEKYMDYDVGAYCDDDWNLAQKLIVNGCDPLPRRRCLTRASMTYQKPYPINESLWKLPDDRNVRWGNYQCRNFACLSSKNPKRGYTKCSGCFEMEKESGKWVTNSTLLADFTIADVLKVKPGEIRIGLDFGVGTGTFAARMREKNVTIVTTALNLGAPFNEMIALRGLIPLYISVNQRLPFFDNTMDMIHTAGLMDGWIDLLLMDFVLYDWDRVLRPGGLLWIDRFFCKKKDLDDYMYMFLQFRYKKHKWAISPKSKDEVYLSALLEKPPRAI

SEQ ID NO: 8784 - protein, 1046 aa, Eutrema parvulum
MAPVRKSRSVNKRFTNETSPRKDVGNSRKNKQRKKLSDKLGPQWTRVELERFYDAYRKYGQDWRKVAAAIRNSRSVDMVEALFNMNRAYLSLPEGTASVAGLIAMMTDHYSVMEGSGSEGEGHDVSEVPRKQQKRKRAKAQLSDSREEDDRQHPVASSDGCLTFLKQARANGTHRRATGKRTPRVPVQTSHMRDDREGSTPPNKRARKQLDANDDVAHFLALALTDASRRGGSPIVSESPNRRTELSDNSPIKSWGKMSRTRKAQSWVGSSRDRKLESDRDAALLMDMEGVGEMEVPRKGKRFYKKKVKVEEAEGNYSDDNGEAGSATEGLRIKSQRRKAGVEASRGTYSPRSPKKRDNKLTSGDEFDALQALAELSASLLPAALMESESSAQLKEERIENDIDEKSSSPETTSTSSHGEKANSEPDDSLLHAISAIGNAACNRKPKPSRQASTDYNVVPTGKLQPETTSGSLRRKRKPKMLGDEAPTDSTQEKSINKKELAQEDHNMKSSLRTKRVGQGPPQSKQLKTVKQLEESTAMSDKKRSAMDVVMSTKQVSDSGPASLPQKPPNRRKMSLKKSLQERAKTSENIHKASRSSRSLSEQELLLKDKLSTSMSYSLARRRCIFEWFYSAIDHPWFAKMEFVDYLNHVGLGHIPRLTRLEWSVIKSSLGRPRRFSERFLQEEREKLKQYRESVRKHYTELRTGAREGLPTDLARPLAVGNRVIAIHPKTREIHDGKILTVDHSQCNVLFDDLGVELVRDIDCMPSNPLEYMPEGLRRQIDKCLSMKKEAQLSGNSNPGVSVIFPPCGLENVDFSMNPSLNQGDMIAPILHGKVSTNTSSPHQTNQSYIINYSKGREAEIQQAFALQHDLDEKEMEPEMLEIVKGSKKRAQAMVDAAIKASSSVKEGEDASKMIQEALDLIGKHQPLRSSMAKHQEHANGSIEHHHNGSPSDASKPVANSDFISQDGSEKNEAQMPSELITSCVATWLMIQMCTERQYPPADVAQLIDTAVTSLQPRCPQNLPIYREIQMCMGRIKTQILSLVPS

SEQ ID NO: 8785 - protein, 412 aa, Arabidopsis lyrata
MDNEIAKKVTAIFDHRRLNRSGSSLYTAFASTVIALVVFTIVLVSNLSVRGDFSAKVVTIEIKTVVPYLLPLSSEKEVSDQGNSNYSIKQQIIVKEIDNNLQVIEDFGGKGVSEKFQERATEFLRDDCEVKFMMTWISPAELFGKREILSVESVFKSHPRGCLMILSSTMDSPQGFSILKPFLDRGYRVMAVTPDLHFLLKDTAGESWLEEIQTGKRDPGKISLAQNLSNLMRLAYLYKFGGVYLDTDMIVLKSFKTLRNVIGAQTLEPVSRKWTRLNNAVLIFDKNHPFLLKSIEEFALTFNGNVWGHNGPYLVSRVARAVEGTDGYNFTIMTPPAFYPVNWVEIEKLFKVPRTEKDSKRVQVKVLEMQKRSYGLHLWNKFSSKFEIEQGSTMDQLISDHCIICDSVVSVS

SEQ ID NO: 8786 - protein, 463 aa, Eutrema parvulum
MVLSGGSERVKLNVGGEIFETNASTIQSTCPDSLLAALSNPTSHGSTPVFIDRDPEIFSVILSLLRTGRLPANSSGIFSKQELLDEALYYGVESVLRSAMLPPPLLGFDAALVSTITPATDGVPSAFTATAGDASLWIAHGGQISVYDWSLSHAGTVRTHLTDITSICRVWSEAAAIGSGSASGLHFYDLSGGRYVGSTHWTDPEDPRIHKARVAAVADSASGVFASFDCLHRENSVLQIDKSTLQVAAVIGQQSGSSAKTTVPEKLRWVPRNGLLVGSTVQRGVFGCSGYIRIWDPRSRNIVWETSEPGSGRSSRFGDAVADVDVDVEDSILFKVCSKSGDLGMADIRKLGEDPWVYVSDENHGAWKAGAGDRSGGYNVVHCYRKQVLAARAGALEVWSRVKENTCGDPIRRRNLVDKEEDSKRGMISKIEAGGDRLFVSREHMEGIEVWASSNFSSVISVE

SEQ ID NO: 8787 - protein, 461 aa, Eutrema halophilum
MAPDDGERVKLNVGGEIFETNVSTIQSTSPDSLLAALTIPTSHGSIPVFIDRDPEIFAVILNLLRTGRLPANSSGVFSKQELLDEALYYGVESLLRSAMFPSPLLGIDASLVSTITPAADGVPSAFTATAGDASLWIAHGGQISVYDWSLSHSGTVRTHLNDITSICRVWAEAAAIGSESASGLHFYDLSGGRYVGSTHWTDPEDPRIHKARVAAVADSSGGVFASFDCLHRENSVLQIDKSTLQVAAVIGQQSGSSAKTSVPEKLRWVPTNGLLVGSAVQRGVFGCSGYIRIWDPRSRNIVWETSEPGSGRSSRFGDALADVDVDVEDSILYKVCSKSGDLGMADLRKLGEDPWVYVSDENPGAWKSDDGGGGGYSVVHCYRKQVWAARGGALEVWSSVKDNIRGDPIRRRNFVDKEEDSIRGMISKIEAGGDRMFVSREYMEGVEVWESCNFSSLVSVE

SEQ ID NO: 8788 - protein, 321 aa, Brassica napus
MVSDGSERLKLNVGGEIFETTASTIQSTCPDSLLAALSTPTSHGSNPVFIDRDPDAFLPSILNLLRTGPSPTLTPPPSSPNKSYSMKLFIYGVESLLRSAMLPPPLLGFDASLASTITPATDGVPSAFTATAGDASLWIAHGGQISVYDWSLSHAVTVRTHLSDVTSICRVWDEAAAIGSGSASGLHFYDLSSGRYVGSTHWTDPEDPRIHKARVAAVADSPGGVFASFDCLHRENSVLQIDKSTLQVAAVIGQQSGSSAKTAVPEKLRWVANNGLLVGSAVQRGVFGCSGTSGSGIHDQRTLCGRRASQARDEAAGSETR

SEQ ID NO: 8789 - protein, 432 aa, Arabidopsis lyrata
MAIKDLTATTGDSSLPLIKPPPSETTGGDRTSALQTLGNIIVSIVGTGVLGLPYAFRVAGWFAGSLGVIIVGFATYYCMLLLIQCRDKLESEQGEEESKTYGDLGFKCMGTKGRYLTEFLIFTAQCGGSVAYLVFIGRNLSSIFSSYGLSMVSFILILVPIEVGLSWITSLSALSPFSIFADICNIIAMCFVVKENVEMVIEGDFSFSDRTAISSTIGGLPFAGGVAVFCFEGFAMTLALENSMRDREAFPKLLAKVLAGITFVYVLFGFCGYMAYGDQTKDIITLNLPNNWSAIAVQIGLCVGLTFTFPIMVHPLNEIIEQKLKKIDWLQKHHHGYNNETGSVSKCAIFMTRTLLVVGLAAIASLVPGFGTFASLVGSTLCALISFVLPASYHLTLLGPSLNVWNKSVDVFIVICGLLFAVYGTYNTIVGV

SEQ ID NO: 8790 - protein, 431 aa, Eutrema parvulum
MAIKDLAVNDDASLPLINSPSSATAGDRTSPIQTLGNIIVSIVGTGVLGLPYAFRVAGWFAGSLGVIIVGFTTYYCMLLLIQCRDKLESEEGKEESKTYGDLGFRCLGTKGRYLTEFLIFTAQCGGSVAYLVFIGRNLSSIFESYGLNMVSFILILVPIEVGLSWITSLSALSPFSIFADICNIIAMCFVVKENVEMVIEGDFSFSDRTAISSTIGGIPFAGGVAVFCFEGFAMTLALEGSMREREAFPKLLAKVLAGITSVYVLFGFCGYMAYGDETKDIITLNLPNNWSAIAVQIGLCVGLTFTFPIMVHPLNEIIEQKLKRIDWLQKHHHHQYSNETSSVSKYVIFITRTLLVVGLAAIASLVPGFGTFASLVGSTLCALISFVLPASYHLTLLGPSLNVWNKSVDVFIVICGLLFAVYGTYNTIVGV

SEQ ID NO: 8791 - protein, 435 aa, Eutrema halophilum
MAIKDLAANDDSSLPLIKSPPSTTTGDRTTALQTLGNIIVSIVGTGVLGLPYAFRVAGWFAGSLGVIIVGFATYYCMLLLIQCRDKLESEEGKEESKTYGDLGFKCMGTKGRYLTEFLIFTAQCGGSVAYLVFIGRNMSSIFKSCGLSMVSFILILVPIEAGLSWITSLSALSPFSIFADICNIIAMCFVVKENVEMVIEGDFSFGDRTAISSTIGGLPFAGGVAVFCFEGFAMTLALEGSMKEREAFPKLLAKVLAGITFVYVLFGFCGYMAYGDETKDIITLNLPKNWSAIAVQIGLCVGLTFTFPIMVHPLNEIIEQKLKRIDWLQKHHHHQQQHQYSNETVSVSKYVILITRTLLVVGLAAIASLVPGFGTFASLVGSTLCALISFVLPASYHLTLLGPSLNLWSKSVDVFIVICGLLFAVYGTYNTIVGV

SEQ ID NO: 8792 - protein, 436 aa, Raphanus sativus
  misc_feature (29)..(29): Xaa can be any naturally occurring amino acid
MAIKDHHLASHGDASSLPLIKSPRSGETXGGDRTSAIQTLGNIIVSIVGTGVLGLPYAFRIAGWFAGSLGVVIVGFATYYCMLLLIQCRDKLEAEEGQEESKTYGDLGFKCMGTKGRYLTEFLIFTAQCGGSVAYLVFIGRNMSSIFASYGLSMVSFILILVPIEVALSWITSLSALSPFSIFADICNIIAMCFVVKENVEMVIGGDFSFGDRTAVSSSIGGLPFAGGVAVFCFEGFAMTLALENSMKDREAFPKLLAKVLAGITFVYVLFGFCGYMAYGDETKDIITLNLPKNWSAIAVQIGLCVGLTFTFPIMVHPLNEIIEQKLKRIDWLQKHHHHEYSNETGSVSKYVIFTTRTLLVVGLAAIASLVPGFGTFASLVGSTLCALISFVLPASYHLTLLGPSLSLWNKSVDVFIVICGLLFAVYGTYNTIVGV

SEQ ID NO: 8793 - protein, 426 aa, Brassica napus
MAANGDDASLPLIKPPPSAATGDRTSAIQTLGNIIVSIVGTGVLGLPYAFRIAGWFAGSLGVIIVGFATYYCMLLLIQCRDKLESEEGQEESKTYGDLGYKCMGTKGRYLTEFLIFTAQCGGSVAYLVFIGRNMSSIFTSYGLSMVSFILILVPIEVALSWITSLSALSPFSIFADICNIIAMCFVVKENVEMVIEGDFSFGDRTAVSSTIGGLPFAGGVAVFCFEGFAMTLALENSMKDREAFPKLLAKVLAGITFVYVLFGFCGYMAYGDETKDIITLNLPKNWSAIAVQIGLCVGLTFTFPIMVHPLNEIIEQKLKRVDWLQKHNHNYSNETSSVSKYVIFTTRTLLVVGLAAIASLVPGFGTFASLVGSTLCALISFVLPASYHLTLLGPSLSLWSKSVDVFIVICGLLFAVYGTYNTIVGV

SEQ ID NO: 8794 - protein, 426 aa, Brassica napus
MAANGDDASLPLIKPPPSAATGDRTSAIQTLGNIIVSIVGTGVLGLPYAFRIAGWFAGSLGVIIVGFATYYCMLLLIQCRDKLESEEGQEESKTYGDLGFKCMGTKGRYLTEFLIFTAQCGGSVAYLVFIGTNMSSIFTSYGLSMVSFILILVPIEVALSWITSLSALSPFSIFADICNIIAMCFVVKENVEMVIEGDFSFGDRTAVSSTIGGLPFAGGVAVFCFEGFAMTLALENSMKDREAFPKLLAKVLAGITFVYVLFGFCGYMAYGDETKDIITLNLPKNWSAIAVQIGLCVGLTFTFPIMVHPLNEIIEQKLKRVDWLQKHNHNYSNETSSVSNYVIFTTRTLLVVGLAAIASLVPGFGTFASLVGSTLCALISFVLPASYHLTLLGPSLSLWSKSVDVFIVICGLLFAVYGTYNTIVGV

SEQ ID NO: 8795 - protein, 426 aa, Brassica napus
MAANGDDASLPLIKPPPSAATGDRTSAIQTLGNIIVSIVGTGVLGLPYAFRIAGWFAGSLGVIIVGFATYYCMLLLIQCRDKLESEEGQEESKTYGDLGFKCMGTKGRYLTEFLIFTAQCGGSVAYLVFIGTNMSSIFTSYGLSMVSFILILVPIEVALSWITSLSALSPFSIFADICNIIAMCFVVKENVEMVIEGDFSLGDRTAVSSTIGGLPFAGGVAVFCFEGFAMTLALENSMKDREAFPKLLAKVLAGITFVYVLFGFCGYMAYGDETKDIITLNLPKNWSAIAVQIGLCVGLTFTFPIMVHPLNEIIEQKLKRVDWLQKHNHNYSNETSSVSNYVIFTTRTLLVVGLAAIASLVPGFGTFASLVGSTLCALISFVLPASYHLTLLGPSLSLRSKSVDVFIVICGLLFAVYGTYNTIVGV

SEQ ID NO: 8796 - protein, 644 aa, Arabidopsis lyrata
MSAVSFLYSSKNPKFRGAFNGICALVLFCFFFDRSDILRNPLFRNSSLVNGGSGSTSRGKFNNGFTLIRRNVRQIETNDSGNSSLSSTSTVLFSGLHKHIGYADQCDFLKANPICSPDGFFDYLNFFYCSCRDFSILGYMMLGVWLVALFYLLGNTAADYFCCSLEKLSKLLRLPPTVAGVTLLPLGNGAPDVFASIAAFVGTDKGEVGLNSVLGGAVFVTSVVVGIVSLCVADKDVKIDKKCFIRDLSFFLFTLVSLLVILMVGKVTVRIAIAFVSIYVIYAFLVAANVILIKHAKRFKLEALTPLLPMQGSMFSPSVGEDMPMNTPLIETDPEDGPPRLQSLPQWMWASNVAIYSNHFAKVSVHDEDRPPWGWIDDSAEVESSSCTKFTSLLEIPLTIPRRLTIPSVEEDTWSKTYAVASVTLAPVLLASLWSSQDDVSPQACGVAYFIGVAIGSTLGFLAYKNTEPDHPPRRFLIPWVLGGFIMSIVWFYMIANELVALLVTFGEIYGINPSILALTVLAWGNSMGDLVSNIALTMNGGDGVQIALSGCYAGPMFNTLVGLGMSMLFGAWSKSPDTYMLPEDKSLFYTLGFLVLGLVWAMVILPRNDMRPNRTLGMGLIAIYLIFVTFRLSCAMGFIPWAA

SEQ ID NO: 8797 - protein, 656 aa, Eutrema halophilum
MSLVNFLCSSKNPKFRGIFNGICAVILFVFFFDRSDILRNPLLRSNASFVDGGSGGSTSKANFNNGFSQFTVVRRHMSEADTNVSKLINGSGNNSLSSTSTVLCSGLHNHMGYADQCEFLRANPICSPDGFFNYLNFFYCSCRDFKILGYMMLGVWLVALFYLLGNTAADYFCCSLEKLSKLLRLPPTVAGVTLLPLGNGAPDVFASIAAFVGTDKGEVGLNSVLGGAVFVTSVVVGIVSLCVADMEVKIDKKCFIRDLSFFLFTLVSLSIILMVGEVTVRVAIAFVSIYVVYAFLVAANVVLRKHAKRFKLEAITPLLPMQGSVFSPSVEEDIPMHSPLIETDTEDGPPRLQNSLPQWMWASNVAIYSNHFARVSVQDDDRPPWGWIDDSAEVESSLCTKLTSLLEIPLTIPRRLTIPSVEEDTWSKTYAVASVSLAPVLLASLWSSQDNVSPQACVVAYFIGVAIGSALGFLAYKNTEPDHPPRRFLIPWVLGGFIMSIVWFYMIANELVALLVTFGEIYGINPSILALTVLAWGNSMGDLVSNIALSMNGGDGVQIALSGCYAGPMFNTLVGLGMSMLLGAWSKSPDTYIVPEDKSLFYTLGFLVLGLVWAMVVLPRNDMRPNKTLGVGLIALYLIFVTFRLSCAMGFIPWAA

SEQ ID NO: 8798 - protein, 81 aa, Eutrema parvulum
MSAASFLLTSKNPKFRGIFNGLCAVILFVFFFDRSDILRNPLLKNAYFVDGGTSGSASKGKFNNGFTHFTVVRRHMSEGSR

SEQ ID NO: 8799 - protein, 656 aa, Eutrema parvulum
MSAASFLLTSKNPKFRGIFNGLCAVILFVFFFDRSDILRNPLLKNAYFVDGGTSGSASKGKFNNGFTHFTVVRRHMSEADTNVAKLINGLGNNSLSSTSTVLCSGLHNHIGYADQCDFLRANPICSPDGFFDYLNFFYCSCRDFKILGYMILGVWLVALFYLLGNTAADYFCCSLEKLSKLLRLPPTVAGVTLLPLGNGAPDVFASIAAFVGTDKGEVGLNSVLGGAVFVTSVVVGIVSLCVADMEVKIDKKCFIRDLSFFLFTLMSLSVILMVGKVTVRIAIAFVSIYVVYAFLVAANVILRKHAKRFKLDAITPLLPMQGSVFSPSVEEDIPMHSPLIESDSEDRPPRLQNSLPQWMWASNVAIYSNHFARGSSVQDDERPPWGWIDDSAEVENSLCTKFTSLLEIPLTIPRKLTIPSVEEDTWSKTYAVASVSLAPVLLVSLWSSQENVSPQACGVAYFIGLGIGSTLGFFAYKNTEPDHPPRSFLIPWVLGGFIMSIVWFYMIANELVALLVTFGEIYGINPSILALTVLAWGNSMGDLVSNIALTMNGGDGVQIALSGCYAGPMFNTLVGLGMSMLLGAWSKSPDSYMVPEDKSLFYTLGFLVLGLVWAMVILPRNDMRPNKTLGIGLIALYLIFVTFRLSCAMGFIPWAA

SEQ ID NO: 8800 - protein, 260 aa, Brassica napus
MILGVWLVALFYLLGNTAADYFCCSLEKLSKLLRLPPTLAGVTLLPLGNGAPDVFASIAAFVGSDKGEVGLNSVLGGAVFVTSVVVGIVSLCVADMEVKLDKKCFIRDLSFFLFSLVSLMVILMVGEVTVRIAVAFVSIYVVYAFLVAANVILRKHAKRFKIEAITPLLPMQGSVFSPSVGEDVPIHSPLIESDSEDGPPRLLNSLPQWMWASNVAIYSNHFARGSSVQDDDRPLGDGLKTVRKLRAPSVINSLRCWRSH

SEQ ID NO: 8801 - protein, 638 aa, Arabidopsis lyrata
MRAVNFLYSSSNPKFRGIFNGLCAIVLFIFFFDQSDILRNPLLKNLSFVDSSGQFSNGFSQFTVIRRHLSGSFGNSSLSGDTTVSCSGLHEHRGYVDQCEFLISNPICSPDGFFDYLKYFYCSCRDFKILGYLVLGVWLVALFYLLGNTAADYFCCSLEKLSKLLRLPPTVAGVTLLPLGNGAPDVFASIAAFVGSDKGEVGLNSVLGGAVFVTCVVVGIVSLCVADKEVKIDKKCFIRDLSFFLFTLAALMVILMVGKVTVRIAIAFVSIYVLYASLVAANEILRKHSRRLKLDSITPLLPMQGSVFSPSVEEDIPMYSPLLELETEEGPPRLHDSLPQWMWATNVAIYSNHFAKANVHDEERPPWGWTEDGAEVESSLCSKFTSLLETPLTVPRRLTIPLIEEDSWSKTYAVASVSLAPVLLSFLWSSQDDTSLQARIVAYFIGIAIGSTLGYLAYKNTESDRPPQRYLIPWVLGGFIMSIVWFYMIANELVALLVTFGGIYGINPSILGLTVLAWGNSMGDLVSNIALSMNGGDGVQIALSGCYAGPMFNTLVGLGMSMFLGAWSKSPETYMIPEDNSLFYTLGFLIFGLIWSLVMLPRNEMRPNKVMGIGLIALYLIFVTFRLSSAMGFVPWAS

SEQ ID NO: 8802 - protein, 644 aa, Arabidopsis thaliana
MRAVNFMYSSNNPKFRGIFNGLCAIILFIFFFDQSDIYRNPLLKNLSFVDSSGKFNRGFSQFTVPRRHLSEVDTNGSSGNSSLSGDSTVSCSGLHEHRGYADQCEFLKSNPICSPDGFFDYLKFFYCSCRDFKILGYILLGVWLVALFYLLGNTAADYFCCSLEKLSKLLRLPPTVAGVTLLPLGNGAPDVFASIAAFVGSDKGEVGLNSVLGGAVFVTCVVVGIVSLCVADKEVKIDKKCFIRDLSFFLFTLVALMVILMVGKVTVGIAIAFVSIYVFYASLVAANEILRKHSRRLKLDSITPLLPMQGSVFSSPSVEEDIPMYSPLMELDTGEGPPRLHDSLPQWMWATNVAIYSNHFAKANVHDEERPPWGWTEDGAEVESSLCSKITSLLETPLTVPRRLTIPLIEEDSWSKTYAVASVSLAPVLLSFLWSSQDDTSLQARIVAYFIGIAIGSTLGYLAFKNTEPDRPPQIYLIPWVLGGFIMSIVWFYMIANELVALLVTFGGIYGINPSILGLTVLAWGNSMGDLVSNIALSMNGGDGVQIALSGCYAGPMFNTLVGLGMSMFLGAWSKSPETYMIPEDNSLFYTLGFLIFGLIWSLVMLPRNEMRPNKVMGIGLITLYLIFVTFRLSSAMGFIPWAS

SEQ ID NO: 8803 - protein, 206 aa, Arabidopsis lyrata
MGERIVVDKAYLYQEDKPLTVCKTSLFYTGDGFAAYDCHGDIIFRVDSYGPDTRDNDEIVLMDATGKCLLTVKRKRPTLHQRWEGFLGERSEGQKPIFSVRRSSIIGRCTMEVEVYDGTGEEYIIDGDFSQRSCLIYDTEKRTVAEIKRKVDASTNVMLGRDVFTLEIKPGFDGAFAMGLVVVLDQINGDDPVEIGDEQVHPFVED

SEQ ID NO: 8804 - protein, 115 aa, Eutrema halophilum
MGKRIVVDKAYLYEEDKPLTVCKTSLFSTGDGFAAYDCNGDIIFRVDSYGPDTRDNDEFVLMNATGKCLLTVKRKVIETDSASEMGRFSRREIGGSETDLQRPEIVDNRTVYDGS

SEQ ID NO: 8805 - protein, 218 aa, Raphanus sativus
MELVEEKAPKEENKIGERRIVVDKAYLYDEDNPLTVCKTSLFHTGDGFTTYDCNGDIIFRVDSYGRDNDEFVLMDATGKCLLTVKRKRPTLHQRWEGFVGERQEGQKPIFSVRRSSIIGRCTMEVEVYDGTGEEYTIDGDFSLRKCVIYDTEKRTVAEIKRKVDASTNVMLGRDVFTLEIKPGFDGAFAMGLVLVLDQINGDDPVEIGDEQVHPFVED

SEQ ID NO: 8806 - protein, 206 aa, Eutrema parvulum
MGKRIVVDKAYLYEEDKPLTVCKTSLFYTGDGFAAYDCNGDIIFRVDSYGPDTRDNDEFVLMNATGKCLLTVKRKRPTLHQRWEGFLGERSEGQKPIFSVRRSSIIGRCTMEVEVYDGTGEEYIIDGDFSQRNCFIYDTEKRIVAEIKRKVDASTNVMLGRDVFTLEIKPGFDGAFAMGLVLVLDQINGDDPVEIGDEQVHPFVED

SEQ ID NO: 8807 - protein, 206 aa, Unknown
  Sequence found in Organisms: Thellungiella halophila, Eutrema halophilum
MGKRIVVDKAYLYEEDKPLTVCKTSLFSTGDGFAAYDCNGDIIFRVDSYGPDTRDNDEFVLMNATGKCLLTVKRKRPTLHQRWEGFLGERSEGQKPIFSVRRSSIIGRCTMEVDVYDGTGEEYTIDGDFSLRSCLIYDTEKRTVAEIKRKVDASTNVMLGRDVFTLEIKPGFDGAFAMGLVLVLDQINGDDPVEIGDEQVHPFVED

SEQ ID NO: 8808 - protein, 207 aa, Brassica rapa
MGEKRVVVDKAYIYEEDKPLTVCKTSLFYTGDGFAAYDCHGDIIFRVDSYGPDTRDNDEFVLMDVAGKCLLTVKRKRPTLHQRWEGFLGERSDGQKPIFSVRRSSIIGRCTMEVEVYDGTGEEYTIDGDFSQRSCLIYDTNKRTVAEIKRKVDASTNVMLGRDVFTLEIKPGFDGAFVMGLVLVLDQINGDDPVEIGDEQVHPFVED

SEQ ID NO: 8809 - protein, 207 aa, Brassica napus
MGEKRVVVDKAYLYEEDKPLTVCKTSLFYTGDGFAAYDCHGDIIFRVDSYGPDTRDNDEFVLMDVAGKCLLTVKRKRPTLHQRWEGFLGERSDGQKPIFSVRRSSIIGRCTMEVEVYDGTGEEYTIDGDFSQRSCLIYDTNKRTVAEIKRKVNASTNVMLGRDVFTLEIKPGFDGAFVMGLVLVLDQINGDDPVEIGDEQVHPFVED

SEQ ID NO: 8810 - protein, 208 aa, Raphanus sativus
MGEKRVVVDKAFLYEEDKPLTVCKTSLFHTGDGFAAYDCHGDIIFRVDSYGPGTRDDDEFVLMDVTGNCLLTVKRKRPTLHQRWEGFLGERSDGQKPIFSVRRSSIIGRCTMEVEVYDETGEEYTIDGDFSQRSCLIYDTKKRTVAEIKRKVDASTNVMLGRDVFTLEIKPGFDGAFAMGLVLVLDQINGDDPVEIGDEQVHPFVEDI

SEQ ID NO: 8811 - protein, 204 aa, Brassica oleracea
MGERRVVVDKAYLYDEDKPLTVCKTSLFHTGDGFTAYDCNGDIIFRVDSYGRDNDELVLMDATGKCLLTVKRKRPTLHQRWEGFLGERSEGQKPIFSVRRSSIIGRCTMEVEVYDGSGEEYTIDGDFSLRSCLIYDTEKRTVAEIKRKVDMSTNVMLGRDVFALEIKPGFDGAFAMGLVLVLDQINGDDPVEIGDEQVHPFVED

SEQ ID NO: 8812 - protein, 204 aa, Brassica napus
MGERRVVVDKAYLYDEDKPLTVCKTSLFHTGDGFTAYDCNGDIIFRVDSYGRDNDEFVLMDATGKCLLTVKSKRPTLHQRWEGFLGERSDGQKPIFSVRRSSIIGRCTMEVEVYDGSGEEYTIDGDFSLRSCLIYDTEKRTVAEIKRKVDMSTNVMLGRDVFTLEIKPGFDGAFAMGLVLVLDQINGDDPVEIGDEQVHPFVED

SEQ ID NO: 8813 - protein, 204 aa, Unknown
  Sequence found in Organisms: Brassica napus, Brassica rapa
MGERRVVVDKAYLYDEDKPLTVCKTSLFHTGDGFTAYDCNGDIIFRVDSYGRDNDEFVLMDATGKCLLTVKSKRPTLHQRWEGFLGERSDGQKPIFSVRRSSIIGRCTMEVEVYDESGKEYTIDGDFSLRSCLIYDTEKRTVAEIKRKVDMSTNVMLGRDVFTLEIKPGFDGAFAMGLVLVLDQINGDDPVEIGDEQVHPFVED

SEQ ID NO: 8814 - protein, 194 aa, Brassica napus
YEEDKPLTVCKTSLFYTGDGFAAYDCHGDIIFRVDSYGPDTRDNDEFVLMDVAGKCLLTVKRKRPTLHQRWEGFLGERSDGQKPIFSVRRSSIIGRCTMEVEVYDGTGEEYTIDGDFSQRSCLIYDTNKRTVAEIKRKVDASTNVMLGRDVFTLEIKPGFDGAFVMGLVLVLDQINGDDPVEIGDEQVHPFVED

SEQ ID NO: 8815 - protein, 567 aa, Arabidopsis lyrata
MEGTDDACALQEPPDPEVLEVDPTFRYIRYKEVIGKGAFKTVYKAFDEVDGIEVAWNQVRIDDVLQSPNCLERLYSEVRLLKSLKHNNIIRFYNSWIDDKNKTVNIITELFTSGSLRHYRKKHRKVNMKAVKNWARQILMGLRYLHGQEPPIIHRDLKCDNIFINGNHGEVKIGDLGLATVMEQANAKSVIGTPEFMAPELYDENYNELADIYSFGMCMLEMVTFEYPYCECKNSAQIYKKVSSGIKPASLSRVKDPEVKQFIEKCLLPASERLSAKELLLDPFLQLNGLTMNNPLPLPDIVMPKEGAFGDRCLMSEGPPTTRPSKTLSIDLDEDSNLPIVTFSDNSGSRCIEVRRAKRGNFFVLKGEENDEQSVSLILRIVDENGRVRNIHFLFYQEGDTASKVSSEMVEQLELTDQNVTFIAELIDILLVNMIPTWKTDVTVDHLIHSQLNQNSRSHHNEAKPQKQEETTFHDACESVSHSWNSDCPRSEEEDKQCVDATKGENGSSNQEAEEATEPVSLEEEERLRQELEEIEAKYQEEMKEIATKREEAIMETKKKLSLMKLK

SEQ ID NO: 8816 - protein, 570 aa, Eutrema halophilum
MDGSEDASVLQEPPDPEVLEVDPTYRYIRYKEVIGKGAFKTVYKAFDEVDGIEVAWNQVRIDDVLQSPNSLERLYSEVRLLKSLKHSNIIRFYNSWIDDKNKTVNIITELFTSGSLRHYRKKHRKVNMKAVKCWARQILMGLRYLHSQEPPIIHRDLKCDNIFINGNHGEVKIGDLGLATVMEQANAKSVIGTPEFMAPELYDENYNELADIYSFGMCMLEMVTFEYPYCECRNSAQIYKKVSSGIKPASLSRVQDPEVKQFIEKCLLPASERLSAKELLLDPFLHVNGLTMNNPLPLPDIVMPKEGAFGERCLMSEGPPTTRRSRAMSIDLDEDNNLPIVTFSDNSGSRCIEVRRAKRGNFFVLKGEENDEHSVSLILRIVDENGRVRNIHFLFYQDGDTASKVSSEMVEQLELTDQNVTFIAELIDILLVNMIPTWKTDVTVDHLIHSQLNQSSRSHQNEAKPQKQEETAFHDACESVSHSWTSDCPRSDEEDKQGVDAIKGEDGSSNQEAEEATEPASVEEEESLRQELEEIEAKYQEEMKEIAKKREEAIMETKKKLSLKKVEQAE

SEQ ID NO: 8817 - protein, 570 aa, Brassica napus
MEGAEDTAPIHEPPDPEVLEVDPTLRYIRYKEVIGKGAFKTVYKAFDEVDGIEVAWNQVRIDDVLQSPNSLERLYSEVRLLKSLKHSNIIRFYNSWIDDKNKTVNIITELFTSGSLRHYRKKHRKVNMKAVKCWARQILMGLRYLHTQVPPIIHRDLKCDNIFINGNHGEVKIGDLGLATVMEQAHAKSVIGTPEFMAPELYDEIYTELADIYSFGMCMLEMVTFEYPYCECRNSAQIYKKVSSGIKPASLSRVQDPEVKQFIEKCLLPASERLSAKELLLDPFLQVNGLTMNNPLPLPDIVMPKEGAFGERCLMSEGPPATRPSKPTSMDLDEDSNLPIVTFSDNSGSRCIEVRRAKRGNFFVLKGEENDEQSVSLILRIVDENGRVRNIHFLFYQEGDTASKVSSEMVEQLELTDQNVTFIAELIDILLVNMIPTWKTDVTVDHLIHSQLNQSSRSHQNEAKPQSQEESTFHDACESVRHSWTSDCPRSEEEEKQFVDAIKGENGSDNQEAEEATEPVSLEEEERLRQELEEIEAKYQEEMKEIAKKREEAIMETKRKLSQKKVEQAG

SEQ ID NO: 8818 - protein, 570 aa, Brassica napus
MDGAEDAAPIHEPPDPEVLEVDPTLRYIRYKEVIGKGAFKTVYKAFDEVDGIEVAWNQVRIDDVLQSPNSLERLYSEVRLLKSLKHSNIIRFYNSWIDDKNKTVNIITELFTSGSLRHYRKKHRKVNMKAVKCWARQILMGLRYLHTQVPPIIHRDLKCDNIFINGNHGEVKIGDLGLATVMEQAHAKSVIGTPEFMAPELYDEIYTELADIYSFGMCMLEMVTFEYPYCECRNSAQIYKKVSSGIKPASLSRVQDPEVKQFIEKCLLPASERLSAKELLLDPFLQVNGLTMNNPLPLPDIVMPKEGAFGERCLMSEGPPATRPSKPTSMDLDEDSNLPIVTFSDNSGSRCIEVRRAKRGNFFVLKGEENDEQSVSLILRIVDENGRVRNIHFLFYQEGDTASKVSSEMVEQLELTDQNVTFIAELIDILLVNMIPTWKTDVTVDHLIHSQLNQSSRSHQNEAKPQSQEESTFHDACESVRHSWTSDCPRSEEEEKQFVDAIKGENGSDNQEAEEATEPVSLEEEKRLRQELEEIEAKYQEEMKEIAKKREEAIMETKRKLSQKKVEQAG

SEQ ID NO: 8819 - protein, 570 aa, Brassica napus
MDGAEDAAPIHEPPDPEVLEVDPTLRYIRYKEVIGKGAFKTVYKAFDEVDGIEVAWNQVRIDDVLQSPNSLERLYSEVRLLKSLKHSNIIRFYNSWIDDKNKTVNIITELFTSGSLRHYRKKHRKVNMKAVKCWARQILMGLRYLHTQVPPIIHRDLKCDNIFINGNHGEVKIGDLGLATVMEQAHAKSVIGTPEFMAPELYDEIYTELADIYSFGMCMLEMVTFEYPYCECRNSAQIYKKVSSGIKPASLSRVQDPEVKQFIEKCLLPASERLSAKELLLDPFLQVNGLTMNNPLPLPDIVMPKEGAFGERCLMSEGPPATRPSKPTSMDLDEDSNLPIVTFSDNSGSRCIEVRRAKRGNFFVLKGEENDEQSVSLILRIVDENGRVRNIHFLFYQEGDTASKVSSEMVEQLELTDQNVTFIAELIDILLVNMIPTWKTDVTVDHLIHSQLNQSSRSHQNEAKPQSQEESTFHDACESVRHSWTSDCPRSEEEEKQFVDAIKGENGSDNQEAEEATEPASLEEEKRLRQELEEIEAKYQEEMKEIAKKREEAIMETKRKLSQKKVEQAG

SEQ ID NO: 8820 - protein, 569 aa, Brassica napus
MDGSEDGAVLQEPPDPEVLEVDPTNRYIRYKEVIGKGAFKTVYKAFDEVDGIEVAWNQVRIDDVLQSPNSLERLYSEVRLLKSLKHSNIIRFYNSWIDDKNKTVNIITELFTSGSLRNYRKKHRKVNMKAVKCWARQILMGLRYLHTQVPPIIHRDLKCDNIFINGNHGEVKIGDLGLATVMEQANAKSVIGTPEFMAPELYDEDYTELADIYSFGMCMLEMVTFEYPYCECKNSAQIYKKVSSGIKPASLSRVQDPEVKQFIETCLLPASERLSAKELLLDPFLQVNGLTMNNPLPLPDIVMPKEGAFGERCLMSEGPPTTRCSRSMSIDLDEDNNLPIVTFSDNSGSRCIEVRRAKRGNFFVLKGEENDEHSVSLILRIVDENGRVRNIHFLFYQEGDTASKVSSEMVEQLELTDQNVTFIAELIDILLVNMIPTWKTDVTVDHLIHSQLNQSSRSHQNAHRQEESAAFHDACESVRHSWNSDCRRSEEEYKQCVDGVKGEDGSRNQEEAEEAIDPVRLEEEERLREELEEIEAKYREEMKEIGRRREEAIMETRKRLSQKKTEQVE

SEQ ID NO: 8821 - protein, 522 aa, Eutrema parvulum
MDGSEDAAVLQEPPDPEVLEVDPTYRYIRYKEVIGKGAFKTVYKAFDEVDGIEVAWNQVRIDDVLQSPNSLERLYSEVRLLKSLKHSNIIRFYNSWIDDKNKTVNIITELFTSGSLRHYRKKHRKVNMKAVKCWSRQILMGLRYLHSQEPPIIHRDLKCDNIFINGNHGEVKIGDLGLATVMEQANAKSVIGTPEFMAPELYDENYNELADIYSFGMCMLEMVTFEYPYCECKNSAQIYKKVSSGIKPASLSRVQDPEVKQFIEKCLLPASERLSAKELLLDPFLHVNGLTMNNPLPLPDIVMPKEGAFGERCLMSEGPPTTRRSRPMSIDLDEDNNLPIVTFSDNSGSRCIEVRRAKRGNFFVLKGEENDEHSVSLILRIVDENGRVRNIHFLFYQEGDTASKVSSEMVEQLELTDQNVTFIAELIDILLVNMIPTWKTDVTVDHLIHSQLNQSSRSHQSEAKPQKQEETAFHDACESVSHSWTSDCPRSEEEDKQCIDATKGEDRSSNHEAEEATEPVSL

SEQ ID NO: 8822 - protein, 422 aa, Arabidopsis lyrata
MGVDLRQVVAGILTITMFVMLGQMLHRDYFDSLQEKAQGDAQDIEFEGSKVSVKDGLVGTVEGSKGLWMEDNTDLNPCWPTLLSDEAVSSKGYVTFSLTNGPEYHISQISDAVMVAKHLGATLVLPDIRGSKPGDERNFEDIYDADKLIKSLENVVKVVKQLPEEVSLRNMAIVKVPTRVTEDYIKEHIDPIFKSKGNIRVASYFPSVNLRKSSQDGETDPVACLAMFGSLELQPEVNAVAESMVERLRTHSRKSGGRFIAVDLRIDILEKKNCHTTGVVGSKTCYNAQEIALFLRKLGFASDTTIYLTQPRWDSSLNILKDIFPKTFTKEAIMPASKRSKYLESESSEYENVIDFYISSRSDVFVPAISGLFYANTVGKRIALGKPQVLVPAEISETSGRATDFISPYISKKNHLAYSCFC

SEQ ID NO: 8823 - protein, 422 aa, Eutrema halophilum
MGVDLRQVVAGILTITMFVMLGQMLHRDYYDSLQKKVQGDAHDMEFEGSRVSVKDSLVGAVEGSKGPWMDDNSDLNPCWPTLLPDEAVSSKGYVTFSLTNGPEYHVSQITDAVMVAKHLGATLVLPDIRGSKPGDERSFEDIYDSDKLIKSLENVVKVVKQLPEEVSLRNIAIVKVPTRVTEDYIKEHIDPIFKSKGNIRVASYFPSVNLRKSLQDGETDPVACLAMFGSLELQPEVNAVVESMVERLRTHSRKSGGRFIAVDLRIDILEKKNCHSTGVVGSKTCYNAQEIALFLRKLGFAGDTTIYLTQPRWDSSLNILKNIFPKTFTKEAIMPASKRSKYLESENSEYENVIDFYISSRSDVFVPAISGLFYANTVGKRIALGKPQVLVPAEISETSGIATDFISPYISKKNHLAYSCFC

SEQ ID NO: 8824 - protein, 422 aa, Brassica rapa
MGVDLRQVVAGILTITMFVMLGQMLHRDYFDSLQEKAQGDAHDIEFEGSRVSVKDSLVGAVEGSKGPWMDDTNDLNPCWPTLLSDEAVSSKGYVTFSLTNGPEYHISQITDAVMVAKHLGATLVLPDIRGSKPGDERNFEDIYDADKLIKSLKNVIKVVKQLPEEVSLRDIAIVKVPTRVTEDYIKENIDPIFKSKGNIRVATYFPSVNLRKSSQEGETDPVACLAMFGSLELQPELNAVVESMIERLRTHSRKSAGRFIAVDLRIDILEKKHCHSTGVVGSKTCYNAQEIAVFLRKLGFAGDTTIYLTQPRWDSSLNILKDIFPKTFTKEAIMPASKKSKYLESESSEYENVIDFYISSRSDVFVPAISGLFYANIVGKRIALGKPQVLVPAEISETSGLATDFISPYISKKNHLAYSCFC

SEQ ID NO: 8825 - protein, 422 aa, Brassica napus
MGVDLRQVVAGILTITMFVMLGQMLHRDYFDSLQEKAQGDAHDIEFEGSRVSVKDSLVGGVEGSKGPWMDDTNDLNPCWPTLLSEEAVSSKGYVTFSLTNGPEYHISQITDAVMVAKHLGATLVLPDIRGSKPGDERNFEDIYDADKLIKSLKNVIKVVKQLPEEVSLRDIAIVKVPTRVTEDYIKENIDPIFKSKGNIRVATYFPSVNLRKSSQDGETDPVACLAMFGSLELQPELNAVVESMIERLRTHSRKSAGRFIAVDLRIDILEKKHCHSTGVVGSKTCYNAQEIAVFLRKLGFAGDTTIYLTQPRWDSSLNILKDIFPKTFTKEAIMPASKKSKYLESESSEYENVIDFYISSRSDVFVPAISGLFYANIVGKRIALGKPQVLVPAEISETSGLATDFISPYISKKNHLAYSCFC

SEQ ID NO: 8826 - protein, 422 aa, Eutrema parvulum
MGVDLRQVVAGILTITMFVMLGQMLHRDYFDSLQEKAQVDGQDIEFEGSRVAVKDSLVGAVEGSKGPWMDDNNDHNPCWPTLLSDEAVSSKGYVTFSLTNGPEYHISQITDAVMVAKHLGATLVLPDIRGSKAGDERNFEDIYDADKLIKSLENVVKVVKQLPEEVSLMNIAIVKVPNRVTEDYIKENIAPIFKSKGNIRVATYFPSLNLRKSSQDGETDPVACLAMFGSLELQPEVNAVVESMIERLRTHSRKSGGRFIAVDLRIDILEKKNCHSTGVVGSKTCYNAQEIALFLRKLGFAGDTTIYLTQPRWDSGLNILKDIFPKTFTKEAIMPASKKSKYLESENSEYENVIDFYISSRSDMFVPAISGLFYANTVGKRIALGKPQVLVPAEISETSGLATNFISPYISKKNHLAYSCFC

SEQ ID NO: 8827 - protein, 422 aa, Brassica napus
MGVDLRQVVAGILTITMFVMLGQMLHRDYYDSLQEKAQGDAHDIEFEGSRVSVKDSLVGALEGNKGPWMDDNNDLNPCWPTLLSDEAVSSKGYVTFSLTNGPEYHISQITDAVMVAKHLGATLVLPDIRGSKPGDERNFEDIYDADKLIKSLDNVIKVVKQLPEQVSLRDIAIVKVPTRVTEDYIKEHIEPIFKSKGNIRVATYFPSVNLRKSSQDGETDPVACLAMFGSLELQPELNAVVESMIERLRTHSRKSDGRFIAVDLRIEALEKKNCHSTGVGGSKTCYNAQEIAVFLRKLGFAGDTTIYLTQPRWDSSLNILKDIFPKTFTKEAVMPASKRSKYLESESSEYENVIDFYISSRSDVFVPAISGLFYANTVGKRIALGKPQVLVPAEISETSSLATDFISPYISKKNHLAYSCFC

SEQ ID NO: 8828 - protein, 422 aa, Brassica napus
MGVDLRQVVAGILTITMFVMLGQMLHRDYYDSLQEKAQGDAHDIEFEGSRVSVKDSLVGALEGNKGPWMDDNNDLNPCWPTLLSDEAVSSKGYVTFSLTNGPEYHISQITDAVMVANHLGATLVLPDIRGSKPGDERNFKDIYDADKLIKSLENVVKVVKQLPEQVSLRDIAIVKVPTRVTEDYIKEHIEPIFKSKGNIRVATYFPSVNLRKSSQDGETDPVSCLAMFGSLELQPELNAVVESMIERLRTHSSKSGGRFIAVDLRIEALEKKNCHSTGVGGSKTCYNAQEIAVFLRKLGFAGDTTIYLTQPRWDSSLNILKDIFPKTFTKEAVMPASKRSKYLESESSEYENVIDFYISSRSDVFVPAISGLFYANTVGKRIALGKPQVLVPAEISETSSLATDFISPYISKKNHLAYSCFC

SEQ ID NO: 8829 - protein, 422 aa, Brassica rapa
MGVDLRQVVAGILTITMFVMLGQMLHRDYYDSLQEKAQGDAHDIEFEGSRVSVKDSLVGALEGNKGPWMDDNNDLNPCWPTLLSDEAVSSKGYVTFSLTNGPEYHISQITDAVMVAKHLGATLVLPDIRGSKPGDERSFEDIYDADNIIKSLENVIKVVKQLPEQVSLRDIAIVKVPTRVTEDYIKEHIEPIFKSKGNIRVATYFPSVNLRKSSQDGETDPVACLAMFGSLELQPELNAVVESMIERLRTHSRKSDGRFIAVDLRIEALEKKNCHSTGVGGSKTCYNAQEIAVFLRKLGFAGDTTIYLTQPRWDSSLNILKDIFPKTFTKEAVMPASKRSKYLESESSEYENVIDFYISSRSDVFVPAISGLFYANTVGKRIALGKPQVLVPAEISETSSLATDFISPYISKKNHLAYSCFC

SEQ ID NO: 8830 - protein, 423 aa, Raphanus sativus
MGVDLRQVVAGILTITMFVMLGQMLHRDYYDSLQEKAQGDAAHDMEFEGSRVSVKDSLLGAVEGSKGPWMDDNNDLNPCWPTLLSDEAVSSKGYVTFSLTNGPEYHISQITDAVMVTKHLGATLVLPDIRGSKPGDERNFEDIYDADKLIKSLENVIKVVKQLPEQVSLRDMAIVKVPTRVTKDYIKENIDPIFKSKGNIRVATYFPSVNLRRSSQDGETDPVACLAMFGSLELQPALNAVVESMVERLRTHSRKSGGRFIAVDLRIDLLEKRNCHSTGVVGSKTCYNAQEIAVFLRKLGFAGDTTIYLTQTRWDSSLNILKDIFPKTFTKEVIMPASKKSKYLESESSEYENVIDFYISSRSDVFVPAISGLFYANIVGKRIALGKPQVLVPAEISETSGLATDFISPYISKKNHLAYSCFC

SEQ ID NO: 8831 - protein, 422 aa, Raphanus sativus
MGVDLRQVVAGILTIAMFVMLAQMLHRDYLDSLQEKAQGDANDIEFEGSRVSVKESLVGALEGNKGPWMDDNNDLNPCWPTLLSDEAVSSKGYVTFSLTNGPEYHISQITDAVMVAKHLGATLVLPDIRGSKPGDERSFEDIYDADKLIKSLENVIKVVKQLPEEVSLRDIAIVKVPTRVTEDYIKEHIEPIFKSKGNIRVATYFPSVNLRKSSQDGETDPVACLAMFGSLELQPELNAVVESMIERLRTHSKKSGGRFIAVDLRIEALEKKNCHSTGVAGSKTCYNAQEIAVFLRKLGFSGDTTIYLTQPRWDSSLNILKDIFPKTFTKEAIMPASKRSKYLESESSEYENVIDFYISSRSDVFVPAISGLFYANTVGKRIALGKPQVLVPAEISESSSLATDFISPYISKKNHLAYSCFC

SEQ ID NO: 8832 - protein, 422 aa, Eutrema parvulum
MGVDLRQVVAGILTITMFVMLGQMLHRDYFDAVQEKVQGDAHDIEFQGSKVAVEDGLVRASEGNKGPWMEDSHELKPCWSISQSDEAVSSKGYVTFSLTNGPEYHVSQITDAVMVAKHLGATLVLPDIRGSKPGDEMNFEDIYDVDKLVKSLESVVKVVKKLPSHVSLRDIAIVKVPTRVAEDYIKEHIDPIFKSKGNIRVTTYFPSVNLRKSSRDAETDPVSCLAMFGSLELQSGVSELVESMIQRLKTHSKKSGGRFIAIDLRVEILEKKNCHETGAVGSKTCYNAQEIALFLRKLGFDSDTTIYLTQPRWESSLNILKDIFPKTFTKEEIMPADKKSKYLELENSEYENVIDFYISSRSDVFVPAIPGLFYANTVGKRIALGKPQVLVPAEISGTSGLSTDYITPYISKKNHLAYSCFC

SEQ ID NO: 8833 - protein, 422 aa, Eutrema halophilum
MGVDLRQVVAGILTITMFVMLGQMLHRDYFDPAQEKIQGDSHDIEFQGSKVAVEDGLVRTFEGNKGPWMEDCHELKPCWSISQPDEAVSSKGHVTFSLTNGPEYHVSQITDAVMVAKHLGATLVLPDIRGSKPGDEMNFEDIYDVDKLVKSLESVVKVVSKLPSHVSLRDIAIVKVPTRVAEDYIKEHIDPIFKSKGNIRVTTYFPSVNLRKSSRDAETDPVSCLAMFGSLELQTGVNELVESMIQRLKSHSKKSGGRFIAIDLRVEILEKKNCHETGAVGSKTCYNAQEIALFLRKLGFGSDTTIYLTQPRWDSSLNILKDIFPKTFTKEAIMPSDKKSKYLELENSEYENVIDFYISSKSDVFVPAIPGLFYANTVGKRIALGKPQVLVPAEISGTSGLSTDYISPYISKKNHLAYSCFC

SEQ ID NO: 8834 - protein, 417 aa, Raphanus sativus
MGVDLRQVVAGILTITMFVMLGQMLHRDYFDAQVQGDAHDIEFHGSKVSLEDGLVRSREGNHGPWMEDSHDLKPCWSISESDEAVSSKGYVTFSLTNGPEYHVSQITDAVMVAKHLGATLVLPDIRGSKPGDEMNFEDIYDADKLVKSLESVLKVVKKLPSHVSLRDIAIVKVPTRVAEDYIKEHINPIFKSKGNIRVTTYFPSVNLRKSSLDGETDPVSCLAMFGSLELQPGVNELVESMVQRLKSKSSGGRFIAIDLRVEILEKKNCHETGAGGSKTCYNAQEIAVFLRKLGFDGDTTIYLTQPRWDSSLNILKDIFPKTFTKEAIMPAEKKSKYLELENSEYENVIDFYISSRSDVFVPAIPGLFYANTVGKRIALGKPQVLVPAEISGTSGLSTDYISPYISKKNHLAYSCFC

SEQ ID NO: 8835 - protein, 423 aa, Arabidopsis thaliana
MGVDLRQVVAGILTITMFVMLGQMLHRDYFDAVQEKVQGDAHDIEFHGSKVAVEDGLVRAFEAGTKGPWMEDSHELKPCWSISQSDEAVSSKGYVTFSLTNGPEYHVSQITDAVMVAKHLGATLVLPDIRGSKPGDEMKFEDIYDVDKLIKTLESVVKVVRKLPSHVSLRDIAIVKVPTRVAEDYIKEHIDPIFKSKGNIRVTTYFPSVNLRKSSQGAETDPVSCLAMFGSLELQPAVNELVESMIQRLKTHSKKSGGRFIAIDLRVEILEKKNCHETGAVGSKTCYNAQEIALFLRKLGFDSDTTIYLTQPRWESSLNILKDIFPKTYTKEAIMPSDKKTKYLELENSEYENVIDFYISSRSDVFVPAIPGLFYANTVGKRIALGKPQVLVPAEISGTSGLPANYISPYISKKNHLAYSCFC

SEQ ID NO: 8836 - protein, 423 aa, Arabidopsis lyrata
MGVDLRQVVAGILTITMFVMLGQMLHRDYFDAVQEKVQGDAHDIEFQGSRVAVEDGLVRAFEGGNKGPWMEDSHGLKPCWSISQSDEAVSSKGYVTFSLTNGPEYHVSQITDAVMVAKHLGATLVLPDIRGSKPGDEMNFEDIYDVDKIVKSLESVVKVVRKLPSHVSLRDIAIVKVPTRVAEDYIKEHIDPIFKSKGNIRVTTYFPSVNLRKSSQGAETDPVSCLAMFGSLELQPGVNELVESMIQRLKTHSKKSGGRFIAIDLRVEILEKKNCHETGAVGSKTCYNAQEIALFLRKLGFDRDTTIYLTQPRWESSLNILKDIFPKTYTKEAIMPSDKKSKYLELENSEYENVIDFYISSRSDVFVPAIPGLFYANTVGKRIALGKPQVLVPAEISGTSGVPTNYISPYISKKNHLAYSCFC

SEQ ID NO: 8837 - protein, 419 aa, Brassica napus
MGVDLRQIVAGILTITMFVMLGQMLHRDYFDAVQEKVEGDAHDIEFHGSKVAVVEDGLVRVSEGIKGPWMRDSHELKPCWSISSSDEAVSSKGYVTFSLTNGPEYHISQITDAVMVAKHLGATLVLPDIRGSKPGDEMNFEDIYDVDKFVKSLESVVKVVKKLPSHVSLRDIAIVKIPTRVAEDYIKEHIDPIFKSKGNIRVTTYFPSVNLRKSSLDGETDPVSCLAMFGSLELQPGVSDLVESMIQRLKKSGGRFVAIDLRLEVLEKKNCRETGAVGSKTCYNAQEIALFLRKLGFESDTTIYLTQPRWESRLNILKDIFPKTFTKEVIMPASKKSKYLELENSEYENVIDFYISSRSDVFVPAIPGLFYANTVGKRIALGKPQVLVPADISGTSGLSTDCISPYISKKNHLAYSCFC

SEQ ID NO: 8838 - protein, 418 aa, Unknown
  Sequence found in Organisms: Brassica napus, Brassica rapa
MGVDLRQVVAGILTITMFVMLGQMLHRDYFDANQVQGDAHDIEFHGSKVSLEDGLVRSSEGTKGPWMEDSNDLKSCWSISESDEAVSSKGYVTFSLTNGPEYHVSQITDAVMVAKHLGATLVLPDIRGSKPGDEMNFEDIYDVDKLVKSLESVIKVVKKLPSHVSLRDIAIVKVPTRVAEDYIKEHISPIFKSKGNIRVTTYFPSVNLRKSSLDGGETDPVSCLAMFGSLELQPGVNELVEAMIQRLKKKSNGRFIAIDLRVEILEKKNCRETGAGGSKTCYNAQEIAVFLRKLGFDGDTTIYLTQPRWESSLNILKDIFPKTFTKEAIMPAEKKSKYLELENSEYENVIDFYISSRSDVFVPAIPGLFYANTVGKRIALGKPQVLVPAEISGTSGLSTDYISPYISKKNHLAYSCFC

SEQ ID NO: 8839 - protein, 414 aa, Brassica napus
MGVDLRQVVAGILTITMFVMLGQMLHRDYFDAVQVQGDAHDIVFHGSKVSLEEDGLVRTSEGPWMENSHQLKPCWSLSQPDEEVSSKGYVTFSLTNGPEYHISQITDAVMVAKHLGATLVLPDIRGSKPGDEMNFEDIYDVDKLVKSLESVVNVVKKLPSHVSLRDIAIVKVPSRVAEDYIKEHIDPIFKSKGNIRVTTYFPSVNLRKSSLDGETDPVSCLAMFGSLELKPGVSDLVESMIQRLKKSDGRFIAIDLRVEILEKKNCRETGGMGSKTCYNAQEIALFLRKLGFGSDTTIYLTQPRWESSLNILKDIFPKTFTKEAIMPAEKKGKYLELENSEYENVIDFYISSRSDVFVPAIPGLFYANTVGKRIALGKPQVLVPAEISGSSGLSTDYISPYISKKNHLAYSCFC

SEQ ID NO: 8840 - protein, 370 aa, Brassica napus
EKAQGDAHDIEFEGSRVSVKDSLVGALEGSKGPWMDDNNDLNPCWPTLLSDEAVSSKGYVTFSLTNGPEYHISQITDAVMVAKHLGATLVLPDIRGSKPGDERNFEDIYDADKLIKSLEKVIKVVKQLPEEVSLRDMAIIKVPTRVTEDYIKENIDPIFKSKGNIRVATYFPSVNLRKSSQDGETDPVACLAMFGSLELQPELNAVVESMVERLRTHSRKLGGRFIAVDLRIDLLEKKHCHSTGVVGSKTCYNAQEIALFLRKLGFAGDTTIYLTQPRWDSSLDILKDIFPKTFTKEAIFPASKKSKYLESESSEYENVIDFYISSRSDVFVPAISGLFYANIVGKRIALGKPQVLVPAEISETSGLATV

SEQ ID NO: 8841 - protein, 108 aa, Arabidopsis lyrata
MSKPILLVGLLVILIVTSQFEWRQPLVELDTATSSSQKQQQISDREEAVKEKIIISQERHIQRLNELVRSLQLQLLQCKGENETQNATKSYHLNKQFIEVERKQILEG

SEQ ID NO: 8842 - protein, 109 aa, Eutrema halophilum
MSKPILLVFLLIILIVTSQFEWRQPLVELDAATSLSQKQQQISDREEAVKEKIIMSQERHIQRLNELVRSLQLQLLRCKGENETQNATKSYHMNKKYIKEVERKQILEG

SEQ ID NO: 8843 - protein, 65 aa, Eutrema halophilum
MSKPILLVFLLIILIVTSQFEWRQPLVELDAATSLSQKQQQISDREEAVKEKVRSSCPKRDISRG

SEQ ID NO: 8844 - protein, 108 aa, Brassica napus
MSKPIMLVCLLVILIVTSQFEWRQPLVDLDAPTTISQKQQQISDREESVKEKIIISQERHIQKLNELVRSLQLQLLQCKGDNGTQNATKSFHSDKHFIEVERKQIFQG

SEQ ID NO: 8845 - protein, 108 aa, Brassica napus
MSKPIMLVCLLVILIVTSQFEWRQPLVDLDAPTTISQKQQKISDREESVKEKIIISQERHIQKLNELVRSLQLQLLQCKGDNGTQNATKSFHSDKHFIEVERKQIFQG

SEQ ID NO: 8846 - protein, 108 aa, Raphanus sativus
  misc_feature (5)..(5): Xaa can be any naturally occurring amino acid
  misc_feature (88)..(88): Xaa can be any naturally occurring amino acid
MSKPXMLVCLLVILIVTSQFEWRQPLVDLDSPTTISQKQQQFSDKEEAVKEKIIISQERHIQKLNELVRSLQLQLLQCKGDNGTQNAXKSFHSDKQFIEVERKQIFQG

SEQ ID NO: 8847 - protein, 110 aa, Eutrema parvulum
MSKHIMLVFVLIVLIVTSQFEWRQPLVVDLDAATSLSQKQQQILDREEAVKEKIIISQERHIQKLNELVRSLQLQVLQCKEENETQNATKSYHLNKQFIEEVESKQILES

SEQ ID NO: 8848 - protein, 352 aa, Arabidopsis lyrata
MILTSISLSTPVSSQRFSPPPATTTRRSHISVTVCSSKGLLKNAELKCFLEKPIGNLSLRKHLVSGLAAILLLSQAGQGIALDLSSGYQNICQLGSASVEETKLTLPLDNASDGDSEAMMMMMMRGMTTKNFDPVRYSGRWFEVASLKRGFAGQGQEDCHCTQGVYSFDMKESAIRVDTFCVHGSPDGYITGIRGKVQCVGAEDLEKSETDLEKREMIKEKCFLRFPTIPFIPKLPYDVIATDYDNYALVSGAKDKGFVQVYSRTPNPGPEFIAKYKNYLAQFGYDPDKIKDTPQDCEVMSDGELAAMMTMPGMEQTLTNQFPDLGLRKSVQFDPFTSVFETLKKLVPLYFK

SEQ ID NO: 8849 - protein, 353 aa, Eutrema halophilum
MVSIPVSSQSFSPPATTRRCSLVRIDKRSHLPDTIRCCCSSTGFLKNLELKCSLENPIQSKSLRNRFVSEFATILLLSQAGQGVALDLSSGHQNICQLGNASVEEKNLTLPLVNGDPETMMMMMTRGMTAKNFDPVKYSGRWFEVASLKRGFAGQGQEDCHCTQGVYTFDMKEPAIRVDTFCVHGSPDGYITGIRGKVQCVADEDLEKSETDLEKREMIKEKCFLRFPTIPFIPKLPYDVIATDYDNYALVSGAKDKGFVQVYSRTPNPGPEFIAKYKNYLAQFGYDPEKIKDTPQDCEVMSDGQLAAMMSMPGMEQTLTNQFPDLGLRKSVQFDPFTSVFETLKKLVPLYFK

SEQ ID NO: 8850 - protein, 345 aa, Eutrema parvulum
LFHLLNRRCSVVRIDSRSHYSDRIRCCSSSKVFPKRPELKCSLENLIESKALRKHFISGFAAILLLSQAGQGVALDLSSDHQNVCQLGSAALEGNKLTLPLENASDGDPETMMMMMMRGMTAKNFDPVRYSGRWFEVASLKRGFAGQGQEDCHCTQGVYSFDMKEPAIRVDTFCVHGSPDGYITGIRGKVQCVGAEDLEKTETDLEKQEMIKEKCFLRFPTIPFIPKLPYDVIATDYDNYALVSGAKDKGFVQIYSRTPTPGPEFIAKYKTYLAQFGYDPDKIKDTPQDCEVMSDGQLAAMMSMPGMEKTLTNQFPDLELRKSVQFDPFTSVFETLKKLVPLYFK

SEQ ID NO: 8851 - protein, 346 aa, Brassica napus
MVSNIITSLSMTLVLPQSFTRPANTRCSVVRRINSRSHYSDRIICSLENPTESKEALRKHFVSGFAAILLLSQAGQGVALDLSSRYHNICQLGSASVEGNKPTLPLDDDPEAMMMMMMRGMTAKNFDPVRYSGRWFEVASLKRGFAGQGQEDCHCTQGVYTFDMKEPAIRVDTFCVHGSPDGYITGIRGKVQCVGAQDLEKTETDLEKQEMIKEKCYLRFPTIPFIPKLPYDVIATDYDNYALVSGAKDRSFVQVYSRTPNPGPEFIAKYKDYLAQFGYDPENIKDTPQDCEVMSDGQLAAMMSMPGMEKTLTNQFPDLELRKSVQFDPFTSVFETLKKLVPLYFK

SEQ ID NO: 8852 - protein, 352 aa, Raphanus sativus
MASNIITSLSTTLVLPQSFTRPANTRFAVRRINSRSHDSKGFLKKSTVKCSLENPIESKETLRKHFVAGFATILLLSQAGQGVALDLSSGQDHNICQLGSAAVEENKPTLPLDNDPEEMMMMMMRGMTAKNFDPVRYSGRWFEVASLKRGFAGQGQEDCHCTQGVYTFDMKEPAIRVDTFCVHGSPDGYITGIRGKVQCVGAQDLEKTETDLEKQEMIKEKCYLRFPTIPFIPKLPYDVIATDYDNYALVSGAKDRSFVQVYSRTPNPGPEFIAKYKDYLAQFGYDPEKIKDTPQDCEVMSDGQLAAMMSMPGMEKTLTNQFPDLELRKAVQFDPFTSVFETLKKLVPLYFK

SEQ ID NO: 8853 - protein, 356 aa, Arabidopsis lyrata
MAVAENAGVKVDSSSGQNLDNNTDSATETKPPCPDDDQSPKSDSSNPPTIDSTPETDDRINETAQKGQTLNGFNRNGERDNNGGSLKTEIKDLADAFSKLNPMAQEFVPPSLARSQSGVFRNGLGFTNNFAAPPKLADGNDHFPTRRRSFGQGKRRINKRTSLAQKDDVIRRTVYVSDIDQQVTEENLAGVFINCGQVVDCRVCGDPNSVLRFAFIEFTNEEGARAALSMSGTVLGFYPLKVLPSKTAIAPVNPTFLPRSEDEREMCVRTVYCTNIDKRITQIDLKVFFEMLCGEVHRLRLGDYHHQTRIAFVEFAMAESAIAALHCSGIVLGALPIRVSPSKTPVRPHFPRADFK

SEQ ID NO: 8854 - protein, 369 aa, Eutrema parvulum
MAVAENAGVKVDSSGQNLDNNNNTASSAAETKPPCPDDQSPKSDSSLDSSNPPTNDSTPDSDDRTNETPKKGPTPNGFNKNGIESKSEDGEGENNGECLKSEIKNLADAFSKLNPMAQEFVPPSLARSQSGVLRNGLGFTNNFAAQPVPADGNDRFARRRRSFGQGKRRMNKRTSLAQKEDVIKRTVYVSDIDQQITEETLAGVFINCGQVVDCRVCGDPNSVLRFAFVEFTNEEGARAALSMSGTVLGFYPLKVLPSKTAIAPVNPTFLPRSEDEREMCVRTVYCTNIDKRISQTDLKGFFEMLCGEVHRLRLGDYHHQTRIAFVEFAMAESAIAALHCSGIVLGALPIRVSPSKTPVRPHFHRAECN

SEQ ID NO: 8855 - protein, 370 aa, Eutrema halophilum
MAVAENAGVKVDSSGQNLDNNNNNTDSSAAETKPPCPDDQSPKSDSSLDSSNPPTSDSALDSDDRTNESAKKGQTPNGFNRNGFGSKSENGEIENNGGSLKSEIKNLSDAFSKLNPMAKEFVPPSLARSQSGVLRNGLGFNNNFASQPVLADGNDNFARRRRNFGQGKRRVNKRTSSAQKEDVIRRTVYVSDIDQQVTEENLAGVFVNCGHVVDCRVCGDPNSVLRFAFIEFTNEEGARAALSMSGTVLGFYPLKVLPSKTAIAPVNPTFLPRSEDEREMCVRTVYCTNIDKRITQIDLKGFFEMLCGEVHRLRLGDYHHQTRIAFVEFAMAESAIAALHCSGVVLGALPIRVSPSKTPVRPQFPRAECN

SEQ ID NO: 8856 - protein, 339 aa, Brassica napus
MAVAENAGVKVDSSGQNLDNNNTASSATETNPSCPDDQSPKSDSSLDSSSDPPDSDDRTNETVQKGQTANGVKSEIKNLSDAFSKLNPMAKEFVPPSLARSQSGVSRNGLGFTNSFAAQPLVADGSGQFARRRRSFGQGRRRVNKRTSLAQKEDVIKRTVYVSDIDHQVTEENLAGVFVNCGQVVDCRVCGDPNSVLRFAFVEFTNEEGARAALSMSGTVLGFYPLKVLPSKTAIAPVNPTFLPRSEGEREMCLRTVYCTNIDKRISQVELKGFFEMICGEVFRLRLGDYHNHTRIAFVEFAMADSAITALHCSGMVLGALPIRVSPSKTPVRPHIHRP

SEQ ID NO: 8857 - protein, 341 aa, Brassica napus
MAVAENAGVKVDSSGHNLDNNNTASSATETNPSCPDDQSPKSDSSLDSSSDPPTPDSDDRTNETVQKGQTANGVKSEIKNLSDAFSKLNPMAKEFVPPSLARSQSGVSRNGLAFTNSFAAQPLVADGNGQFATRRRSFGQGRRRVNKRTSLAQKEDVIKRTVYVSDIDHQVTEENLAGVFVNCGQVVDCRVCGDPNSVLRFAFVEFTNEEGARAALSMSGTVLGFYPLKVLPSKTAIAPVNPTFLPRSEGEREMCLRTVYCTNIDKRISQVELKGFFEMICGEVFRLRLGDYHNHTRIAFVEFAMADSAITALHCSGMVLGALPIRVSPSKTPVRPHIHRP

SEQ ID NO: 8858 - protein, 562 aa, Arabidopsis lyrata
MADGFRSYGGFSGIAYPLWLSSPPPPHPASAPPFQPSNPVESYDPTKEVFDPMMYPGSYQRSPDDWSNNPSYRENSRSQTPSSSFYADNTRLGNCGPRGEDYYKEMLSPSGFYSSRESSSDFVSLPADNFWERQRLNFTPTYNSATLAPVSSYADMLIKNSREPFFTPITSSGVYASSNVVDENRPGYYFPETMNVVSASHVEPYIGVTDCNPSLPMTNLKTQALFDGSQTGVRLGDGRSFPSNSDVCSQAPENFLGAQSSLQSSSVEPVNFDVLLGYGEATGHIRPSPENPDLRYRIAGSQGLRSPGSSHPLPANINSSVSLINDKLEGSGVSSLYQRPYTLVADSENGVSESSLKNASEDLNCHEPRSWSHFMVTSEGPSAPTMKADNENAQSAVNYKPPFEGGTTQTSEDVPTNQKSCNLQEQTFDIIDRDKKIMLLTDLGLDLSSRSNADDVSTGRSPEKHFCDQGDFPSPTSSPRVSSVVNAMHNLSEVLVYECFNNGSWLKLEQLENLDKVVDNLTKCLKKITDNKSTAGEASLPTQAMHEVCSSFTPAFCREGNC

SEQ ID NO: 8859 - protein, 659 aa, Arabidopsis lyrata
MGTEEYRFPQGPEELHHRHHHTVEAPQPQPFLKSLQYSVKETLFPDDPFRQFKNQNASRKVVLGLKYFLPIFEWAPRYNLKFFKSDLIAGITIASLAIPQGISYAKLANLPPILGLYSSFVPPLVYAVLGSSRDLAVGTVAVASLLTGALLSKEVDAEKDPKLYLHLAFTATFFAGVFEASLGIFRLGFIVDFLSHATIVGFMGGAATVVSLQQLKGIFGLKHFTDATDVISVMRSVFSQTHQWRWESGVLGCGFLFFLLSTRYFSTKKPKFFWVAAMAPLTSVILGSLLVYFTHAERHGVQVIGNLKKGLNPLSGSDLIFTSPYMSTAVKTGLITGIIALAEGIAVGRSFAMFKNYNIDGNKEMIAFGMMNIVGSFTSCYLTTGPFSRSAVNYNAGCKTAMSNIVMAIAVMFTLLFLTPLFHYTPLVVLSAIIISAMLGLIDYQAAIHLWKVDKFDFLVCMSAYVGVVFGSVEIGLIVAVAISIARLLLFVSRPRTAVKGNIPNSMIYRNTEQYPSSRTVPGILILEIDAPIYFANASYLRERIIRWIDEEEERVKQSGESSLQYIILDMSAVGNIDTSGISMMEEIKKVIDRRALKLVLANPKGEVVKKLTRSKFIGDHLGKEWMFLTVGEAVEACSYVLHTFKTEPASKNEPWNNV

SEQ ID NO: 8860 - protein, 658 aa, Eutrema halophilum
MGTADYTFPQGAEESHRRHHTVEAPEPQPFLKSLQYSLKETLFPDDPFRQFKNQKASRKVVLGIKYFFPICEWAPRYNLKFFKSDLIAGITIASLAIPQGISYAKLANLPPILGLYSSFVPPLVYAVLGSSKDLAVGTVAVASLLTGAMLSKEIDAEKYPKLYLQIAFTATFFAGVFEASLGFFRLGFIVDFLSHATIVGFMGGAATVVSLQQLKGIFGLKHFTEATDVISVMRSVFSQTHQWRWESGVLGCGFLFFLLSTKYFSTKKPKFFWVAAMAPLTSVILGSLLVYFTHAERHGVQVIGNLKKGLNPLSVSDLVFTSPYMSTAVKTGLITGIIALAEGIAVGRSFAMFKNYNIDGNKEMIAFGMMNIVGSLTSCYLTTGPFSRSAVNFNAGCKTAVSNIVMAIAVMFTLLFLTPLFHYTPLVVLSSIIIAAMLGLIDYQAAFHLWKVDKFDFLVCMSAYFGVVFGSVEIGLVLAVAISIARLLLFMSRPRTAVKGNIPNSMIYRNTEQYPYSRTVPGLLILEIDAPIYFANAGYLRERITRWIDEEEERVKTSGESSLQYVILDMSAVGNIDTSGISMMEEIKKIIDRRALKLVLANPKGEVVKKLTRSKFIDGNLGKEWMFLTVGEAVEACSFRLHTFKNEPASKEEPWNNV

SEQ ID NO: 8861 - protein, 658 aa, Brassica napus
MGTEDNTFPQGAEEPHRRHHAVEAPDPQPFLKSLQYSVKETLFPDDPFRQFKNQTTSRQVVLGLKYFLPILEWAPRYNFKLFKSDLIAGITIASLAIPQGISYAKLANLPPILGLYSSFVPPLVYAVLGSSKDLAVGTVAVGSLLTGAMLSKEVDAEKDPKLYLHLAFTATFFAGVLEASLGIFRLGFIVDFLSHATIVGFMGGAATVVSLQQLKGIFGLKHFTEATDVISVMRSVFSQTHQWRWESGVLGCCFLFFLLSTRYFSTKKPKFFWVAAMAPLTSVILGSLLVYFTHAERHGVQVIGDLKKGLNPLSVSDLVFTSPYMSTALKTGLITGIIALAEGIAVGRSFAMFKNYNIDGNKEMIAFGMMNIVGSFTSCYLTTGPFSRSAVNFNAGCKTAVSNIVMAIAVMFTLLFLTPFFHYTPLVVLSSIIMVAMLGLIDYQAAIHLWKVDKFDFLVCMSAYFGVVFGSVEIGLVVAVVISIARLLLFVSRPRTAVKGNIPNTMIYRNTDQYPYSRIVPGLLILEIDAPIYFANAGYLRERITRWIDEEEDRIKASGGNSLQYVILDMSAVGNIDTSGISMMEEIKKIMDRRELKLVLANPKGEVVKKLTRSKFIGDNLGKEWMFLTVGEAVEACSFMLHTSKTEPASKEEPWNNV

SEQ ID NO: 8862 - protein, 658 aa, Eutrema parvulum
MGTVDYKLPQEAEEPHRRYHTVEAPKPQPFLKSLQYSVKETLFPDDPFRQFKNQKASTRVVLGLKYFFPICEWAPRYSLSFFKSDLIAGITIASLAIPQGISYAKLANLPPILGLYSSFIPPLVYAVLGSSRDVAVGTVAVASLLIGAMLSKEVDAEKDPKLYLQLAFTATFIAGVLEASLGIFRLGFIVDFLSHATIVGFMGGAATVVSLQQLKGIFGLRHFTEATDVISVMRSVFSQTHQWRWESGVLGCGFLFFLLSTKYFSMKKPKFFWVAAMAPLTSVILGSLLVYFTHAERHGVQVIGNLKKGLNPLSVSDLVFTSPYMSTAVKTGIITGIIALAEGIAVGRSFAMFKNYNIDGNKEMIAFGMMNIVGSFTSCYLTTGPFSRTAVNFNAGCKTAVSNIVMAIAVMFTLLFLTPFFYYTPLVVLSSIIISAMLGLIDYQAAIHLWKVDKFDFFVCMSAYIGVVFGSVEIGLVVAVAISIARLLLFVSRPKTAVKGNIPNSMIYRNTEQYPYSRTVPGLLILEIDAPIYFANAGYLRERITRWIDEEEERVKISGENSLQYVVLDMSAVGNIDTSGISMMEEIKKVIDRRELKLVLANPKGEVVKKLTRSEFIGGSLGKEWMFLTVGEAVEACSFMLHTLKTEPASKEEQWNNV

SEQ ID NO: 8863 - protein, 658 aa, Brassica napus
MGTEDNTFPQGAEEPHRRHHAVEAPDPQPFLKSLQYSVKETLFPDDPFRQFKNQTTSRQVVLGLKYFLPILEWAPLYNFKLFKSDLIAGITIASLAIPQGISYAKLANLPPILGLYSSFVPPLVFAVLGSSKDLAVGTVAVGSLLTGAMLSKEVDAEKDPKLYLHLAFTATFFAGVLEASLGIFRLGFIVDFLSHATIVGFMGGAATVVSLQQLKGIFGLKHFTEATDVISVMRSVFSQTHQWRWESGVLGCCFLFFLLSTRYFSTKKPKFFWVAAMAPLTSVILGSLLVYFTHAERHGVQVIGDLKKGLNPLSVSDLVFTSPYMSTALKTGLITGIITLAEGIAVGRSFAMFKNYNIDGNKEMIAFGMMNIVGSFTSCYLTTGPFSRSAVNFNAGCKTAVSNIVMAIAVMFTLLFHTPFFHYTPLVVLSSIIMVAMLGLIDYQAAIHLWKVDKFDFFVCMSAYFGVVFGSVEIGLVVAVVISIARLLLFVSRPRTAVKGNIPNTMIYRNTDQYPYSRIVPGLLILEIDAPIYFANAGYLRERITRWVDEEEDRIKASGGNSLQYVILDMSAVGNIDTSGISMMEEIKKIMDRRELKLVLANPKGEVVKKLTRSKFIGENLGKEWMFLTVGEAVEACSFMLHTSKTEPASKEEPWNNV

SEQ ID NO: 8864 - protein, 596 aa, Brassica napus
MGTVDYTFPQGADEPHRRHHTVEAPEPQPFLKSLQYSVKETLFPDDPFRQFKNQNASRKVVLGLQYFFPICEWAPRYNLKLFKSDLIAGITIASLAIPQGISYAKLANLPPILGLYSSFVPPLVYAVLGSSRDLAVGTTAVGSLLMGAMLSKEVNAEKDPKLYLHLAFTATFFAGVLEASLGIFRLGFIVDFLSHATIVGFMGGAATVVSLQQLKGIFGLKHFTEATDIISVMRSVFSQTHQWRWESGVLGCGFLFFLLSTRYFSTKKPKFFWVAAMTPLTSVILGSLLVYFTHAERHGVQVIGNLKKGLNPLSVSDMVFTSPYMSTAVKTGIITGIIALAEGIAVGRSFAMFKNYNIDGNKEMLAFGMMNIVGSLTSCYLTTGPFSRSAVNFNAGCKTVVSNIVMAIAVMFTLLFLTPLFHYTPLVVLSSIIISAMLGLIDYQAAIHLWNVDKFDFLVCMSAYFGVVFGSVEIGLVVAVAISIARLLLFMSRPRTAIKGNIPNSMIYRNTEQYPYSRTVPGLLILEIDAPIYFANAGYLRERITRWINEEEERVKTSGENSLQYVILDMSAVGNIDTSGISMMEEIRNRSTRALS

SEQ ID NO: 8865 - protein, 578 aa, Brassica napus
LFKSDLIAGITIASLAIPQGISYAKLANLPPILGLYSSFVPPLVYAVLGSSKDLAVGTVAVGSLLTGAMLSKEVDAEKDPKLYLHLAFTATFFAGVLEASLGIFRLGFIVDFLSHATIVGFMGGAATVVSLQQLKGIFGLKHFTEATDVISVMRSVFSQTHQWRWESGVLGCCFLFFLLSTRYFSTKKPKFFWVAAMAPLTSVILGSLLVYFTHAERHGVQVIGDLKKGLNPLSVSDLVFTSPYMSTALKTGLITGIIALAEGIAVGRSFAMFKNYNIDGNKEMIAFGMMNIVGSFTSCYLTTGPFSRSAVNFNAGCKTAVSNIVMAIAVMFTLLFLTPFFYYTPLVVLSSIIMVAMLGLIDYQAAIHLWKVDKFDFLVCMSAYFGVVFGSVEIGLVVAVVISIARLLLFVSRPRTAVKGNIPNTMIYRNTDQYPYSRIVPGLLILEIDAPIYFANAGYLRERITRWIDEEEDRIKASGGNSLQYVILDMSAVGNIDTSGISMMEEIKKIMDRRELKLVLANPKGEVVKKLTRSKFIDDNLGKEWMFLTVGEAVEACSFMLHTSKTEPASKEEPWNNV

SEQ ID NO: 8866 - protein, 478 aa, Arabidopsis lyrata
MDDCSKDVINCLPDNLLCQILSNLSTKEAALTSLLSKRWRYLFALVPNLDFDVLPSLHPEIAMQDQDQTSFIDFVDRVLKLRGNDHINKFSLKCGHGIEDEDVFPWILNALRHGVSDLSLHVSPSLVYWLPSKVFASKTLVRLKIGPKDGPRVKLRNVCLPKLKTLNLDSVVFEEGKIGLAKLLSGCPVLEELALLNLAWDRWDSCSVSSKLLKRLTLCCAHYKKNPKSVSFDTPNVVYFEYSDNIAHKYPKVNFDSLVEASIDIRMTNDQKANARYVSDVDEETVMVGNATDLLMGICNVKTLYLSYDTLETLHFCCQVIPVFNNLTHLTIESHPELGWESLPNLLKSCPNLETLVFQGLLHKATYRCGDVCLCQGLENSPSCLSSSPVKFLKILKFGETNVDDDMEIEMEQIKNFLEKMPNLEQLMIYYNTSIENDLVEVSSQLQMVPAVASLKCKIQVISDNLSSCHPLCPFPCQ

SEQ ID NO: 8867 - protein, 703 aa, Arabidopsis lyrata
MEETFVPFEGIKNDVKGRLMCYKQDWIGGIKAGFRILAPTTYIFFASAIPVISFGEQLERSTDGVLTAVQTLASTAICGIIHSIIGGQPLLILGVAEPTVIMYTFMFNFAKGRPELGRNLFLAWSGWVCVWTSLILFVLAICGACSIINRFTRVAGELFGLLIAMLFMQQAIKGLVDEFRAPAREDLKLVEFLPSWRFANGMFALVLSFGLLITALRSRKARSWRYGTGWLRSLIADYGVPLMVLVWTGVSYIPTGDVPKGIPRRLFSPNPWSPGAYENWTVVKEMLQVPIVYIIGAFIPATMIAVLYYFDHSVASQLAQQKEFNLRKPSSYHYDLLLLGFLTLMCGLLGIPPSNGVIPQSPMHTKSLATLKYQLLRNRLVATARRSIKQNASLGQLYGNMQDAYNQMQTPLVYQQPQGLKELRESTIQATTFTGNLDAPVDETLFDIEKEIDDLLPIEVKEQRVSNLLQAIMVGGCVAAMPLLKMIPTSVLWGYFAFMAIESLPGNQFWERILLLFTAPSRRFKVLEDNHATFVETVPFKTIAMFTIFQTTYLLTCFGLTWIPIAGVMFPLMIMFLIPVRQYILPRFFKSAHLQDLDAAEYEEAPALPFHLAVPEAEMGSTASYPCDSEILDEFITRSRGEFRHTCSPKVTSSTSTPVYNRNLSQVFSPRVNDLRGEMSPRLAGKGQSSPKPSPLNPSSSSK

SEQ ID NO: 8868 - protein, 705 aa, Eutrema halophilum
MEETFVPFEGIKNDLKGRLTCYKQDWTGGFKAGFRILAPTTYIFFASAIPVISFGEQLERSTDGVLTAVQTLASTAICGIIHSIIGGQPLLILGVAEPTVIMYTFMFNFAKGRPELGRNLFLAWSGWVCVWTSLILFVLAICGACSIINRFTRVAGELFGLLIAMLFMQEAIKGLVDEFRSPERENLKLLEFLPSWRFANGMFALVLSFGLLITALRSRKARSWRYGTGWLRSLIADYGVPLMVLVWTGVSYIPTGDVPKGIPRRLFSPNPWSPGAYENWTVVKEMLEVPIVYIIGAFIPATMIAVLYYFDHSVASQLAQQKEFNLRKPSSYHYDLLLLGFLTLICGLLGIPPSNGVIPQSPMHTKSLATLKYQLLRNRLVATARRSIKQNASLGQLYGNMQEVYNQMQTPLVYQQPQGLKELKESTIQATTFTGNLDAPVDETLFDIEKEIDDLLPIEVKEQRVSNLLQALMVGGCVAAMPLLKMIPTSVLWGYFAFMAIESLPGNQFWERILLLFTAPSRRFKVLEDNHATFVETVPFKTIAMFTIFQTTYLLICFGLTWIPLAGVMFPLMIMFLVPVRQYILPRFFKSAHLQDLDAAEYEEAPALPFNLAVPEAEMGSTASYPCDSEILDEYITRSRGEFRHTCSPKVTSSTSTPGFNRNLSQVFSPRVNERRGEMSPRLAGKGKNSPKPSPLNPSSSSPSK

SEQ ID NO: 8869 - protein, 705 aa, Eutrema parvulum
MEETFVPFEGIKNDLKGRLMCYKQDWTGGFKAGFRILAPTTYIFFASAIPVISFGEQLERSTDGVLTAVQTLASTALCGIIHSIIGGQPLLILGVAEPTVIMYRFMFNFAKGRPELGRNLFLAWSGWVCVWTSLILFVMAICGACSIINRFTRVAGELFGLLIAMLFMQEAIKGIVDEFRSPERENLKLLEFSPSWRFGNGMFALVLSFGLLITALRSRKARSWRYGAGWLRSLIADYGVPLMVLVWTGVSYIPTGDVPKGIPRRLFSPNPWSPGAYENWTVIKEMLEVPIAYIIGAFIPATMIAVLYYFDHSVASQLAQQKEFNLRKPSSYHYDLLLLAFLTLMCGLLGIPPSNGVIPQSPMHTKSLATLKYQLLRNRLVATARRSIKQNASLGQLYGNMQEVYNQMQTPLVYQQPQGLNELRESTIQATTFTGNLDAPVDETLFDIEKEIDHLLPIEVKEQRVSNLLQAVMVGGCVAAMPLLKRIPTSVLWGYFAFMAIESLPGNQFWERILLLFTAPSRRFKVLEDNHATFVETVPFKTIAMFTIFQTTYLLTCFGLTWIPIAGVMFPLMILFLIPVRQYILPKFFKGAHLQDLDAAEYEEAAALPFNLAVVEAEMGSTASYPCDSEILDEFITRSRGEFRQTCSPKVTSSISTPVYNRNLSQVFSPGVNELRGEISPRVSGKGKNSAKPSPFNPSSSSPSK

SEQ ID NO: 8870 - protein, 704 aa, Brassica napus
MEETFVPFEGIKNDLKGRLMCYKQDWTGGFKAGFRILAPTTYIFFASAIPVISFGEQLERNTDGVLTAVQTLASTAICGIIHSVIGGQPLLILGVAEPTVIMYTFMFNFAKARPELGRDLFLAWSGWVCVWTALMLFVMAICGACSIINRFTRVAGELFGLLIAMLFMQQAIKGLVDEFRIPERENQKLMEFLPSWRFANGMFALVLSFGLLLTGLRSRKARSWRYGTGWLRSLIADYGVPLMVLVWTGVSYIPSGDVPKGIPRRLLSPNPWSPGAYGNWTVAKEMLDVPIVYIIGAFIPASMIAVLYYFDHSVASQLAQQKEFNLRKPSSYHYDLLLLGFLTLMCGLLGVPPSNGVIPQSPMHTKSLATLKYQLLRNRLVATARKSIKTNASLGQLYNNMQEAYHHMQTPLVYQQPQGLKELKESTIQATTFTGNLNAPVDETLFDIEKEIDDLLPVEVKEQRVSNLLQSTMVGGCVAAMPILKMIPTSVLWGYFAFMAIESLPGNQFWERILLLFTAPSRRFKVLEDYHATFVETVPFKTIAMFTIFQTVYLLICFGLTWIPIAGVMFPLMIMFLVPVRQYILPRFFKGAHLQDLDAAEYEEAPALPFNLAAETEIGSTTSYPGDSEILDEVITRSRGEFRHTSSPKVTSSSSTPVNNRSLSQVFSPRVGELRFGQMSPRVVGNSPKPVSCGRSPLNQSSSK

SEQ ID NO: 8871 - protein, 705 aa, Arabidopsis lyrata
MEETFVPFEGIKNDLKGRLMCYKQDWTGGFKAGFRILAPTTYIFFASAIPVISFGEQLERSTDGVLTAVQTLASTAICGMIHSIIGGQPLLVLGVAEPTVIMYTFMFNFAKARPELGRDLFLAWSGWVCVWTALMLFVLAICGACSIINRFTRVAGELFGLLIAMLFMQQAIKGLVDEFRIPERENQKLKEFLPSWRFANGMFALVLSFGLLLTGLRSRKARSWRYGTGWLRSLIADYGVPLMVLVWTGVSYIPAGDVPKGIPRRLFSPNPWSPGAYGNWTVVKEMLDVPIVYIIGAFIPASMIAVLYYFDHSVASQLAQQKEFNLRKPSSYHYDLLLLGFLTLMCGLLGVPPSNGVIPQSPMHTKSLATLKYQLLRNRLVATARRSIKTNASLGQLYDNMQEAYNHMQTPLVYQQPQGLKELKESTIQATTFTGNLNAPVDETLFDIEKEIDDLLPVEVKEQRLSNLLQSTMVGGCVAAMPILKMIPTSVLWGYFAFMAIESLPGNQFWERILLLFTAPSRRFKVLEDYHATFVETVPFKTIAMFTLFQTTYLLICFGLTWIPIAGVMFPLMIMFLIPVRQYLLPRFFKGAHLQDLDAAEYEEAPALPYNLAAETEIGSTTSYPGDLEILDEVITRSRGEFRHTSSPKVTSSSSTPVNNRSLSQVFSPRVSEIRLGQMSPRVVGNSPKPVSRGRSPLNQSSSSN

SEQ ID NO: 8872 - protein, 704 aa, Arabidopsis thaliana
MEETFVPFEGIKNDLKGRLMCYKQDWTGGFKAGFRILAPTTYIFFASAIPVISFGEQLERSTDGVLTAVQTLASTAICGMIHSIIGGQPLLILGVAEPTVIMYTFMFNFAKARPELGRDLFLAWSGWVCVWTALMLFVLAICGACSIINRFTRVAGELFGLLIAMLFMQQAIKGLVDEFRIPERENQKLKEFLPSWRFANGMFALVLSFGLLLTGLRSRKARSWRYGTGWLRSLIADYGVPLMVLVWTGVSYIPAGDVPKGIPRRLFSPNPWSPGAYGNWTVVKEMLDVPIVYIIGAFIPASMIAVLYYFDHSVASQLAQQKEFNLRKPSSYHYDLLLLGFLTLMCGLLGVPPSNGVIPQSPMHTKSLATLKYQLLRNRLVATARRSIKTNASLGQLYDNMQEAYHHMQTPLVYQQPQGLKELKESTIQATTFTGNLNAPVDETLFDIEKEIDDLLPVEVKEQRVSNLLQSTMVGGCVAAMPILKMIPTSVLWGYFAFMAIESLPGNQFWERILLLFTAPSRRFKVLEDYHATFVETVPFKTIAMFTLFQTTYLLICFGLTWIPIAGVMFPLMIMFLIPVRQYLLPRFFKGAHLQDLDAAEYEEAPALPFNLAAETEIGSTTSYPGDLEILDEVMTRSRGEFRHTSSPKVTSSSSTPVNNRSLSQVFSPRVSGIRLGQMSPRVVGNSPKPASCGRSPLNQSSSN

SEQ ID NO: 8873 - protein, 704 aa, Eutrema halophilum
MEETFVPFEGIKNDLKGRLICYKQDWTGGFKAGFRILAPTTYIFFASAIPVISFGEQLERNTDGVLTAVQTLASTTICGMIHSIIGGQPLLILGVAEPTVIMYTFMFNFAKARPELGRNLFLAWSGWVCVWTALMLFVLAICGACSFINRFTRVAGELFGLLIAMLFMQQAIKGLVDEFRIPERENQKLMEFLPSWRFANGMFALVLSFGLLLTGLRSRKARSWRYGSGWLRSLIADYGVPLMVLVWTGVSYIPAGDVPKGIPRRLFSPNPWSPGAYGNWTVVKEMLDVPIVHIIGAFIPASMIAVLYYFDHSVASQLAQQKEFNLRKPSSYHYDLLLLGFLTLMCGLLGVPPSNGVIPQSPMHTKSLATLKYQLLRNRLVATARRSIKTNASLGQLYNNMQEAYHHMQTPLVYQQPQGLKELKESTIQATTFTGNLNAPVDETLFDIEKEIDDLLPVEVKEQRLSNFLQSTMVGGCVAAMPILKMIPTSVLWGYFAFMAIESLPGNQFWERILLLFTAPSRRFKVLEDYHATFVETVPFKTIAMFTIFQTIYLLICFGLTWIPIAGVMFPLMIMFLIPVRQYILPRFFKGAHLQDLDAAEYEEAPALPFNLAAETEIGSTTSYPGDSEILDEVITRSRGEFRHTSSPKVTSSSSTPVNNRSLSQVFSPRVGELRLGQMSPRIVGNSPKPASCGRSPLNQSSSN

SEQ ID NO: 8874 - protein, 704 aa, Brassica napus
MEETFVPFEGIKNDLKGRLMCYKQDWTGGFKAGFRILAPTTYIFFASAIPVISFGEQLERNTDGVLTAVQTLASTAICGIIHSVIGGQPLLILGVAEPTVIMYTFMFNFAKARPELGRDLFLAWSGWVCVWTALMLFVMAICGACSIINRFTRVAGELFGLLIAMLFMQQAIKGLVDEFRIPERENQKLMEFLPSWRFANGMFALVLSFGLLLTGLRSRKARSWRYGTGWLRSLIADYGVPLMVLVWTGVSYIPSGDVPKGIPRRLLSPNPWSPGAYGNWTVAKEMLDVPVVYIIGAFIPASMIAVLYYFDHSVASQLAQQKEFNLRKPSSYHYDLLLLGFLTLMCGLLGVPPSNGVIPQSPMHTKSLATLKYQLLRNRLVATARKSIKTNASLGQLYNNMQEAYHHMQTPLVYQQPQGLKELKESTIQATTFTGNLNAPVDETLFDIEKEIDDLLPVEVKEQRVSNFLQSTMVGGCVAAMPILKMIPTSVLWGYFAFMAIESLPGNQFWERILLLFTAPSRRFKVLEDYHATFVETVPFKTIAMFTIFQTVYLLICFGLTWIPIAGVMFPLMIMFLIPVRQYILPRFFKGAHLQDLDAAEYEEAPALPFNLAAETEIGSTTSYPGDSEILDEVITRSRGEFRHTSSPKVTSSSSTPLNNRSLSQVFSPRVGELRFGQMSPRVVGNSPKPVSCGRSPLNQSSSK

SEQ ID NO: 8875 - protein, 704 aa, Eutrema parvulum
MEETLMPFEGIKNDLKGRLMCYKQDWTGGFKAGFRILAPTTYIFFASAIPVISFGEQLERNTDGVLTAVQTLASTAICGMIHSIIGGQPLLILGVAEPTVIMYTFMFNFAKARPELGRNLFLAWSGWVCVWTSLMLFVMAICGACSIINRFTRVAGELFGLLIAMLFMQQAIKGLVDEFRIPERENQKLKEFLPSWRFANGMFALVLSFGLLLTGLRSRKARSWRYGTGWLRSLIADYGVPLMVLVWTGVSYIPAGDVPKGIPRRLFSPNPWSPGAYGNWTVVKEMLDVPVVYIIGAFIPASMIAVLYYFDHSVASQLAQQKEFNLRKPSSYHYDLLLLGFLTLMCGLLGVPPSNGVIPQSPMHTKSLATLKYQLLRNRLVATARRSIKTNASLGQLYNNMQEAYHHMQTPLVYQQPQGLKELKESTIQATTFTGNLNAPVDETLFDIEKEIDDLLPVEVKEQRVSNLLQSTMVGGCVAAMPILKMIPTAVLWGYFAFMAIESLPGNQFWERILLLFTAPSRRFKVLEDYHATFVETVPFKTIAMFTIFQTIYLLICFGLTWIPIAGVMFPLMIMFLIPVRQYILPRFYKGAHLQDLDAAEYEEAPALPFNLAAETEIGSTTSYPGDSEILDEVITRSRGEFRHTSSPKVTSSTSTPLNNRSLSQVFSPRVGEIRLSQMSPRVVGNSPKPASCGRSPLNQSSSN

SEQ ID NO: 8876 - protein, 703 aa, Brassica napus
MEETFVPFEGIKNDLKGRVMCYKQDWAGGFKAGFRILAPTTYIFFASAIPVISFGEQLERSTDGVLTAVQTLASTAICGIIHSIIGGQPLLILGVAEPTVIMYTFMFNFAKARPELGRNLFLAWSGWVCVWTALMLFVMAICGACSIINRFTRVAGELFGLLIAMLFMQQAIKGLVDEFRIPDRENQKLKEFLPSWRFANGMFALVLSFGLLLTGLRSRKARSWRYGSGWLRSLIADYGVPLMVLVWTGVSYIPAGDVPKGIPRRLFSPNPWSPGAYGNWTVVKEMLDVPIVHIIGAFIPASMIAVLYYFDHSVASQLAQQKEFNLRKPSSYHYDLLLLGFLTLTCGLLGIPPSNGVIPQSPMHTKSLATLKYQLLRNRLVATARRSIKTNASLGQLYNNMQEAYHHMQTPLVYQQPQGLKELKESTIQATTLTGNLNAPVDETLFDIEKEIDDLLPVEVKEQRVSNFLQSTMVGGCVAAMPILKMIPTSVLWGYFAFMAIESLPGNQFWERILLLFTAPSRRFKVLEDYHATFVETVPFKTIATFTIFQTIYLLVCFGLTWIPIAGVMFPLMIMFLIPVRQYILPRFFKGAHLQDLDAAEYEEAPALPFNLAAETEIGSTTSYPGDSEILDEVITRSRGEFRHTSSPKVTSSNSTPVNNRSLSQVFSPRVGELRLGQMSPRVVGNSPKPPSTGRSPLNHCSH

SEQ ID NO: 8877 - protein, 525 aa, Brassica napus
MEETFVPFEGIKNDLKGRLMCYKQDWTGGFKAGFRILAPTTYIFFASAIPVISFGEQLERSTDGVLTAVQTLASTAICGIIHSIIGGQPLLILGVAEPTVIMYTFMFNFAKARPELGRNLFLAWSGWVCVWTALMLFVMAICGACSIINRFTRVAGELFGLLIAMLFMQQAIKGLVDEFRIPDRENQKLKEFLPSWRFANGMFALVLSFGLLLTGLRSRKARSWRYGSGWLRSLIADYGVPLMVLVWTGVSYIPAGDVPKGIPRRLFSPNPWSPGAYGNWTVVKEMLDVPIVHIIGAFVPASMIAVLYYFDHSVASQLAQQKEFNLRKPSSYHYDLLLLGFLTLMCGLLGVPPSNGVIPQSPMHTKSLATLKYQLLRNRLVATARRSIKTNASLGQLYNNMQEAYHHMQTPLVYQQPQGLKELKESTIQATTLTGNLNAPVDETLFDIEKEIDDLLPVEVKEQRVSNFLQSTMVGGCVAAMPILKMIPTSVLWGYFAFMAIESLPGNQFWERILLLFTAPSRRGS

SEQ ID NO: 8878 - protein, 701 aa, Brassica napus
MEETFVPFEGIKNDLKGRLMCYKQDWTGGFKAGFRILAPTTYIFFASAIPVISFGEQLERNTDGVLTAVQTLASTAICGIIHSVIGGQPLLILGVAEPTVIMYTFMFNFAKARPELGRDLFLAWSGWVCVWTALMLFVMAICGACSIINRFTRVAGELFGLLIAMLFMQQAIKGLVDEFRIPERENEKLKEFLPSWRFANGMFALVLSFGLLLTGLRSRKARSWRYGTGWLRSLVADYGVPLMVLLWTGVSYIPSGDVPKGIPRRLFSPNPWSPGAYGNWTVVQEMLDVPVVYIIGAFIPASMIAVLYYFDHSVASQLAQQKELNLRKPSSYHYDLLLLGFLTLMCGLLGVPPSNGVIPQSPMHTKSLATLKYQLLRNRLVATARKSIKTNASLGQLYNNMQEAYHHMQTPLVYQQPQGLKELKESTIQATTFTGNLNAPVDETLFDIEKEIDDLLPVEVKEQRVSNFLQSTMVGGCVAAMPILKMIPTSVLWGYFAFMAIESLPGNQFWERILLLFTAPSRRFKVLEDYHATFVETVPFKAIAMFTVFQTVYLLICFGLTWIPIAGVMFPLMIMFLIPVRQYILPRFFKGAHLQDLDAAEYEEAPALPFNLAAETEIGSTTSYPGDSEILDEVITRSRGEFRHTSSPKVTSSSSTPLNNRSLSSPRVGEIRLSQMSPRVVGNSPKPASCGRSPLNQSSLN

SEQ ID NO: 8879 - protein, 701 aa, Brassica napus
MEETFVPFEGIKNDLKGRLKCYKQDWTGGFKAGFRILAPTTYIFFASAIPVISFGEQLERNTDGVLTAVQTLASTAICGIIHSVIGGQPLLILGVAEPTVIMYTFMFNFAKARSELGRDLFLAWSGWVCVWTALMLFVMAICGACSIINRFTRVAGELFGLLIAMLFMQQAIKGLVDEFHIPERENEKLKEFLPSWRFANGMFALVLSFGLLLTGLRSRKARSWRYGTGWLRSLVADYGVPLMVLVWTGVSYIPSGDVPKGIPRRLFSPNPWSPGAYGNWTVVQEMLDVPVVYIIGAFIPASMIAVLYYFDHSVASQLAQQKEFNLRKPSSYHYDLLLLGFLTLMCGLLGVPPSNGVIPQSPMHTKSLATLKYQLLRNRLVATARRSIKKNASLGQLYNNMQEAYHHMQTPLVYQQPQGLKELKESTIQATTFTGNLNAPVDETLFDIEKEIDDLLPVEVKEQRVSNFLQSTMVGGCVAAMPILKMIPTSVLWGYFAFMAIESLPGNQFWERILLLFTAPSRRFKVLEDYHATFVETVPFKAIAMFTVFQTVYLLICFGLTWIPIAGVMFPLMIMFLIPVRQYILPRFFKGAHLQDLDAAEYEEAPALPFNLAAETEIGSTTSYPGDSEILDEVITRSRGEFRHTSSPKVTSSSSTPLNNRSLSSPRVGEIRLSQMSPRVVGNSPKPASCGRSPLNQSSFN

SEQ ID NO: 8880 - protein, 707 aa, Unknown
  Sequence found in Organisms: Citrus clementina, Citrus sinensis
MEETFVPFRGIKNDLRGRLMCYKQDWTSGFKAGFRILAPTTYIFFASAIPVISFGEQLERDTEGVLTAVQTLASTALCGIIHSIIGGQPLLILGVAEPTVIMYTFMFNFAKERADLGRNLFIAWSGWVCVWTALLLLMLSILGACSIINRFTRVAGELFGLLIAMLFMQQAIKGLVEEFRIPERENPKLVQFIPSWRFANGMFALVLSFGLLYTGLKSRKARSWRYGTGWLRSVIADYGVPLMVVVWTGVSYIPSGDVPKGIPRRLFSPNPWSPGAYENWTDMLNVPIVYIIGAFIPATMIAVLYYFDHSVASQLAQQKEFNLRKPSSYHYDLLLLGFLTLLCGLIGIPPSNGVIPQSPMHTKSLATLKHQLLRNRLVATARTSMRKNASLGQMYGNMQEAYQQMQTPLIYQQSAAQGLKELKESTIQAASCTGNLNAPVDETLFDIEKEIDDLLPVEVKEQRLSNLLQAIMVGGCVAAMPFLKMIPTSVLWGYFAFMAIESLPGNQFWERILLLFTAPSRRYKVLEEYHATFVETVPFKTIAMFTIFQTIYLLICFGLTWVPIAGVMFPLMIMLLVPARQYILPKFFKGVHLQDLDAAEYEEAPALPFNLAAETQMGAGASYAGDAEILDEVITRSRGEFRHTNSSKITSSTSTPANDPLSMQSPRVRQSPRLSELRGERSPRIRGLPSPKTGESKLSNLGKSPLN

SEQ ID NO: 8881 - protein, 731 aa, Populus trichocarpa
MEETFVPFRGIKNDLRGRLMCYKQDWTGGFRAGFRILAPTTYIFFASAIPVISFGEQLERNTDGVLTAVQTLASTAVCGIIHSIIGGQPLLILGVAEPTVIMYTFMFNFAKERADLGRNLFLAWTGWVCVWTSLLLFLLAVLGACSIINRFTRVAGELFGLLIAMLFMQQAIKGLVDEFRIPKREDPKSMEFIPSWRFANGMFALVLSFGLLLTALRSRKARSWRYGSGWLRSLVADYGVPLMVVVWTAVSYIPTGNVPKGIPRRLFSPNPWSPGAYENWTVVKASSEMLDVPISYIIGAFIPATMIAVLYYFDHSVASQLAQQKEFNLRKPSSYHYDLLLLGFLTLMCGLIGIPPSNGVIPQSPMHTKSLATLKYQVIYPEISQKIKLLRNRLVATARTSLRKNASLGQLYGNMQEAYHQIQTPLMYQQPSQGLKEFKESTIQAATCTGHIDAPVDETVFDIEKEIDDLLPVEVKEQRVSNLLQATMVGGCVAAMPFLKMIPTSVLWGYFAFMAIESLPGNQFWERILLLFTAPSRRYKVLEDFHATFVETVPFKSIAMFTIFQTAYLLICFGLTWIPIAGLMFPLMIMLLVPVRQYCLPKFFKGAHLQDLDAAEYEEAPALPFNLATEAELGGGAAYGGDGEILDEVITRSRGEFRHTSSPKISSSTTTPANNPKSLQSPRLSYTYSPRISELRGQKSPKSSGRGLNSPRTGDQKLSKLGKSPSSSEQN

SEQ ID NO: 8882 - protein, 714 aa, Populus trichocarpa
MEETFVPLRGIKNDLRGRLRCYKQDWTGGFKSGFRILAPTTYIFFASAIPVISFGEQLERNTDGVLTAVQTLASTSICGIIHSIVGGQPLLILGVAEPTVIMYTFMFNFAKERADLGRDLFLAWTGWVCVWTALLLFLLAVLGASSIINRFTRIAGELFGLLIAMLFMQQAIKGLVEEFRIPQREDPKSTEFIPSWRFANGMFALVLSFGLLLTGLRSRKARSWRYGSGWLRSLIADYGVPLMVLVWTAVSYIPTGNVPKGIPRRLFSPNPWTPGAYENWTVIKASSEMLNVPIFYIIGAFVPATMIAVLYYFDHSVASQLSQQKEFNLRKPSSYHYDLLLLGFLTLMCGLLGIPPSNGVIPQSPMHTKSLATLKYQLLRNRLVQTARRSLRKNASLGQLYGNMQEAYQQMQTPLVYQQPAQGLKEFKESTIQASTCTGHIDAPVDETVFDIEKEIDDLLPVEVKEQRLSNILQATMVGGCVAAMPFLKKIPTSVLWGYFAFMAIESLPGNQFWERILLLFTAPSRRYKVLEDYHATFVETVPFKTIAMFTIFQTTYLLICFGLTWVPIAGVMFPLMIMLLVPVRQYCLPKFFKGAHLQDLDAAAYEEAPALPFNLATEAEMGAGAAYGGDGEILDEVITRSRGEFRHTSSPKITSSTATPANNPKSHQSPRLSYTYSPRVSELRGEKSPKPGGLGNSWRVKKSLSPSSSSISS

SEQ ID NO: 8883 - protein, 713 aa, Theobroma cacao
MEETFVPLRGIKNDLKGRLMCYKQDWTGGFKAGFRILAPTTYIFFASAIPVISFGEQLERNTDGVLTAVQTLASTALCGIIHSIIGGQPLLILGVAEPTVIMYTFMFNFAKERPDLGRDLFLAWTGWVCVWTAGLLFLLSILGACSIINRFTRVAGELFGLLIAMLFMQQAIKGLVEEFRIPQHEDPKLTEFIPSWRFANGMFALVLSFGLLLTALRSRKARSWRYGTGWLRSFIADYGVPFMVLVWTAVSYIPAESVPKGIPRRLFSPNPWSPGAYENWTEMLNVPVVYIIGAFIPATMIAVLYYFDHSVASQLAQQKEFNLRKPSCYHYDLLLLGFLTLLCGLIGIPPANGVIPQSPMHTKSLATLKHQLLRNRLVATARKSIRKNASLGQLYGNMQEAYQQMQTPLVYQETSARGLNELKESTVQAATCTDNIDAPIDETLFDIEKDIDDLLPVEVKEQRLSNLLQATMVGGCVGAMPILKMIPTSVLWGYFAFMAIESLPGNQFWERILLLFTAPSRRYKVLEQQHATFVETVPFKTIAIFTIFQTTYLLVCFGLTWIPIAGVMFPLMIMLLVPVRQYFLPKFFKGAHLYDLDAAEYEEAPALPYNLATETELGHGASYAGDGEILDEVITRSRGEFRHTCSPKITSSTATPANDPSSLQSPRLSGSPRVSELKGERSPRSSGKGPHSPRAGEPKPSNLGKSPLNPASS

SEQ ID NO: 8884 - protein, 715 aa, Manihot esculenta
MEETFVPLRGIKNDLKGRLLCYKQDWTGGFRAGFRILAPTTYIFFASAIPVISFGEQLERNTDGVLTAVQTLASTAVCGIIHSIIGGQPLLILGVAEPTVIMYTFMFNFAKERPDLGRDLFLAWTGWVCVWTALLLFLLAILGACSIINRFTRVAGELFGLLIAMLFMQQAIKGLVDEFRIPQREDPKLIEFIPSWRFANGMFALVLSFGLLLTALRSRKARSWRYGTGWLRSFTADYGVPFMVLVWTAVSYIPSGSVPQGIPRRLFSPNPWSPGAYENWTEMLNVPIFYIIGAFVPATMIAVLYYFDHSVASQLAQQKEYNLRKPSSYHYDLLLLGFLTLMCGLIGIPPSNGVIPQSPMHTKSLATLKYQLLRNRLVATARTSIKKNASLGQLYGNMQEAYQQMQTPLIYQQPSQQGLKEFKETTIQAASSTGHIDAPVDETVFDIEKEIDDLLPVEVKEQRVSNLLQATMVGGCVAAMPFLKKIPTSVLWGYFAFMAIESLPGNQFWERILLLFTAPSRRYKVLEEYHATFVETVPFKTIATFTIFQTIYLLICFGLTWVPIAGVMFPLMIMLLVPVRQYVLPKFFKGAHLQDLDAAEYEEAPALPYNIATESELGAGATRAGDGEILDEVITRSRGEFRHVSSPKITSTTGTPANDPKSHQSPRLSYTYSPRLSELKGEKSPKASGRGPISPRPAELGLSKLGKSPSNSAQK

SEQ ID NO: 8885 - protein, 716 aa, Euphorbia peplus
MEETFVPLRGIKNDLHGRLLCYKQDWTGGFKAGFRILAPTTYIFFASAIPVISFGEQLERNTEGVLTAVQTLASTAICGMIHSIIGGQPLLILGVAEPTVIMYTFMFNFVKERTDIGRELFLAWTGWVCVWTAALLFLLAILGACSIINRFTRVAGELFGLLIAMLFMQQAIKGLVDEFRIPQREDPTREEFLPSWRFANGMFALVLSFGLLYTALRSRKARSWRYGTGWLRSSIADYGVPLMVLAWTAISYIPSGSVPQRIPRRLFSPNPWSPGAYENWTVIKDMLNVPISYIIGAFIPATMIAVLYYFDHSVASQLAQQKEFNLRKPASYHYDLLLLGFLTLMCGLLGIPPSNGVIPQSPMHTKSLATLKHQLLRNRLVASARKSIQKNASLGQIYGNMQEAYQQMQTPLIYQQPSEGLKEFKESTIQAATCTGHIDAPVDETVFDIEKEIDDLLPVEVKEQRVSNLLQSMMVGGCLAAMPVLKRIPTSVLWGYFAFMAIESLPGNQFWERILLLFTAPSRRYKVLEDYHATFVETVPFKSIAMFTIFQTTYLLICFGLTWIPIAGLMFPLMIMLLVPVRQYILPKFFKGAHLQDLDAADYEEAPALPFNLATESEMGAGAAQAGDAEILDEVITRSRGEFRHINSPKMTSTTSTPGHELKSPSGFSYSYSPRVSELRGVRSPTLSQKGSSKSPIIGDVRLSKLGKSPSASEHK

SEQ ID NO: 8886 - protein, 606 aa, Brassica napus
MYTFMFNFAKGRPELGRNLFLAWSGWVCVWTSLILFVLAICGACSIINRFTRVAGELFGLLIAMLFMQEAIKGLVDEFRSPEREDLKLLEFLPSWRFANGMFALVLSFGLLITALRSRKARSWRYGTGWLRSLIADYGVPLMVLVWTGVSYIPTGDVPKGIPRRLFSPNPWSPGAYENWTVVKEMLQVPVVYIIGAFIPATMIAVLYYFDHSVASQLAQQKEFNLRKPSSYHYDLLLLGFLTLICGLLGIPPSNGVIPQSPMHTKSLATLKYQLLRNRLVATARRSIKQNASLGQLYGNMQEAYNQMQTPLVYQQPQGLKELRESTIQATTFTGNLDAPVDETLFDIEKEIDDLLPIEVKEQRVSNLLQALMVGGCVAAMPILKMIPTSVLWGYFAFMAIESLPGNQFWERILLLFTAPSRRFKVLEDNHATFVETVPFKTIAMFTIFQTTYLLICFGLTWIPIAGVMFPLMIMFLIPVRQYILPRFFKGAHLQDLDAAEYEEAPALPFNLAVAEDEMGSTASYPCDSEILDEVMTRSRGEFRHTCSPKVTSSTSTPVYHRNLSQVFSPRVNELRGGGMMSPSLAGKGHNSPKPSPLNPSSSSPSK

SEQ ID NO: 8887 - protein, 710 aa, Malus domestica
MEETFVPLRGIKNDLRGRLKCYKEDWTGGFKAGFRILAPTTYIFFASAIPVISFGEQLDRSTDGVLTAVQTLVSTAVCGIIHSIVGGQPLLILGVAEPTVIMYTFMFNFAKERKDLGPKLFLAWSAWVCVWTAGLLFLLAILGACSIINRFTRVAGELFGLLIAMLFMQQAIKGLVDEFRLPEREDTSLLQFIPSWRFANGMFALVLSFGLLLTALKSRKARSWRYGTGWLRSFVADYGVPLMVLVWTGVSYIPTSSVPHGIPRRLFSPNPWSPGAYENWTDMLNVPVLYIIGAFIPATMIAVLYYFDHSVASQLSQQKEFNLRKPSSYHYDLLLLGFLTLMCGLLGIPPSNGVIPQSPMHTKSLATLKHQLLRNRLVATARTSMRNNASLGQLYGNMQDAYQQMQTPLVYQEASSRGLNELKESTIQAASSMGNYIDAPVDQTVFDIEKEIDDLLPVEVKEQRLSNLLQAVLVGGCVAAMPILKRIPTSVLWGYFAFMAIESLPGNQFWERILLLFTAPSRRFKVLEDNHATFVETVPFKSIAMFTVFQTLYLLVCFGLTWVPIAGVMFPMMIMLLVPVRQYILPKFFKGAHLQDLDAAEYEEAPALTYNLATETELGAGASCAGDAEILDEVMTRSRGEFRHVSSPKITSSTSTPANAPEILGSPHKTFSPRVSELRGERSPLSGGRGSHSPGTPGSSSILGKSPSNS

SEQ ID NO: 8888 - protein, 717 aa, Ricinus communis
MEETFVPLRGIKNDLRGRLLCYKQDWTSGFKAGLRILAPTTYIFFASAIPVISFGEQLERNTDGVLTAVQTLVSTAVCGIIHSVIGGQPLLILGVAEPTVIMYTFMFNFVKERPDLGRDLFLAWTGWVCVWTAILLFLLAILGACSIINRFTRVAGELFGLLIAMLFMQQAVKGLVDEFRIPQREDRKSIEFIASWRFANGMFALVLSFGLLFTALRSRKARSWRYGTGWLRSLMADYGVPLMVLVWTGVSYIPSGSVPKGIPRRLFSPNPWSPGAYENWTVIKDMLNVPVFYIIGAFIPATMIAVLYYFDHSVASQLAQQKEFNLRKPPSYHYDLLLLGFLTLLCGLLGIPPSNGVIPQSPMHTKSLATLKHQLLRSRLVATARQSIRKNASLGQLYGNMKEAYQQMQTPLIYQQPSEGLKEFKESTIQVASCTGHIDAPVDETVFDIEKEIDDLLPVEVKEQRLSNLLQATMVGGCVAAMPFLKKIPTSVLWGYFAFMAIESLPGNQFWERILLLFTAPSRRYKVLEEYHATFVETVPFKTIAMFTIFQTFYLLICFGLTWVPIAGVMFPLMIMLLVPVRQYFLPKLFKGAHLQDLDAAEYEEAPALPYTLATESELGAGAVQAGDGEILDEVITRSRGEFRHMSSPKITSSTATPANDPKSHQSPRFSSSYSPRLSELRGEKSPKASGKGAKSPRTPELGLSKLGKSPSSSAQN

SEQ ID NO: 8889 - protein, 716 aa, Prunus persica
MEETFVPLQGIKNDLRGRLMCYKQDWTGGFRAGFRILAPTTYIFFASAIPVISFGEQLERNTDGVLTAVQTLVSTAVCGIIHSIIGGQPLLILGVAEPTVIMYTFMFNFAKERADLGPKLFLAWSGWVCVWTAALLFLLAILGACSIINRFTRVAGELFGLLIAMLFMQQAIKGLVDEFRLPQREDTSLPQFVPSWRFANGMFALVLSFGLLLTALKSRKARSWRYGSGWLRGFVADYGVPLMVLVWTGVSYIPTSTVPHGIPRRLFSPNPWSPGAYDNWTVIKDMLNVPVLYIIGAFIPATMIAVLYYFDHSVASQLSQQKEFNLRKPSSYHYDLLLLGFLTLMCGLLGIPPSNGVIPQSPMHTKSLATLKHQLLRNRLVATARKSMRKNASLGQLYGNMQEAYRQMQTPLIYQEASARGLNELKESTIQAASSMGNYIDAPVDETVFDVEKEIDDLLPVEVKEQRLSNLLQAILVGGCVAAMPILKKIPTSVLWGYFAFMAIESLPGNQFWERILLLFTAPSRRYKVLEEYHATFVETVPFKSIGLFTVFQTLYLLVCFGLTWVPIAGVMFPLMIMLLVPVRQYVLPKFFKGAHLQDLDAAEYEEAPALPFNLATEAELGAGASYAGDAEILDEVMTRSRGEFRHVSSPRITSSTSTPGNAPKILGSPHSSFSPRVNELRGERSPRSGGRGPNSPRTPGSSSILGKSPSDNTTS

SEQ ID NO: 8890 - protein, 717 aa, Citrullus lanatus
MEETFVPLRGIKNDLKGRLVCYKQDWTGGLRAGYRILAPTTYIFFASAIPVISFGEQLERSTDGVLTAVQTLASTALCGIIHSIVGGQPLLILGVAEPTVIMYTFMFNFAKERPELGRNLFLAWSGWVCVWTAALLFLMAILGACSIINRFTRLAGELFGLLIAMLFMQQAIKGLVDEFRIPERENPKLLQFIPSWRFANGMFALVLSFGLLLTALRSRKARSWRYGSGSLRSLIADYGVPLMVLVWTGISYIPSKSVPQGIPRRLFSPNPWSPGAYENWTVIKDMLDVPVFYICGAFIPATMIAVLYYFDHSVASQLAQQKEFNLRKPSSYHYDLLLLGFLTLICGLLGIPPSNGVIPQSPMHTKSLATLKHQLLRNKLVETARSSMRKNASLGQLYGSMQQAYQQMQTPLIYQQPSIRGLNELKETTIQAASSMGSFDAPVDETIFDIEKEIDDLLPVEVKEQRVSNLLQAIMVGGCVAAMPVLKKIPTSVLWGYFAFMAIESLPGNQFWERILLLFTAPSRRYKVLEDYHATFVETVPFKSIVLFTIFQTVYLFICFGLTWVPIAGVMFPLMIMLLVPVRQYLLPKFFKGAHLQDLDAAEYEEAPALPFNLATEAELGAGASFGGDGEILDEVITRSRGEFRRISSPKITSSTATPISDRKSIDSPHRSFSPRLSELRGEHSPRAGGRGTPGQRSAEAKPSSLGKSPLNNTASK

SEQ ID NO: 8891 - protein, 714 aa, Ricinus communis
MEETFVPLRGIKNDLRGRLLCYKQDWTSGFKAGLRILAPTTYIFFASAIPVISFGEQLERNTDGVLTAVQTLVSTAVCGIIHSVIGGQPLLILGVAEPTVIMYTFMFNFVKERPDLGRDLFLAWTGWVCVWTAILLFLLAILGACSIINRFTRVAGELFGLLIAMLFMQQAVKGLVDEFRIPQREDRKSIEFIASWRFANGMFALVLSFGLLFTALRSRKARSWRYGTGWLRSLMADYGVPLMVLVWTGVSYIPSGSVPKGIPRRLFSPNPWSPGAYENWTDMLNVPVFYIIGAFIPATMIAVLYYFDHSVASQLAQQKEFNLRKPPSYHYDLLLLGFLTLLCGLLGIPPSNGVIPQSPMHTKSLATLKHQLLRSRLVATARQSIRKNASLGQLYGNMKEAYQQMQTPLIYQQPSEGLKEFKESTIQVASCTGHIDAPVDETVFDIEKEIDDLLPVEVKEQRLSNLLQATMVGGCVAAMPFLKKIPTSVLWGYFAFMAIESLPGNQFWERILLLFTAPSRRYKVLEEYHATFVETVPFKTIAMFTIFQTFYLLICFGLTWVPIAGVMFPLMIMLLVPVRQYFLPKLFKGAHLQDLDAAEYEEAPALPYTLATESELGAGAVQAGDGEILDEVITRSRGEFRHMSSPKITSSTATPANDPKSHQSPRFSSSYSPRLSELRGEKSPKASGKGAKSPRTPELGLSKLGKSPSSSAQN

SEQ ID NO: 8892 - protein, 711 aa, Mimulus guttatus
MEETFVPFRGIKNDIQGRLLCYKQDWTGGFKAGFRILAPTTYIFFASAIPVISFGEQLERNTDGVLTAVQTLVSTAICGIIHSIIGGQPLLILGVAEPTVIMYTFMFTFAKQRPDLGRELFLAWTGWVCVWTAALLFLLAILGACSIINRFTRVAGELFGMLIAMLFMQQAIKGLVDEFRIPKREDTTLTEFMPSWRFANGMFALVLSFGLLLTALRSRKARSWRYGSGWVRSLVADYGVPLMVLVWTAISYIPTKSVPEGIPRRLFSPNPWSPGAYGNWTDMLNVPILYILGAFIPATMIAVLYYFDHSVASQLAQQKEFNLRKPPSFHYDLLLLGFLTLMCGLLGIPPSNGVIPQSPMHTKSLATLKHQLLRNRLVATARESIQTNSSLGQLYGNMQEAYQQMQTPLVYQEPSSARGLKELKESTVQLASSMGSFDAPVDETVFDVDKEIDDLLPVEVKEQRVSNLLQAVMVGGCVAAMPALRMIPTSVLWGYFAFMAIESLPGNQFWERILLLFTAPSRRYKVLEDYHATFVETVPFKTIAMFTVFQTTYLLLCFGITWVPIAGLLFPLLIMLLVPVRQYVLPKFFKGVHLQDLDAADYEEAPAVPFNIPEGELGGGRLSFAADGGEILDGIITRSRGEIKHMCSPKVTSSSSATPAKDGKVLQSPRVGELRGERTPRSGGRGPHSPMTGEVGPSHLGISPRKSASDQ

SEQ ID NO: 8893 - protein, 715 aa, Fragaria vesca
MEETFVPMRGIKNDLRGRLMCYKQDWTGGFRAGYRILAPTTYIFFASAIPVISFGEQLERSTDGALTAVQTLVSTAVCGIIHSIIGGQPLLILGVAEPTVIMYTFMFNFVKEQNDLGAKLFLAWAGWVCVWTAGLLFLLAILGACSIINRFTRIAGELFGLLIAMLFMQQAIKGLVEEFRIPQREDTSLAQFMPSWRFANGMFALVLSFGLLLTALKSRKARSWRYGSGSLRGFIADYGVPLMVLVWTGVSYIPTSSVPKGIPRRLFSPNPWSPGAYENWTQMLDVPILYIIGAFIPATMIAVLYYFDHSVASQLAQQKEFNLRKPSSYHYDLLLLGFLTLMCGLLGIPPSNGVIPQSPMHTKSLATLKHQLLRNKLVATARKSMRKNASLGQLYGNMQEAYHQMQTPLVYQSASSLGLNELKESTIQAASSMGNYIDAPVDDTVFDVEKEIDDLLPVEVKEQRLSNILQAVLVGACVAAMPILKKIPTSVLWGYFAFMAIESLPGNQFWERILLLFTAPSRRYKVLEEYHATFVETVPFKTIVMFTIFQTVYLLICFGLTWVPIAGVMFPLMIMLLVPVRQYFLPKFFKGAHLQDLDAAEYEEAPALPFNLAAETELGAGASCAGDAEILDDAFTRSRGEFKHVSSPKITSTTSTPANAPRSLESPRVSFSPRISELRGVPSPRSGGRGPHSPKTGEVKPSILGKSLSKSNSTS

SEQ ID NO: 8894 - protein, 717 aa, Cucumis sativus
MEETFVPLRGIKNDLKGRLVCYKQDWTGGLRAGYRILAPTTYIFFASAIPVISFGEQLERSTDGVLTAVQTLASTALCGIIHSIVGGQPLLILGVAEPTVIMYTFMFNFAKERPELGRNLFLAWSGWVCVWTAALLFSMAILGACSIINRFTRLAGELFGLLIAMLFMQQAVKGLVDEFQIPERENPKLIEFIPSWRFANGMFALVLSFGLLFTALRSRKARSWRYGSGWLRSLIADYGVPLMVLVWTGISYIPSKSVPEGIPRRLFSPNPWSPGAYENWTVIKDMLEVPVIYICGAFIPATMIAVLYYFDHSVASQLAQQKEFNLRKPSSYHYDLLLLGFLTLICGLLGIPPSNGVIPQSPMHTKSLATLKHQLLRNKLVETARSSMRKNASLGQLYGSMQQAYQQMQTPLIYQQPSVRGLNELKETTIQAASSMGSFDAPVDETMFDIEKEIDDLLPVEVKEQRVSNLLQAAMVGGCVAAMPVLKMIPTSVLWGYFAFMAIESLPGNQFWERILLLFTAPSRRYKVLEDYHATFVETVPFTSIVLFTIFQTVYLFICFGLTWVPIAGVMFPLMIMLLVPVRQYLLPKFFKGAHLQDLDAAEYEEAPALPFNLATEAELGAGASFGGDGEILDEVITRSRGEFRRISSPKITSSTATPISDRKSIDSPHRSFSPRLSELKGEHSPRAGGRGTPGQRSAEAKPSSLGKSPLNNTASK

SEQ ID NO: 8895 - protein, 721 aa, Medicago truncatula
MEETFVPFEGIKNDLRGRLMCYKQDWTGGIKAGVRILAPTTYIFFASAIPVISFGEQLERNTEGVLTAVQTLASTSICGIIHSIIGGQPLLILGVAEPTVIMYTFMFNFAKERPELGRNLFLGWAGWVCVWTALILFLLAILGACSIINRFTRIAGELFGMLIAMLFMQQAIKGLVDEFRIPKREDTKAIEFLPSWRFANGMFALVLSFGLLLTALKSRKARSWRYGSGWLRSLIADYGVPLMVLVWTGVSYMPTASVPNGIPRRLFSPNPWSPGAYDNWTDMVQVPVVFIIGAFIPATMIAVLYYFDHSVASQLSQQKEFNLRKPSSYHYDLLLLGFLTLLCGLIGIPPANGVIPQSPMHTKSLATLKHQLLRNRLVITARNSISKNASLGQLYGNMQEVYHQMQTPLIYQDPSARAQGLKELKETTIQAATSMGNVDAPVDETIFDVEKEIDDLLPVEVKEQRVSNLLQSVLVGGCVAAMPILKKIPTSVLWGYFAFMAIESLPGNQFWERILLLFTAPSRRYKVLEDYHATFVETVPFKTIALFTIFQTIYLFICFGLTWVPIAGVMFPLMIMLLVPLRQYFLPKFFKGAHLQDLDAAEYEEQTALPFNLASQSEFGAGASHIGEGEIFDEVITRSRGEFRHTTNSPKISSSTPTPRNDPKSRLSPHLSFNSRVGEFATEQSPRSGVRGTNSPMTKEMRLSGRGISPLNPDSKHQDKK

SEQ ID NO: 8896 - protein, 714 aa, Vitis vinifera
MEETFVPFRGIKNDLRGRLMCYKQDWAGGFRAGFRILAPTTYIFFASAIPVISFGEQLERNTEGVLTAVQTLASTAICGIIHSIIGGQPLLILGVAEPTVIMYTFMFNFAKERPDLGRKLFLAWTGWVCVWTAFLLFLLAILGACSIINRFTRVAGELFGLLIAMLFMQQAIKGIVDEFRIPKQENAKLTEFIPSWRFANGMFALVLSFGLLLTALRSRKARSWRYGTGWLRSLIADYGVPLMVLIWTAVSYIPAGSVPKGIPRRLVSPNPWSPGAYENWTDMLDVPVLYIVGAFIPATMIAVLYYFDHSVASQLAQQKEFNLRKPPSFHYDLLLLGFLTIMCGLIGIPPSNGVIPQSPMHTKSLATLKHQLLRNRLVATARISMRKNSSLSQLYGNMQEAYQQMQTPLIYQEPSARGLKELKESTIQLASSMGAIDAPVDETVFDVEKEIDDLLPVEVKEQRLSNLLQAAAVGGCVAAMPILKMIPTSVLWGYFAFMAIESLPGNQFWERILLLFTAPSRRYKVLEEYHATFVETVPFKSIATFTIFQTAYLLICFGITWVPIAGLLFPLMIMLLVPVRQYFLPKFFKGAHLQDLDAAEYEEAPALPFNLAMEGEMGAGASLAEGGEILDEIITRSRGEIRHMCSPKITSSTATPTKDPRNFQSPRLSEKAYSPRVSELRGEHSPQSSGRGKYSPKTGEVKPSNLGKSPHSSN

SEQ ID NO: 8897 - protein, 716 aa, Eucalyptus grandis
MEETFVPLEGIKNDLRGRLMCYRQDWSGGFRAGIRILAPTTYIFFASAIPVISFGEQLERSTEGVLTAVQTLASTAICGIIHSIIGGQPLLILGVAEPTVIMYTFMFNFAKERSDLGRNLFLAWAAWVCVWTAALLFLMAILGACSIINRFTRVAGELFGLLIAMLFMQQAIKGLVEEFRIPKQENPKLDEFLPSWRFANGMFALVLSFGLLLTALKSRKARSWRYGTGWLRSFIADYGVPLMVLVWTAVSYIPAKSVPDGIPRRLVSPNPWSPGASENWTVVKDMLNVPFFYIIGAFIPATMIAVLYYFDHSVASQLAQQKEFNLRKPASYHYDLLLLGFLTLMCGLIGVPPANGVIPQSPMHTKSLATLKHQLLRNRLVTTARRSIQNNASLGQLYGNMQEAYRQMQTPLVYQGASSRGLNELKETTIQAASSMGNLNAPVDETVFDVDKEIDDLLPVEVKEQRVSNLLQSMMVGGCVAAMPILKMIPTSVLWGYFAFMAIESLPGNQFWERILLLFTAPSRRYKVLEEYHATFVETVPFKAIVTFTLFQTIYLLICFGLTWVPIAGVMFPLMIMLLVPVRQYALPKFFKGVHLQDLDAAEFEEAPALPFNLATETEIGAGASYGGGGEILDEVITRSRGEVRHLSSPKITSSTTTPAHDSKSTLQSPRPSFSPRVSELRGERSPYGGRGPYSPRTGEKQPSHLGKSPSNPASG

SEQ ID NO: 8898 - protein, 718 aa, Lotus japonicus
MEETFVPLEGIKNDLRGRLMCYKQDWIGGIKAGLRILAPTTYIFFASAIPVISFGEQLERDTDGVLTAVQTLASTSVCGIIHSIIGGQPLLILGVAEPTVIMYTFMFNFAKERPELGREKFLAWTGWVCVWTALLLFLLAILGACSIINRFTRIAGELFGMLIAILFMQQAIKGLVDEFRIPEREDPKSIEFIPSWRFSNGMFALVLSFGLLFTALRSRKARSWRYGSGWLRSLIADYGVPLMVLVWTGVSYMPSKSVPNGIPRRLFSPNPWSPGAYENWTDMIHVPVVYIIGAFIPATMIAVLYYFDHSVASQLAQQKEFNLRKPSSYHYDLLLLGFLTLMCGLIGIPPSNGVIPQSPMHTKSLATLKHQLLRNRLVVTARKSIGKNASLGQLYGNMQEAYHQMQTPLIYQDPSARGLKELKETTIQAATSMGNMDAPIDETMFDVEKEIDDLLPVEVKEQRVSNLLQSVMVGGCVAAMPILKRIPTSVLWGYFAFMAIESLPGNQFWERILLLFTAPSRRYKVLEDYHATFVETVPFKTIAAFTIFQTVYLLGCFGLTWVPIAGVMFPLLIMLLVPVRQYFLPKFFKGAHLQDLDAAEYEEQTALPFNIAAQSEFGGGASHIGESEILDEVITRSRGEFRHTSSPRITSSTPTPGNETKSHLSPNLSFNSRMGEFTTEQSPRSGARGPSPKAREVRLSSLGRSPLDPDSKQKQDKK

SEQ ID NO: 8899 - protein, 728 aa, Glycine max
MEETFVPFEGIKNDLRGRLMCYKQDWSGGIKAGLRIWAPTTYIFFASAIPVISFGEQLERDTDGVLTAVQTLASTSICGIIHSILGGQPLLILGVAEPTVIMYTFMFNFAKERPELGRDLFLAWTGWVCVWTALLLFLFAILGACSIINRFTRIAGELFGMLIAMLFMQQAIKGLVDEFRIPERQNSKSIEFIPSWRFANGMFALVLSFGLLLTALRSRKARSWRYGTGWLRSLIADYGVPLMVLVWTGVSYIPAGSVPHGIPRRLFSPNPWSPGAYENWTVIKACKLQDMVHVPVVYIIGAFIPATMIAVLYYFDHSVASQLAQQKEFNLRKPSSYHYDLLLLGFLTLMCGLIGIPPANGVIPQSPMHTKSLATLKHQLLRNKLVVTARKSMGKNASLGQLYGNMLEAYNQMQTPLVYQDPSARAQGLRELKESTIQAATSMGNVDAPVDETIFDVEKEIDDLLPVEVKEQRLSNLLQSTMVGGCVAAMPLLKKIPTSVLWGYFAFMAIESLPGNQFWERILLLFTAPSRRYKVLEDYHATFVETVPFKTIATFTIFQTIYLLICFGLTWVPIAGVMFPMMIMLLVPVRQYFLPKFFKGVHLQDLDAAAYEEQTALPFNLATHSEFGAGASQVGEGEILDEVITRSRGEFRHTSSPKITSSTPTPRTDPKSHLSPRLSFSARVGEFKTEQSPRSGARGPLSPKAGEVRLSNLGRSPLNPDSKQQDQN

SEQ ID NO: 8900 - protein, 343 aa, Arabidopsis lyrata
MLALGYAKGIAHRFLRNPKWTSGLFLHHNQSPNYSIYVKSKPFLQVPCKSASFDVLQAQRRNLFAYDGFFSRRYLSNSTVELRTDDNVVRFAFNNVTGSGNNVVPTRKEKKWKRAKMSRKAKVNELRFYRLKAKKKMNSPNPEVRIRYKLEKAKRKEEWLIEKLRKYDVPKSSAEPYDPESLTEEEQHYLKRTGEKRKNFVLVGRRGVFGGVVLNLHLHWKKHETVKVICKPCNKPGQVHEYAEELARLSKGIVIDVKPNNTIVLYRGKNYVRPEVMSPVDTLSKDKALEKYRYEQSLEHTSEFIEKLEKELEEYQKYVTRHKKKKDEEAEKKKEADSKSKVV

SEQ ID NO: 8901 - protein, 338 aa, Eutrema parvulum
MLASGYAKGIANRFLRNPKLTSGLVLLNLQFPKYSVYAKQRPFVEVPYESASFELLRTSTQNVFAFNRRYVSNSTIELRTDDNVVRFSFNNNVPDNKSVPMMKEKKWKRAKSSRKAKVNELRFYRLKAKKKMNSPNPEVRIRYKLEKAKRKEEWLIEKLRKYDVPKSPAEPYDPETLTEEEQHYLKRTGEKRKNFVLVGRRGVFGGVVLNMHLHWKKHETVKVICKPCNKPGQIHEYADELARLSKGIVIDVKPNNAIVLYRGKNYVRPEVMSPVDTLSKDKALEKYRYEQSLEHTSEFIEKLEKELEEYQKYVARYKKKKDEETETKKEADSKSKAV

SEQ ID NO: 8902 - protein, 352 aa, Eutrema halophilum
MLALSYAKGIANRYLRIPRWTSRLCLLNHQFHNYSVYAKQRPFVEVPYESPSFELLRASRQDVFAYNRRYMSNSTIELRTDDNVVRFSFNNVPDNKSVPMRKEKKWKRAKSSRKAKVNELRFYRLKAKKKMNSPNPEVRIRYKLEKAKRKEEWLIEKLRKYDVPKSPAEPYDPETLTEEEQHYLKRTGEKRKNFVLVGRRGVFGGVVLNMHLHWKKHETVKVICKPCNKPGQIHEYAEELARLSKGIVIDVKPHNTIILYRGKNYVRPEVMSPIDTLSKDKALEKYRYEQSLEHTSEFIEKLETELEEYQKYVARYKKKKDEEAETKKETDSRSKAGYVYDSSLKTPILKRN

SEQ ID NO: 8903 - protein, 216 aa, Arabidopsis lyrata
MSANSKSERSASQSAETVAVSNRVVASRSSRQPRLSFSSFAPSSEHDYLKKLKSDEISPTREEVPVSVKEREETEEEEAKRTWNLRPRKAFGGLKKGNGVLAAEVCGGGGGGGGSEVKNQKSSGGMEPKSNRQRGIPAESPGLGGGEVANENRRLWVALSRDEIEEDLFSMSGNRPSRRPRKRAKALQKYLDVIFPGLCLVGMNADCFRVSTSPAK

SEQ ID NO: 8904 - protein, 386 aa, Arabidopsis lyrata
MDFNRKAHPDCVYADNPFHECASACLERIAQGHVKKNTKKQSSRLLSFSGSFGRKKKESHSQPPSPLSARPYQNGRGGFANSNSPKVHHSVAPSVSVKKKIVSESNKSLTSSSSGDPDDFFNHKPEKKPSQTIPLSSNNLVDQSKAVSPKPGIQEHDGKIGAGGETRLFSFLSLPRSHEEESNDDYTDDDEENNNEIGVELDLESVMSDTFVSVGKYRVRSGSSTILSAIIEKHGDIAQNCKLESDSMRSRYLECLCSLMQELRSTPVGQLSKIKVKEMLAVLKDLESVNIEVAWLRSVLEEFAQSLEDAENEKERHDGLVKAKKEELEAQETDLVRMEKEVAEARLRIEETRAQMVEIEAERSRLEKMGFKMEKFKGKSFIDELL

SEQ ID NO: 8905 - protein, 392 aa, Eutrema parvulum
MDFNQKAHPDCVYADNPFHECASACLERIAQGHVKKNTKKQGSKILSFSGSFGRKKKETHSQPPSPLSVRPYQNGGGGFGNANSPKVHHSVAPPVAVKKKTISESNKSFSSSSSGDPDDFFKHKPEKKLSQIIPLSPNNLVDRSKVVSPKPGKQEHNGKIEAGGETKPFNFLSSPRLPGKESSDDYNDDYSGDDDDEENNTETGVELDLESVMSDTFVSVGKYRVRSGSSTILSAILEKHGDIAQNCKLESDSMRSRYLECLCSLMQELRSTPVGQLTKAKVKEMLAVLKDLESVNIEVAWLRSILEEFSQSQEDVETEKERQEGLVKAKREELEAREADLVRMEKEVAEARLRIEETRVLMVEMERERSRMEKMGFKMEKFKGKTFIDELL

SEQ ID NO: 8906 - protein, 382 aa, Eutrema halophilum
MDFIRNAHPNCVYADNPFHECASACLERIAQGHGKKNTKKQGSKILSFSGSFGRKKKESRSQPLSPLSARPYQNGGGGFANANSPKIHHSVAPAVAVKNKTESFSSSSSGDPDDFFKHKPEKKLSQISLLSPNNLVDRSKAVSPKPGKQEQNGKIEAGGETTLYSFLSSPRSSGKESSDYSNDDDDDKNNNEIGVELDLESVMSDTFVSVGKYRVRSGSSTILSAILEKHGDIAQNCKLESDSMRSRYLECLCSLMQELRSTPVGQLTKVKVKEMLAVLKDLESVNIEVAWLRSILEEFARCQEDVETEKERQESLVKAKREELEAQEADLVRKEKEVAEARLRIEETRAVMVEMEKERSRMEKMGFKMEKFKGKSFIDELL

SEQ ID NO: 8907 - protein, 391 aa, Arabidopsis lyrata
MGCVSSKLGKKKLIREIRVNNGGDHIVSLTSTTYGHLDLDERAETSPKSLEVTKGEVFESEIKARRSIQRDDPEIINTWELMEDLEDSMHVSNPQKISPKSRGIFGKSWKTPVKSVVESPKRGSSKRFGGKENRGGNNSRGVSPNQILKPKNILETPKRGVMRLSFPLKSEEPSVVITQRRKSYSPMFDPDLVASYERELSQEQEQIKMVISPVVHESRKTEKTRESERILEKFPEKCPPGGENSVVIYITTLRGIRKTFEDCNVVRSILDSHEVRFSERDVSMHSVFKEEIRGIMGTKHVKIPAVFVKGRMLGSVEEVMKLEEEGKLGILLEGIPAARLGGSCCRGCGGMRFVMCVVCDGSCKVRGEDKKSMVKCLECNENGLVLCPICS

SEQ ID NO: 8908 - protein, 386 aa, Eutrema halophilum
MGCVSSKLGKKKLIREIRVNNGGDHIVSLTSTTYGHLDLEKRAETSPTLQELTKGDVFESEIKPRRSITQRDDPEIINTWELMEDLEDSMHPQRISPKSRGIFGKSWKTPVKSIVESPKRNSSKRFVGKENRGGNNSRGVSPNQILKPRNILETPKRGVMRLSFPLKSEEPSVQRRKSFSPMFDPNLVASYERELSQEQEQIKMVISPVVRETRKTEKTIESERILKSFPEKCPPGGENSVVIYITSLRGIRKTFEDCNAVRSILDSHEVRFSERDVSMHSVYKEEIRGIMGTKQVKIPAVFVKGRMIGSVEEVVRLEEEGKLGILLECMPKARLGGRCCRGCGGMRFVMCAVCNGSCKVMEEEKKSMVKCLECNENGLVICPFCS

SEQ ID NO: 8909 - protein, 402 aa, Eutrema parvulum
MGCVSSKLVKKKLIREIRVNNGGNHIVSLTSTTYGHLDLDERAETCPKLQEPTKGDDVPDSDIIKPRRSTTQRDDPEIINTWELMEDLEDSMHPQRISPKSRGIFGKSWKTPVKSIVESPKRNSSSKRFGGKENRGGNHSRGVSPNQILKPKNILETPKRGVMRLSFPLKSEEPSVVITQRRKSFSPMFDPDLVASYERELSQEKEQIKMVISPAPETRKHEKHRESERILENFPEKCPPGGGNSVVIYITSLRGIRKTFEDCNAVRSILDSHEVGFSERDVSMHSVFKEEIRSIMGTKQVKIPAVFVKGRMIGSVEEVMRLEEEGKLGILLKCMPKARLGGGACRGCGGLRFVMCAVCNGSCKVMDAEKKNTVKCLDCNENGLVLCPICSLNFFFLSFCPN

SEQ ID NO: 8910 - protein, 232 aa, Eutrema parvulum
MGCVSSKLVKKKLIREIRVNNGGNHIVSLTSTTYGHLDLDERAETCPKLQEPTKGDDVPDSDIIKPRRSTTQRDDPEIINTWELMEDLEDSMHPQRISPKSRGIFGKSWKTPVKSIVESPKRNSSSKRFGGKENRGGNHSRGVSPNQISKERSNAFEFPSQIRGTFGGDYAEEEEFQPHVRSRSRGFLRERVISRERADQDGDMRNTENRRESSRISRRNVHREEETQWSST

SEQ ID NO: 8911 - protein, 1620 aa, Brassica napus
MAMKSLSPVPKLLLSTTPSSVLSSDKNFFFVDFVGLYCKSKRTRRRLRGDSSSSTSRASPLSRLSSVRAVIDLERVHDKDLASPSYLKPQVANLEDILSERGACGVGFIANLDNIPSHGVVKDALIALGCMEHRGGCGADNDSGDGSGLMSSIPWDFFNVWAKEQGLAPFDKLHTGVGMIFLPQEDTFMQEAKQVIENIFEKEGLEVLGWRDVPVNAPIVGKNARETMPNIQQVFVKIAKDDSTDDIERELYICRKLIERAVAAETWGTELYFCSLSNQTIVYKGMLRSEALGLFYLDLQNELYTSPFAIYHRRYSTNTSPRWPLAQPMRFLGHNGEINTIQGNLNWMQSREASLKSSVWNGRENEIRPFGNPRGSDSANLDSAAEILIRSGRTPEEALMILVPEAYKNHPTLSIKYPEVLDFYDYYKGQMEAWDGPALLLFSDGKTVGACLDRNGLRPARYWRTSDNFVYVASEVGVVPVDEAKVTMKGRLGPGMMIAADLVNGQVYENTEVKKRVSSLNPYGKWIKENLRFLKPVNFKSSTVMENEEILRTQQAFGYSSEDVQMVIESMASQGKEPTFCMGDDIPLAGLSQRPHMLYDYFKQRFAQVTNPAIDPLREGLVMSLEVNIGKRGNILELGPENASQVILSNPVLNEGGIEELMKDTYLKPKVLSTFFDIRKGVEGSLQKALYYLCEAADDAVRSGSQLLILSDRTDSLEPTRPAIPIMLAVGAVHQHLIQNGLRMSASIVADTAQCFSTHQFACLIGYGASAVCPYLALETCRQWRLSNKTVALMRNGKIPTVTIEQAQKNYTKAVNAGLLKILSKMGISLLSSYCGAQIFEIYGLGQDVVDLAFTGSVSKISGLTFDELARETLSFWVKAFSEDTTKRLENFGFIQFRPGGEYHSNNPEMSKLLHKAVREKSETAYAVYQQHLANRPVNVLRDLLEFKSDRAPIPVGKVEPAVSIVQRFCTGGMSLGAISRETHEAIAIAMNRIGGKSNSGEGGEDPIRWKPLTDVVDGYSPTLPHLKGLQNGDIATSAIKQVASGRFGVTPTFLVNADQLEIKVAQGAKPGEGGQLPGKKVSAYIARLRSSKPGVPLISPPPHHDIYSIEDLAQLIFDLHQINPNAKVSVKLVAEAGIGTVASGVAKGNADIIQISGHDGGTGASPISSIKHAGGPWELGLTETNQTLIENGLRERVILRVDGGLKSGVDVLMAAAMGADEYGFGSLAMIATGCVMARICHTNNCPVGVASQREELRARFPGVPGDLVNYFLYVAEEVRGILAQLGYSKLDDIIGRTELLKPRDISLVKTQHLDLSYLLSSVGVPSMSSTEIRKQEVHTNGPVLDDDILDDPLVKDAIENEKVVDKTVKICNIDRAACGRVAGVIAKKYGDTGFAGQVNLTFLGSAGQSFGCFLIPGMNIRLVGEANDYVGKGMAGGEIVVTPVDKIGFVPEEATIVGNTCLYGATGGQIFARGKAGERFAVRNSLAEAVVEGTGDHCCEYMTGGCVVVLGKVGRNVAAGMTGGLAYLLDEDDTLLPKINREIVKIQRVTAPAGELQLKSLIEAHVEKTGSSKGETILKEWEKYLPLFWQLVPPSEEDTPEASAAYVRTATGEVTFQSA

SEQ ID NO: 8912 - protein, 1623 aa, Eutrema parvulum
MAMKSLSPVPKLLSTTPSSVLSSDKNFFFVDFVGLYCKSKRTRRRLRGDSSSSSNSRASPLSRLSSVRAVIDLERVNGVSDKDLASPSYLKPQVANLEDILSERGACGVGFIANLDNIPSHGVVKDALIALGCMEHRGGCGADNDSGDGSGLMSSIPWDYFNVWAKEQGLAPFDKLHTGVGMIFLPQDDTFMQEAKQVIENIFEKEGLQVLGWREVPVNAPIVGKNARETMPNIQQVFVKIAKDDSTDDIERELYICRKLIERAVVTESWGNELYFCSLSNQTIVYKGMLRSEVLGLFYLDLQNELYTSPFAIYHRRYSTNTSPRWPLAQPMRFLGHNGEINTIQGNLNWMQSREASLKSSVWNGRENEIRPFGNPRGSDSANLDSAAEILIRSGRTPEEALMILVPEAYKNHPTLSIKYPEIIDFYDYYKGQMEAWDGPALLLFSDGKTVGACLDRNGLRPARYWRTSDNVVYVASEVGVVPVDEAKVTMKGRLGPGMMIAVDLVNGQVYENTEVKKRISSFNPYGKWIKENLRFLKPVNFKSSTVMENEEILRTQQAFGYSSEDVQMVIESMASQGKEPTFCMGDDIPLAGLSQRPHMLYDYFKQRFAQVTNPAIDPLREGLVMSLEVNIGKRGNILELGPENASQVILPNPMLNEGGIEELMKDTYLKPKVLSTFFDIRKGVEGSLQKALYYLCEAADDAVRSGSQLLILSDRSDKLEPTRPAIPIMLAVGAVHQHLIQNGLRMSASIVADTAQCFSTHQFACLIGYGASAVCPYLALETCRQWRLSTKTVALMRNGKIPTVTIEQAQKNYTKAVNAGLLKILSKMGISLLSSYCGAQIFEIYGLGKEIVDLAFTGSVSKISGLTFDELARETLSFWVKAFSEDTTKRLENFGFIQFRPGGEYHSNNPEMTKLLHKAVREKSETAYAVYQQHLANRPVNVLRDLLEFKSDRAPIPVGKVEPAVSIVQRFCTGGMSLGAISRETHEAIAIAMNRIGGKSNSGEGGEDPIRWKPLTDVVDGYSPTLPHLKGLQNGDIATSAIKQVASGRFGVTPTFLVNADQLEIKVAQGAKPGEGGQLPGKKVSAYIARLRSSKPGVPLISPPPHHDIYSIEDLAQLIFDLHQINPNAKVSVKLVAEAGIGTVASGVAKGNADIIQISGHDGGTGASPISSIKHAGGPWELGLTETHQTLIENGLRERVILRVDGGLKSGVDVLMAAAMGADEYGFGSLAMIATGCVMARICHTNNCPVGVASQREELRARFPGVPGDLVNYFLYVAEEVRGILAQLGYNKLDDIIGRTELLRPRDISLVKTQHLDLSYLLSSAGIPSMSSTEIRKQAVHTNGPVLDDDILEDPLVMDAIENEKVVEKTVKICNIDRAACGRIAGVIAKKYGDTGFAGQVNLTFLGSAGQSFACFLIPGMNIRLIGEANDYVGKGMAGGEVVVTPVEKIGFVPEEATIVGNTCLYGATGGQIFARGRAGERFAVRNSLAEAVVEGTGDHCCEYMTGGCVVVLGKVGRNVAAGMTGGLAYLLDEDDTLLPKINREIVKIQRVTAPAGEFQLKSLIEAHVEKTGSSKGETILKDWDKYLPLFWQLVPPSEEDTPEASAAYVRTATGEVTFQSA

SEQ ID NO: 8913 - protein, 1621 aa, Eutrema halophilum
MAMKSLSPVPKILSTTPSSVLSSDKNFFFVDFVGLYCKSKRTRRRLRGDSSSNSRASSLSRLSSVRAVLDLERVNGVSDKDLPSPSFLKPQVANLEEILSERGACGVGFIANLDNIPSHGVVKDALIALGCMEHRGGCGADNDSGDGSGLMSSIPWDFFNVWAKEQGLSPFDKLHTGVGMIFLPQEETFMQEAKQVIENIFEKEGLQVLGWREVPVNAPVVGRNAKETMPNIQQVFVKIAKEDSTDDIERELYICRKLIERAVATESWGSELYFCSLSNQTIVYKGMLRSAVLGLFYLDLQNELYTSPFAIYHRRYSTNTSPRWPLAQPMRFLGHNGEINTIQGNLNWMQSREASLKSSVWNGRENEIRPFGNPRGSDSANLDSAAEILIRSGRTPEEALMILVPEAYKNHPTLSIKYPEVVDFYDYYKGQMEAWDGPALLLFSDGKTVGACLDRNGLRPARYWRTSDNVVYVASEVGVVPVDEAKVTMKGRLGPGMMIAVDLVNGQVYENTEVKKRISSFNPYGKWIKENLRFLKPVNFKSSTIMENEEILRTQQAFGYSSEDVQMVIESMASQGKEPTFCMGDDIPLAGLSQRPHMLYDYFKQRFAQVTNPAIDPLREGLVMSLEVNIGKRGNILELGPENASQVILSNPVLNEGGIEELMKDPYLKPKVLSTFFDIRKGVEGSLQKALYYLCEAADDAVRSGSQLLILSDRSDNLEPTRPAIPIMLAVGAVHQHLIQNGLRMSASIVADTAQCFSTHHFACLIGYGASAVCPYLALETCRQWRLSNKTVALMRNGKIPTVTIEQAQKNYTKAVNAGLLKILSKMGISLLSSYCGAQIFEIYGLGKEVVDFAFTGSVSKISGLTFDELARETLSFWVKAFSEDTTKRLENFGFIQFRPGGEYHSNNPEMSKLLHKAVREKSETAYAVYQQHLANRPVNVLRDLLEFKSDRAPIPVGKVEPAVSIVQRFCTGGMSLGAISRETHEAIAIAMNRIGGKSNSGEGGEDPIRWKHLTDVVDGYSPTLPHLKGLQNGDIATSAIKQVASGRFGVTPTFLVNADQLEIKVAQGAKPGEGGQLPGKKVSAYIARLRSSKPGVPLISPPPHHDIYSIEDLAQLIYDLHQINPNAKVSVKLVAEAGIGTVASGVAKGNADIIQISGHDGGTGASPISSIKHAGGPWELGLTETHQTLIENGLRERVILRVDGGLKSGVDVLMAAAMGADEYGFGSLAMIATGCVMARICHTNNCPVGVASQREELRARFPGVPGDLVNFFLYVAEEVRGILAELGYSKLDDIIGRTELLRPRDISLVKTQHLDLSYLLSSAGLPSMSSTEIRKQDVHSNGPVLDDEILEDPLVMDAIENEKVVDKTVKICNIDRAACGRVAGVIAKKYGDTGFAGQVNLTFLGSAGQSFACFLIPGMNIRLIGEANDYVGKGMAGGEVVVTPVDKIGFVPEEATIVGNTCLYGATGGQIFARGKAGERFAVRNSLAEAVVEGTGDHCCEYMTGGCVVVLGKVGRNVAAGMTGGLAYLLDEDDTLLPKINREIVKIQRVTAPAGELQLKSLIEAHVEKTGSSKGEAILKEWDKYLPMFWQLVPPSEEDTPEASASYVRTATGEVTFQSA

SEQ ID NO: 8914 - protein, 1475 aa, Arabidopsis lyrata
MEHRGGCGADNDSGDGSGLMSSIPWDFFNVWAKEQGLSPFDKLHTGVGMIFLPQEDTFMQEAKQVIENIFEKEGLQVLGWREVPVNVPIVGKNARETMPNIQQVFVKIAKEDSTDDIERELYICRKLIERAVATESWGTELYFCSLSNQTIVYKGMLRSEALGLFYLDLQNELYESPFAIYHRRYSTNTSPRWPLAQPMRFLGHNGEINTIQGNLNWMQSREASLKSSVWNGRENEIRPFGNPRGSDSANLDSAAEILIRSGRTPEEALMILVPEAYKNHPTLSVKYPEVIDFYDYYKGQMEAWDGPALLLFSDGKTVGACLDRNGLRPARYWRTSDNVVYVASEVGVVPVDEAKVTMKGRLGPGMMIAVDLVNGQVYENTEVKKRISSFNPYGKWIKENSRFLKPVNFKSSTVMENEEILRSQQAFGYSSEDVQMVIESMASQGKEPTFCMGDDIPLAGLSQRPHMLYDYFKQRFAQVTNPAIDPLREGLVMSLEVNIGKRGNILELGPENASQVILSNPVLNEGTLEELMKDTYLKPKVLSTYFDIRKGVEGSLQKALYSLCEAADDAVRSGSQLLVLSDRSDSLEPTRPAIPIMLAVGAVHQHLIQNVSFVCSEFSKFVPANAVCPYLALETCRQWRLSNKTVAFMRNGKIPTVTIEQAQKNYTKAVNAGLLKILSKMGISLLSSYCGAQIFEIYGLGKEVVDLAFTGSVSKISGLTFDELARETLSFWVKAFSEDTTKRLENFGFIQFRPGGEYHSNNPEMSKLLHKAVREKSETAYAVYQQHLSNRPVNVLRDLLEFKSDRAPIPVGKVEPAVSIVQRFCTGGMSLGAISRETHEAIAIAMNRIGGKSNSGEGGEDPIRWKPLTDVVDGYSSTLPHLKGLQNGDIATSAIKQVASGRFGVTPTFLVNADQLEIKVAQGAKPGEGGQLPGKKVSAYIARLRSSKPGVPLISPPPHHDIYSIEDLAQLIFDLHQINPNAKVSVKLVAEAGIGTVASGVAKGNADIIQISGHDGGTGASPISSIKHAGGPWELGLTETHQTLIENGLRERVILRVDGGLKSGVDVLMAAAMGADEYGFGSLAMIATGCVMARICHTNNCPVGVASQREELRARFPGVPGDLVNYFLYVAEEVRGILAQLGYSKLDDIIGRTELLKPRDISLVKTQHLDLSYLLSSVGTPSLSSTEIRKQEVHTNGPVLDDDILADPLVIDAIENEKVVDKTVKICNVDRAVCGRVAGVIAKKYGDTGFAGQVNLTFLGSAGQSFGCFLIPGMNIRLIGESNDYVGKGMAGGEIVVTPVDTIGFVPEEATIVGNTCLYGATGGQIFARGKAGERFAVRNSLAEAVVEGTGDHCCEYMTGGCVVVLGKVGRNVAAGMTGGLAYLLDEDDTLLPKINREIVKMQRVTAPAGELQLKSLIEAHVEKTGSSKGATILNEWDKYLPLFWQLVPPSEEDTPEASAAYVRTATGEVTFQSA

SEQ ID NO: 8915 - protein, 1168 aa, Citrus sinensis
MALQSSISPVIAHLSAATKPSSVLSSNKNLLFVDFVGLYCQSNRIRRRIGVSCNQTVFSRLLNKKTSSSVKAVHDLERTTSAPQSDSKPKVANLEDIISERGACGVGFIAHLENKASYEIVKDALTALGCMEHRGGCGADNDSGDGSGLMTSIPWDLFNNWAENEGIASFDKLHTGVGMVFFPKDDDLMKKAKEVIVNTFRQEGLEVLGWRPVPVNTSVVGYYAKETMPNIQQVFVKVVKEESVDDIERELYICRKLIERAAALESCGNELYFCSLSNQTVVYKGMLRSEVLGLFYGDLQNELYKTSFAIYHRRYSTNTSPRWPLAQPMRLLGHNGEINTIQGNLNWMQSREASLKSPVWRGRENEIRPFGNPKASDSANLDSTAELLLRSGRTPDEALMILVPEAYKNHPTLSKKYPEVIDFYDYYKGQMEAWDGPALLLFSDGKTVGACLDRNGLRPARYWRTIDNVVYVASEVGVLPIDDAKVTMKGRLGPGMMIAVDLRSGQVFENTEVKKRVAASNPYGKWVSENLRTLKPVNFFSATAMDNEAILRHQQAFGYSSEDVQMVIETMAAQGKEPTFCMGDDIPLAVLSQKPHMLYDYFKQRFAQVTNPAIDPLREGLVMSLEVNIGRRGNILEAEPENASQVILSSPVLNEGELESLLKDPLLKPQVLPTFFDIRKGIEGSLEKTLYKLCEAADDAVRNGSQLLVLSDRADELEPTRPAIPILLAVGAVHQHLIQNGLRMSASIVADTAQCFSTHQFACLIGYGASAVCPYLALETCRQWRLSSKTVNLMRNGKMPSVTIEQAQMNFCKAVKSGLLKILSKMGISLLSSYCGAQIFEIYGLGKEVVDLAFSGSVSNIGGLTFDELARESLSFWVKAFSGDTAKRLENYGFIQFRPGGEYHGNNPEMSKLLHKAVRQKSENAFSIYQQHLANRPVNVLRDLLEFKSDRAPIPVGRVEPAATIVQRFCTGGMSLGAISRETHEAIAIAMNRLGGKSNSGEGGEDPIRWSPLTDVVDGYSPTLPHLKGLQNGDTATSAIKQVASGRFGVTPTFLANADQLEIKIAQGAKPGEGGQLPGKKVSAYIARLRNSKPGVPLISPPPHHDIYSIEDLAQLIYDLHQVNPKAKVSVKLVGEAGIGTVASGVAKGNADIIQISGHDWWNWSQPY

SEQ ID NO: 8916 - protein, 1621 aa, Quercus alba
MALQSVSPIPHLLHSSSSPKPSILASSNNGRYFIDFVGLHCKSKRTRRKFTATSRTFSHFVSSSKVKAVLDFARNNNASEESDSRSDLRPKVASLDDILSERGACGVGFIANLENKESHGIIKDALTALGCMEHRGGCGADNDSGDGSGVMTSIPWELFNSWGNKQGIAPFDKLHTAVGMIFLPKDDDLLKEAKRVIVNTFQQEGLEVLGWRPVPVNASIVGYYARETMPNIQQVFVKAVKEETVEDIERELYICRKLIERAASSETWGSELYFCSLSNQTIVYKGMLRSEALGLFYSDLQSDLYKSPFAIYHRRYSTNTSPRWPLAQPMRFLGHNGEINTIQGNLNWMQSRESSLKSSVWRGRENEIRPFGNPKASDSANLDSAAELLIRSGRTAEEALMILVPEAYKNHPTLMIKYPEVADFYDYYKGQMEAWDGPALLLFSDGKTVGACLDRNGLRPARYWRTSDNVVYVASEVGVLPMDESKVTMKGRLGPGMMIAVDLTSGQVYENTEVKKRVALSNPFGKWIKENLRSLKPVNFLSGTIMDNDAILRHQQAFGYSSEDVQLVIETMASQGKEPTFCMGDDIPLAILSQKPHMLYDYFKQRFAQVTNPAIDPLREGLVMSLEINIGKRRNILEVGPENASQVILSSPVLNEGELESLLNDPSLKPQVLPTFFDIRKGVDGSLEKTLNKLCEAADEAVRNGSQLLVLSDRSDVLEPTRPAVPILLAVGAVHQHLIQNGLRMSASIVADTAQCFSTHQFACLVGFGASAICPYLALETCRQWRLSKKTVNLMRNGKMPTVTIEQAQKNFCKAVKSGLLKILSKMGISLLSSYCGAQIFEIYGLGKEIVDLSFCGSVSKIGGLTFDELARETLSFWVKAFSEDTAKRLENFGFIQFRPGGEYHGNNPEMSKLLHKAVRQKSESAFSVYQQHLANRPVNVLRDLLEFKSDRAPIPVGKVEPAVSIVLRFCTGGMSLGAISRETHEAIAIAMNRLGGKSNSGEGGEDPIRWRPLTDVFDGYSPTLPHLKGLQNGDTATSAIKQVASGRFGVTPMFLANADQLEIKIAQGAKPGEGGQLPGKKVSAYIARLRNSKPGVPLISPPPHHDIYSIEDLAQLIFDLHQVNPKAKVSVKLVAEAGIGTVASGVAKGNADVIQISGHDGGTGASPISSIKHAGGPWELGLTETHQTLIENGLRERVILRVDGGFKSGVDVLTAAAMGADEYGFGSVAMIATGCVMARICHTNNCPVGVASQREELRARFPGVPGDLVNFFLYVAEEVRGMLAQLGYEKLDDIIGRTDLLRPRDISLMKTQHLDLSYILSNVGLPKWSSTEIRNQDVHTNGPVLDDILLADPEISDAIDNEKVIHKNVKIYNVDRAACGRIAGVIAKKYGDTGFAGQLNITFVGSAGQSFACFLTPGMNIRLIGESNDYVGKGIAGGELVVVPVDNTGFCPEDATIVGNTCLYGATGGQVFVRGKAGERFAVRNSLAEAVVEGTGDHCCEYMTGGCVVVLGKVGRNVAAGMTGGLAYILDEDNALLPKVNKEIVKIQRVTATVGQMQLKNLIEAHVEKTGSSKGSAILKEWDTYLPLFWQLVPPSEEDTPEACADYEKTGAGQVTLQSA

SEQ ID NO: 8917 - protein, 1620 aa, Citrus clementina
MALQSSISPVIAHLSAATKPSSVLSSNKNLLFVDFVGLYCQSNRIRRRIGVSCNQTVFSRLLNKKTSSSVKAVHDLERTTSAPQSDSKPKVANLEDVISERGACGVGFIAHLENKASYEIVKDALTALGCMEHRGGCGADNDSGDGSGLMTSIPWDLFNNWAENEGIASFDKLHTGVGMVFFPKDDDLMKKAKEVIVNTFRQEGLEVLGWRPVPVNTSVVGYYAKETMPNIQQVFVKVVKEESVDDIERELYICRKLIERAAALESCGNELYFCSLSNQTVVYKGMLRSEVLGLFYGDLQNELYKTSFAIYHRRYSTNTSPKWPLAQPMRLLGHNGEINTIQGNLNWMQSREASLKSPVWRGRENEIRPFGNPKASDSANLDSTAELLLRSGRTPDEALMILVPEAYKNHPTLSIKYPEVIDFYDYYKGQMEAWDGPALLLFSDGKTVGACLDRNGLRPARYWRTIDNVVYVASEVGVLPIDDAKVTMKGRLGPGMMIAVDLRSGQVFENTEVKKRVAASNPYGKWVSENLRTLKPVNFFSATAMDNEAILRHQQAFGYSSEDVQMVIETMAAQGKEPTFCMGDDIPLAVLSQKPHMLYDYFKQRFAQVTNPAIDPLREGLVMSLEVNIGRRGNILEAGPENASQVILSSPVLNEGELESLLKDPLLKPQVLPTFFDIRKGIEGSLEKTLYKLCEAADDAVRNGSQLLVLSDRADELEPTRPAIPILLAVGAVHQHLIQNGLRMSASIVADTAQCFSTHQFACLIGYGASAVCPYLALETCRQWRLSSKTVNLMRNGKMPSVTIEQAQMNFCKAVKSGLLKILSKMGISLLSSYCGAQIFEIYGLGKEVVDLAFSGSVSNIGGLTFDELARESLSFWVKAFSGDTAKRLENYGFIQFRPGGEYHGNNPEMSKLLHKAVRQKSENAFSIYQQHLANRPVNVLRDLLEFKSDRAPIPVGRVEPAATIVQRFCTGGMSLGAISRETHEAIAIAMNRLGGKSNSGEGGEDPIRWSPLTDVVDGYSPTLPHLKGLQNGDTATSAIKQVASGRFGVTPTFLANADQLEIKIAQGAKPGEGGQLPGKKVSAYIARLRNSKPGVPLISPPPHHDIYSIEDLAQLIYDLHQVNPKAKVSVKLVGEAGIGTVASGVAKGNADIIQISGHDGGTGASPISSIKHAGGPWELGLTETHQTLIANGLRERVILRVDGGFKSGVDVLMAAVMGADEYGFGSVAMIATGCVMARICHTNNCPVGVASQREELRARFPGVPGDLVNFFLYVAEEVRGMLAQLGYEKLDDVIGRTDLFRPRDISLVKTQHLDLSYILSNVGLPKWSSTEIRNQDVHTNGPVLDEVLLADPEISDAIEYEKVVHKTCKIYNVDRAVCGRIAGVIAKKYGDTGFAGQLNITFIGSAGQSFACFLTPGMNIHLIGEANDYVGKGMAGGEVVVTPIETTGFCPEEATIVGNTCLYGATGGQIFVRGKAGERFAVRNSLVQAVVEGTGDHCCEYMTGGCVVVLGKVGRNVAAGMTGGLAYILDEDDTLIPKVNKEIVKVQRVIAPVGQMQLKSLIEAHVEKTGSSKGTAILKEWDTYLPLFWQLVPPSEEDTPEACAEYVRTATGEVTLQSA

SEQ ID NO: 8918 - protein, 1618 aa, Tabernaemontana elegans
MSVNTVAGQVPQLLYSNGQLASRDLVFLDFVGLCSKRTRRRVGIASSNRLTRGAMLGKNWSSLSIRAVLDLERIGTVSKSSSDDLKPQVASLEDIISERGACGVGFIANLENKASHAIVKDALTALGCMEHRGGCGADNDSGDGSGVMTSIPWDLFNDWAAKSGIAAFDKLHTGVGMIFFPQDEELMKEAKTAIVNIFKEEGLEVLGWRPVPVDASVVGFYARKTVPNIQQVFVRIVKEENVDDIERELYICRKLIERAANSETWGSELYFCSLSNQTIVYKGMLRSEVLGRFYLDLQNDLYESPFAIYHRRYSTNTSPRWPLAQPMRFLGHNGEINTIQGNLNWMQSREASLKSPVWRGRENEIRPFGNPKASDSANLDSAAELLIRSGRTPEEALMILVPEAYKNHPTLSIKYPEVVDFYDYYKGQMEAWDGPALLLFSDGKTVGAALDRNGLRPARYWRTKDNIVYVASEVGVLPMDESKVTMKGRLGPGMMIAVDLTSGQVFENTEVKKRVAFSNPYGKWVNENLRSLKPVNFLSTTVMDNEAILRRQQAFGYSSEDVQMVIESMAAQGKEPTFCMGDDIPLAALSQKPHMLFDYFKQRFAQVTNPAIDPLREGLVMSLEVNLGKRGNILEVGPENTSQVILSSPVFNEGELESLLKDPILKPQVLRTFFDIRKGVEGSLEKTLNKLCEAADEAVRNGSQLLILSDRSDEPEPTQPAIPILLAVGAVHQHLIQNGLRMSASIVADTAQCFSTHHFACLIGYGASAVCPYLALETSRQWRLSTKTVNLMRNGKMPTVTIEQAQKNYCKAVKSGLLKILSKMGISLLSSYCGAQIFEIYGLGKEVVDIAFCGSNSSIGGLTLDELARESLSFWVKAFSEDTAKRLENFGFIQFRPGGEYHGNNPEMSKLLHKAVRQKSEIAYSVYQQHLATRPVNVLRDLLEFKSDRSPIPVGRVEPASSIVQRFCTGGMSLGAISRETHEAIAIAMNRIGGKSNSGEGGEDPIRWKPLTDVVDGYSPTLPHLKGLQNGDTATSAIKQVASGRFGVTPTFLANADQLEIKIAQGAKPGEGGQLPGKKVSAYIARLRNSKPGVPLISPPPHHDIYSIEDLAQLIFDLHQVNPKAKVSVKLVAEAGIGTVASGVAKGNADIIQISGHDGGTGASPISSIKHAGGPWELGLTESHQTLIENGLRERVILRVDGGFKSGMDVLMAAAMGADEYGFGSVAMIATGCVMARICHTNNCPVGVASQREELRARFPGVPGDLVNYFLYVAEEVRGMLAQLGYEKLDDVIGRTDLLRPRDISLMKTQHLDLSYILSSVGLPKWSSTAVRNQEVHSNGPVLDDTLLSDPEISDAIKNEKVVNKTVPIYNVDRAVCGRIAGVVAKKYGDTGFAGQLNMTFMGSAGQSFACFLTPGMNIRLVGEANDYVGKGMAGGELVVTPVDNTGFCPEDATIVGNTCLYGATGGQVFVRGKAGERFAVRNSLAEAVVEGTGDHCCEYMTGGCVVVLGKVGRNVAAGMTGGLAYILDEDDTLIPKLNKEIVKIQRVVAPVGQMQLKSLIEAHAEKTGSSKGTAILKEWDKYLPLFWQLVPPSEEDTPEACAEYEQTAAGQVSLQSA

SEQ ID NO: 8919 - protein, 1491 aa, Populus trichocarpa
MEHRGGCGADNDSGDGSGLMTSIPWELFDKWAESEGIGSFDKSHTGVGMVFFPKDDNLVKEAKKAIVNIFEQEGLEVLGWRSVPVNTSVVGFYAKETMPNIQQVFVKVIKEENVDDIERELYICRKLIERAANSANWGNELYFCSLSNQTIVYKGMLRSEVLGMFYSDLQNDIYKSPFAIYHRRYSTNTSPRWPLAQPMRFLGHNGEINTIQGNLNWMQSRETSLKSSVWHGRENEIRPYGNPKASDSANLDSAAELLIRSGRAPEEALMILVPEAYKNHPTLTIKYPEVVDFYDYYKGQMEAWDGPALLLFSDGKTVGACLDRNGLRPARYWRTVDNFVYVASEVGVVPMDESKVTMKGRLGPGMMIAVDLPGGQVYENTEVKKRVALLNPYGKWVKENLRSLKPANFLSATVMDNEVTLNRQQAFGYSSEDVQMVIENMASQGKEPTFCMGDDIPLAILSQKPHMLYDYFKQRFAQVTNPAIDPLREGLVMSLEVNIGKRRNILEVGPENASQVILSSPVLNEGELELLLKDPYLKPQVLPTFFDIRKGVEGSLEKTLIKLCEAADEAVRNGSQLLVLSDRSDELEPTRPAIPILLAVGAVHQHLIQNGLRMSTSIVADTAQCFSTHQFACLIGYGASAICPYLALETCRQWRLNKRTVNLMMNGKMPTVTIEQAQKNFCKAVKSGLLKILSKMGISLLSSYCGAQIFEIYGLGKEIVDLAFCGSVSNIGGATFDELARETLSFWVKAFSQATAKRLENYGFIQFRPGGEYHGNNPEMSKLLHKAVRQKSENAFSIYQQHLSNRPVNVLRDLLEFKSDRAPIPVGKVEPATSIVQRFCTGGMSLGAISRETHEAIAIAMNRLGGKSNSGEGGEDPIRWSPLTDVVDGYSPTLPHLKGLQNGDTATSAIKQVASGRFGVTPTFLVNADQLEIKIAQGAKPGEGGQLPGKKVSAYIARLRNSKPGVPLISPPPHHDIYSIEDLAQLIYDLHQVNPKAKVSVKLVAEAGIGTVASGVAKGNADIIQISGHDGGTGASPISSIKHAGGPWELGLTESHQTLIENGLRERVILRVDGGFKSGVDVMMAAVMGADEYGFGSVAMIATGCVMARICHTNNCPVGVASQREELRARFPGIPGDLVNFFLYVAEEIRGMLAQLGYQKLDDIIGHTDLLRPRDISLVKTQHLDLSCIMSSVGLPKLRSTDIRNQDVHTNGPVLDDVVLADPEILDAINNEKVVNKTIKIYNVDRAVCGRIAGVVAKKYGDTGFAGQLNITFTGSAGQSFACFLTPGMNIRLIGEANDYVGKGMAGGELVVTPVENTGFVPEDAAIVGNTCLYGATGGQVFVRGKAGERFAVRNSLAQAVVEGTGDHCCEYMTGGCVVVLGKVGRNVAAGMTGGLAYILDEDDTLMPKVNKEIVKVQRVTASVGQMQLKSLIEAHVEKTGSSKGAAILKEWDTNLPLFWQLVPPSEEDTPEACAAYEANSAGQVTSLQSA

SEQ ID NO: 8920 - protein, 1621 aa, Amsonia hubrichtii
MSVNTVAGQVPQLLYSNGQLASRDLVFLDFVGLCSKSSKRTGRRLGVASSTRLTRGGLLGKNWSSSSIRAVLDLERIGTVSKSSSYDLKPQVANLEDIISERGACGVGFIANLENKASHEIVKDALTALGCMEHRGGCGADNVSGDGSGVMTSIPWDLFNDWAAKHGITAFDKIHTGVGMIFFPKDEVLMKEAKTAIVNIFKEEGLEVLGWRPVPVDASIVGFYARETIPNIQQVFVRIVKEENTDDIERELYICRKLIEKAANCETWGSDLYFCSLSNQTIVYKGMLRSEVLGTFYPDLQNDLYKSPFAIYHRRYSTNTSPRWPLAQPMRFLGHNGEINTIQGNLNWMQSRETSLKSPVWRGRENEIRPFGNPKASDSANLDSAAEILIRSGRTPEEALMILVPEAYKNHPTLSIKYPEAVDFYDYYKGQMEAWDGPALLLFSDGKTVGATLDRNGLRPARYWRTKDNIVYVASEVGVLPMDESKVTMKGRLGPGMMIAVDLTSGQVFENTEVKKRVALSNPYGKWVNENLRSLKPANFLSTTVMDNEAILRSQQAYGYSSEDVQMVIESMAAQGKEPTFCMGDDIPLAALSRKPHMLFDYFKQRFAQVTNPAIDPLREGLVMSLEVNLGKRGNILEVGPENASQVILSSPVLNEGELEALLKDPILKPQVLRTFFSIRRGLEGSLEKMLNKLCEAADEAVRNGSQLLILSDRSDELEPTQPAIPILLAVGAVHQHLIQNGLRMSASIVADTAQCFSTHHFACLIGYGASAVCPHLALETCRQWRLSTKTVNLMRNGKMPTVTIEQAQKNYCKAVKSGLLKILSKMGISLLSSYCGAQIFEIYGLGKEVVDIAFCGSKSSIGGLTLDELARESLSFWVKAFSEDTAKRLENFGFIQFRPGGEYHGNNPEMSKLLHKAVRQKSESAYSVYQQHLATRPVNVLRDLLEFKSDRSPIPVGRVEPASSIVQRFCTGGMSLGAISRETHEAIAIAMNRIGGKSNSGEGGEDPIRWKPLTDVVDGYSPTLPHLKGLQNGDTATSAIKQVASGRFGVTPTFLANADQLEIKIAQGAKPGEGGQLPGKKVSAYIARLRNSKPGVPLISPPPHHDIYSIEDLAQLIFDLHQVNPKAKVSVKLVAEAGIGTVASGVAKGNADIIQISGHDGGTGASPISSIKHAGGPWELGLTETHQTLIENGLRERVILRVDGGFKSGMDVLMAAAMGADEYGFGSVAMIATGCVMARICHTNNCPVGVASQREELRARFPGVPGDLVNYFLYVAEEVRGMLAQLGYEKLDDVIGRTDLFRPRDVSLMKTQHLDLSYILSNVGLPKWSSTAIRNQEVHSNGPVLDDTLLSDPEISDAIENEKVVNKTVPIYNVDRAVCGRIAGIVAKKYGDTGFAGQLNITFTGSAGQSFACFLTPGMNIRLVGEANDYVGKGMAGGELVVTPVENTGFCPEEATIVGNTCLYGATGGQVFVRGKAGERFAVRNSLAEAVVEGTGDHCCEYMTGGCVVVLGKVGRNVAAGMTGGLAYILDEDDTLIPKVNKEIVKIQRVLAPVGQMQLKSLIEAHVEKTGSTKGATILNEWDKYLPLFWQLVPPSEEDTPEACAEYEQTAAGQVTLQSA

SEQ ID NO: 8921 - protein, 1491 aa, Populus trichocarpa
MEHRGGCGADNDSGDGSGLMTSIPWELFDKWAESEGIGSFDKLHTGVGMIFFPKDDNLMKEAKEVIVNIFKQEGLEVLGWRPVPVNTSVVGFYAKETMPNIEQVFVRVINEEDVDDIERELYICRKLIERAANSESWGNELYFCSLSNRTIVYKGMLRSEVLRLFYSDLQNDIYKSPFAIYHRRYSTNTSPRWPLAQPMRFLGHNGEINTIQGNLNWMQSRETSLKSSVWHGRENEIRPYGNPKASDSANLDSAAELLIRSGRTPEHALMVLVPEAYKNHPTLTIKYPEVVDFYDYYKGQMEAWDGPALLLFSDGKTVGACLDRNGLRPARYWRTVDNFVYVASEVGVVPMDESKVTMKGRLGPGMMITVDLPGGQVYENTEVKKRVALSNPYGKWVHENLRSLKSTNFLSATVMDNESILRCQQAFGYSSEDVQMVIENMASQGKEPTFCMGDDIPLAILSQKPHMLYDYFKQRFAQVTNPAIDPLREGLVMSLEINIGKRGNILEDGPENASQVILSSPVLNEGELELLLKDPYLKPQVLPTFFDIRKGVEGSLEKTLIKLCAAADEAVRNGSQLLVLSDRSDDLEPTRPAIPILLAVGAVHQHLIQNGLRMSTSIVADTAQCFSTHHFACLIGYGASAICPYLALETCRQWRLSKRTVNLMMNGKMPTVTIEQAQKNFCKAVKSGLLKILSKMGISLLSSYCGAQIFEIYGLGKEVVDLAFCGSVSNIGGVTFDELARETLSFWVKAFSEATAKRLENYGFIQFRPGGEYHGNNPEMSKLLHKAVRQKSENAFSIYQQHLANRPVNVLRDLLEFKSDRAPIPVGKVEPAISIVQRFCTGGMSLGAISRETHEAIAIAMNRLGGKSNSGEGGEDPIRWTPLSDVVDGYSPTLPHLKGLQNGDTATSAIKQVASGRFGVTPTFLVNAVQLEIKIAQGAKPGEGGQLPGKKVSAYIARLRNSKPGVPLISPPPHHDIYSIEDLAQLIYDLHQVNPKAKVSVKLVAEAGIGTVASGVAKGNADVIQISGHDGGTGASPISSIKHAGGPWELGLTETHQTLVANGLRERVILRVDGGFKSGVDVLMAAAMGADEYGFGSVAMIATGCVMARICHTNNCPVGVASQREELRARFPGVPGDLVNFFLYVAEEVRGMLAQLGYQKLDDIIGHTDLLRQRDISLVKTQHLDLSYIMSSVGLPKLSSTDIRNQDVHSNGPVLDDVVLADPEILDAIENEKVVNKTIKIYNVDRAVCGRIAGVVAKKYGDTGFAGQLNITFTGSAGQSFACFLTPGMNIRLIGEANDYVGKGMAGGELVVTPVENTGFVPEDATIVGNTCLYGATGGQVFVRGKAGERFAVRNSLAEAVVEGTGDHCCEYMTGGCVVVLGKVGRNVAAGMTGGLAYMLDEDDTLMPKVNKEIVKVQRVTAPVGQMQLKSLIEAHVEKTGSGKGAAILKEWDTYLPLFWQLVPPSEEDTPEACASFEATSAGQVTSFQSA

SEQ ID NO: 8922 - protein, 1629 aa, Vitis vinifera
MSLHSFSPTSQLLHSNVFPAAQSPPPTSVFATNKGIILADFVGLYCKSRRARPRIGVSGHRRFHKFSAGKFGTINAVLDLDRIKNAAEQSSSRSDSKPKVANLDDIISERGACGVGFIANLDNKASHEVVKDALAALSCMEHRGGCGADNDSGDGSGLMTSIPWDLFNNWAKEQRIGSFDRLHTGVGMVFLPKDDDLMKEAKTVIDNSFKQEGLEVLGWRPVPVDISIVGYYAKETMPNIQQVFVRVVKEENIDDIERELYICRKLIERAVKSETWGNELYFCSLSNQTIVYKGMLRSEVLGNFYLDLKSDIYKSPFAIYHRRYSTNTSPRWPLAQPMRLLGHNGEINTIQGNLNWMQSREASLKSPVWRGRENEIRPFGNPKASDSANLDSTAELLIRSGRSAEESLMILVPEAYKNHPTLMIKYPEVVDFYNYYKGQMEAWDGPALLLFSDGKTVGACLDRNGLRPARYWRTIDNVVYVASEVGVLPMDESKVVMKGRLGPGMMISVDLTSGQVYENTEVKKQVALSNPYGKWVNENMRSLRPVNFLSATVMDNEGILRHQQAYGYSSEDVQMVIETMAAQAKEPTFCMGDDIPLAVISQRSHMLYDYFKQRFAQVTNPAIDPLREGLVMSLEVNIGKRGNILEVGPENASQVNLSSPVLNEGELESLLKDPHLKPRVLPTFFDIRKGVEGSLQKRLNKLCEAADEAVRNGSQLLVLSDRSDELEPTRPGIPILLAVGAVHQHLIQNGLRMSASIVADTAQCFSTHHFACLIGYGASAVCPYLALETCRQWRLSNKTVNLMRNGKMPTVTIEQAQKNFCKAVQSGLLKILSKMGISLLSSYCGAQIFEIYGLGREVVDLAFCGSVSSIGGLTLDELARETLSFWVKAFSEDTAKRLENFGFIQFRPGGEYHGNNPEMSKLLHKAVRQKSESAFSVYQQHLANRPVNVLRDLLEFKSDRSPIPLGKVEPAASIVQRFCTGGMSLGAISRETHEAIAIAMNRLGGKSNSGEGGEDPIRWSPLTDVVDGYSPTLPHLKGLQNGDTATSAIKQVASGRFGVTPTFLANADQLEIKIAQGAKPGEGGQLPGKKVSAYIARLRNSKPGVPLISPPPHHDIYSIEDLAQLIFDLHQVNPKAKVSVKLVAEAGIGTVASGVAKGNADIIQISGHDGGTGASPISSIKHAGGPWELGLSESHQTLIENGLRERVILRVDGGFKSGVDVMMAATMGADEYGFGSVAMIATGCVMARICHTNNCPVGVASQREELRARFPGVPGDLVNFFLYVAEEVRGILAQLGFEKLDDVIGRTDLLRPRDISLVKTQHLDLSYILSNVGLPKWSSTEIRNQDVHSNGPVLDDIILADPETSDAIENEKVVNKSIKIYNVDRAVCGRIAGVVAKKYGDTGFAGQLNITFTGSAGQSFACFLTPGMNIRLIGEANDYVGKGMAGGELVVTPVEDTGFLPEDATIVGNTCLYGATGGQIFVRGKGGERFAVRNSLAEAVVEGTGDHCCEYMTGGCVVVLGKVGRNVAAGMTGGLAYILDEDDTLIPKVNKEIVKIQRVTAPVGQMQLKSLIEAHVEKTGSSKGSAILKEWDTYLPLFWQLVPPSEEDTPEASAEFERTDASQVTLQSA

SEQ ID NO: 8923 - protein, 1625 aa, Prunus persica
MALQSLAPIPQLVHCSNNGRSPAKPLRNGLFVVDFVGLYCKSKRTRRKFGTSEHRSFPQFVSRSYPVKAVLDLGRSDAALDQSAASPSSDLKPKVADLHDIIAERGACGVGFIANLENKASHGIIEDALTALGCMEHRGGCGADNDSGDGSGLMSSIPWDLFDNWANKQGISSFDKLHTGVGMVFLPKDDDLMKEAKKVVVNIFRQEGLEVLGWRPVPVNASVVGYYAKETMPNIQQVFVKVVKEENVEDIERELYICRKLIEKAASSESWGNELYFCSLSNQTIVYKGMLRSEILGLFYSDLQSDLYKSPFAIYHRRYSTNTTPRWPLAQPMRLLGHNGEINTIQGNLNWMQSREASLKSPVWNGRENEIRPYGNPKASDSANLDSAAEFLLRSGRSAEEALMILVPEGYKNHPTLSIKYPEVVDFYDYYKGQMEPWDGPALLLFSDGKTVGACLDRNGLRPARYWRTSDNVVYVASEVGVLPVDDSKITMKGRLGPGMMIAADLISGQVYENTEVKKRVALSHPYGKWVQENMRSLKAVNFLSGTVAENDAILRRQQAFGYSSEDVQMVIETMASQGKEPTFCMGDDIPLAILSQRPHMLYDYFKQRFAQVTNPAIDPLREGLVMSLEVNIGKRQNILEVGPENASQVILSSPVLNEGELDLLLKDAQLKPQVLPTFFDIHKGVDGSLEKTLYRLCEAADEAVQNGCQLLVLSDRSDELEATRPAIPILLAVGAVHQHLIQNGLRMSASIIVDTAQCFSTHQFACLIGYGASAVCPYLALETCRQWRLSTKTVNLMRNGKMPTVTIEQAQKNFCKAVKAGLLKILSKMGISLLSSYCGAQIFEIYGLGKEVVDLAFCGSISSVGGLTFDELARETLSFWVKAFSEDTAKRLENFGFIQFRPGGEYHGNNPEMSKLLHKAIRQKNENAFSVYQQHLANRPVNVLRDLVEFKSDRAPIPVGKVEPAVSIVQRFCTGGMSLGAISRETHEAIAIAMNRIGGKSNSGEGGEDPIRWKPLTDVVDGYSPTLPHLKGLQNGDTATSAIKQVASGRFGVTPTFLVNADQLEIKIAQGAKPGEGGQLPGKKVSAYIARLRNSKPGVPLISPPPHHDIYSIEDLAQLIYDLHQVNPKAKVSVKLVAEAGIGTVASGVAKGNADVIQISGHDGGTGASPISSIKHAGGPWELGLTETHQTLLSNGLRERVILRVDGGFKSGVDVLMAAAMGADEYGFGSVAMIATGCVMARICHTNNCPVGVASQREELRARFPGVPGDLVNFFLYVAEEVRGMLAQLGYEKLDDIIGRTDLLRPRDISLVKTQHLDLSYLLSNVGLPKWSSTMIRNQDVHTNGPVLDDILLADPEISDAIENEKVVYKTIKIYNVDRAVCGRIAGVVAKKYGDTGFAGQLNITFTGSAGQSFGCFLTPGMNIRLVGEANDYVGKSISGGELVVTPVENTGFCPEDATIVGNTCLYGATGGQIFIRGKAGERFAVRNSLAQAVVEGTGDHCCEYMTGGCVVILGKVGRNVAAGMTGGLAYILDEDDTFIPKVNREIVKIQRVNAPVGQMQLKSLIEAHVEKTGSSKGSSILKEWDKYLPLFYQLVPPSEEDTPEACADYEQTAAVDVTLQSTA

SEQ ID NO: 8924 - protein, 1621 aa, Vinca minor
MSVNTVAGQFVPQLLYSNGQLGSRDMLFLDFVGLCTKSSKCFTRRKLRLTRGGLLPKHCSSNNNVRAVLDFQRIGSVSKSSSSIDLKPQVANLEDIIAEKGECGVGFIANLENKASHGIVKDALIALGCMEHRGGCGADNDSGDGSGVMTSIPWDLFNDWAALNGIAAFDKLHTGVGMVFFPKDEALMEQAKTAIVNIFKEEGLEVLGWRPVPVDTSVVGYYARETMPNIEQVFVRIVKEENVDDIERELYICRKLIERLASSETWGSELYFCSLSNQTIVYKGMLRSEVLGRFYLDLQNDLYQSPFAIYHRRFSTNTSPKWPLAQPMRFLGHNGEINTIQGNLNWMQSREASLKSPVWRGRENEIRPFGNSKASDSANLDSAAELLIRSGRAPEEALMILVPEAYKNHPTLSIKYPEVVDFYDYYKGQMEAWDGPALLLFSDGKTVGATLDRNGLRPARYWRTKDNIVYVASEVGVLPMDESKVTMKGRLGPGMMIAVDLTSGQVFENTEVKKRVALSYPYGKWVNENLRSLKPANFLSTPVMDNEVILRRQQAYGYSSEDVQMIIESMASQGKEPTFCMGDDIPLAALSQKPHMLFDYFKQRFAQVTNPAIDPLREGLVMSLEVNIGKRRNILEVGPENASQVFLSSPVLNEGELESLLKDPILKPKVLRTFFDIKKGVEGSLEKTLNKLCEAADEAVRAGSQLLILSDRSDEPEPTQPAIPILLAVGAVHQHLIQNGLRMSASIVADTAQCFSTHHFACLIGYGASAVCPYLALETSRQWRLSNKTVNLMRNGKMPTVTIEQAQKNYCKAVKSGLLKILSKMGISLLSSYCGAQIFEIYGLGKDVVDIAFCGSKSSIGGLTLDELARETLSFWVKAFSEDTAKRLENFGFIQFRPGGEYHSNNPEMSKLLHKAVREKSENAYSVYQQHLATRPVNVLRDLLEFKSDRSPIPVGRVEPASSIVKRFCTGGMSLGAISRETHEAIAIAMNRIGGKSNSGEGGEDPIRWKPLTDVVDGYSPTLPHLKGLQNGDTATSAIKQVASGRFGVTPTFLANADQLEIKIAQGAKPGEGGQLPGKKVSAYIARLRNSKPGVPLISPPPHHDIYSIEDLAQLIFDLHQVNPKAKVSVKLVAEAGIGTVASGVAKANADIIQISGHDGGTGASPVSSIKHAGGPWELGLTETHQTLIENGLRERVILRVDGGFKSGMDVLIAAAMGGDEYGFGSIAMIATGCVMARICHTNNCPVGVASQREELRARFPGVPGDLVNYFLYVAEEVRGMLAQLGFEKLDDIIGRTDLLRPRDISLVKTQHLDLSYILSNVGLPKWSSTTIRHQEVHSNGPVLDDTLLSDPEISDAIENEKVVNKTVPIYNVDRAVCGRVAGVIAKKYGDSGFAGQLNITFTGSAGQSFACFLTPGMNIRLVGEANDYVGKGMAGGEVVVTPVDNTGFCPEDATIVGNTCLYGATGGQIFVRGKAGERFAVRNSLAEAVVEGTGDHCCEYMTGGCVVVLGKVGRNVAAGMTGGLAYILDEDDSFIPKVNKEIVKIQRVLAPVGQMQLKNLIQAHVEKTGSNKGATILNDWDKYLPLFWQLVPPSEEDTPEACAEYEETAAGQVTTTLQSA

SEQ ID NO: 8925 - protein, 1489 aa, Ricinus communis
MEHRGGCGADNDSGDGSGLMTSIPWDLFNNWADKQGIASFDKLHTGVGMVFLPKDDNLMKEAKQVVENVFKQEGLEVLGWRPVPVNKSIVGFYAKETMPNIQQVFVRIVKDESVDDIEREFYICRKLIERAATSERWGNELYICSLSNQTIVYKGMLRSEVLGLFYSDLQSDLYKSPFAIYHRRYSTNTSPRWPLAQPMRLLGHNGEINTIQGNLNWMQSRESSLKSPVWRGRENEIRPFGNPKASDSANLDSAAELLIRSGRNPEEALMILVPEAYKNHPTLTIKYPEVVDFYDYYKGQMETWDGPALLLFSDGKTVGACLDRNGLRPARYWRTVDNFVYVASEVGVLPMDESKVTMKGRLGPGMMIAVDLLGGQVYENTEVKKRVALSNPYGKWVSENLRSLKPANFLSTTDLDNEAILRRQQSFGYSSEDVQMVIESMAAQGKEPTFCMGDDIPLAILSQRPHMLYDYFKQRFAQVTNPAIDPLREGLVMSLEVNIGKRGNILEVGPENAMQVNLSSPVLNEGELESLLKDPHLKPQVLPTFFDIRKGVEGTLEKTLLRLCEKADEAVRNGSQLLVLSDRSDDLEPTRPAIPILLAVGAVHQHLIQNGLRMSTSIIADTAQCFSTHHFACLIGYGASAVCPYLALETCRQWRLSNKTVNLMRNGKMPTVTIEQAQKNFCKAVKAGLLKILSKMGISLLSSYCGAQIFEIYGLGKEVVDLAFCGSKSTIGGATLDELARETLSFWVKAFSEDTAKRLENFGFIQFRPGGEYHGNNPEMSKLLHKAVRQKNESAFSIYQQHLANRPVNVLRDLVEFKSDRAPISVGKVEPASSIVERFCTGGMSLGAISRETHEAIAIAMNRLGGKSNSGEGGEDPIRWSPLSDVTDGYSPTLPHLKGLQNGDTATSAIKQVASGRFGVTPTFLVNADQLEIKIAQGAKPGEGGQLPGKKVSAYIARLRNSKPGVPLISPPPHHDIYSIEDLAQLIYDLHQVNPKAKVSVKLVAEAGIGTVASGVAKGNADIIQISGHDGGTGASPISSIKHAGGPWELGLTESHQTLIENGLRERVILRVDGGFKSGVDVMMAAAMGADEYGFGSVAMIATGCVMARICHTNNCPVGVASQREELRARFPGVPGDLVNYFLYVAEEVRGMLAQLGYQKLDDIIGRTDLLRARDISLMKTQHLDLSYILSNVGLPKWSSTEIRNQDVHSNGPVLDDVILADPQILDAIENEKIVNKTIKIYNVDRAVCGRIAGVVAKKYGYTGFAGQLNITFTGSAGQSFACFLTPGMNIRLVGEANDYVGKGMAGGEVVVMPVENPGFCPEDATIVGNTCLYGATGGQVFVRGKAGERFAVRNSLAEAVVEGTGDHCCEYMTGGCVVVLGKVGRNVAAGMTGGLAYILDEDDTLMPKVNKEIVRAQRVTAPVGQMQLKSLIQAHVEKTGSGKGAAILKEWDNYLPRFWQLVPPSEEDTPEACADYQATVAGEVLQSA

SEQ ID NO: 8926 - protein, 1490 aa, Fragaria vesca
MEHRGGCGADNESGDGAGLMSSIPWDLFNNWADKQGIASFDKLHTGVGMVFLPKEDNLMKEAKKAIVNIFKQEGLEVLGWRPVPVNTAIVGFNAKETMPSIQQVFVKVVKEEKVEDIERELYICRKLIERAAISESWGSDLYFCSLSNQTIVYKGMLRSEALGLFYSDLQSDLYKSSFAIYHRRYSTNTTPRWPLAQPMRLLGHNGEINTIQGNLNWMQSRESSLKSPVWHGRENEIRPYGNPKGSDSANLDSAAEFLLRSGRTAEEALMILVPEGYKNHPTLMINYPEVVDFYDYYKGQMEAWDGPALLLFSDGKTVGACLDRNGLRPARYWRTSDNVVYVASEVGVLPVDDSKVTMKGRLGPGMMISVDLLSGQVYENTEVKKRVALSNPYGTWVQENMRTLKAVNFLSSTIADNDAILRRQQAFGYSSEDVQMVIETMASQGKEPTFCMGDDIPLAILSQRPHMLYDYFKQRFAQVTNPAIDPLREGLVMSLEVNIGKRRNILEVGPENALQVILSSPVLNEGELESLLNDAQLKPHVLPTFFDIHKGVDGSLEKALYRLCEAADDAVQNGCQLLVLSDRSDELEATHPAIPILLAVGAVHQHLIQNGLRMSASIIVDTAQCFSTHQFACLIGYGASGVCPYLALETCRQWRLSNKTVNLMRNGKMPSVTIEQAQKNFCKAVRAGLLKILSKMGISLLSSYCGAQIFEIYGLGKGVVDLAFCGSISSIGGLTFDELARETLSFWVKAFSEDTAKRLENFGFIQFRPGGEYHGNNPEMSKLLHKAVRQKNESAFSVYQQHLANRPVNVLRDLIEFKSDRAPIPVGKVEPAVSIVQRFCTGGMSLGAISRETHEAIAIAMNRIGGKSNSGEGGEDPIRWKPLADVVDGYSPTLPHLKGLQNGDTATSAIKQVASGRFGVTPTFLVNADQLEIKIAQGAKPGEGGQLPGKKVSAYIARLRNSKPGVPLISPPPHHDIYSIEDLAQLIYDLHQVNPKAKVSVKLVAEAGIGTVASGVAKGNADVIQISGHDGGTGASPISSIKHAGGPWELGLTETHQTLIENGLRERVILRVDGGFKSGVDVLMAATMGADEYGFGSVAMIATGCVMARICHTNNCPVGVASQREELRARFPGVPGDLVNFFLYVAEEVRGMLAQLGYEKLDDIIGRTDLFRPRDISLVKTQHLDLGYILSNVGLPKWTSTMIRNQDVHTNGPVLDDILLADPEISEAIENEKMVQKTIKIYNVDRAVCGRIAGVVAKKYGDTGFAGQLNITFTGSAGQSFGCFLTPGMNIRLVGEANDYVGKSISGGELVVTPAENTGFCPEDATIVGNTCLYGATGGQIFVRGKAGERFAVRNSLAQAVVEGTGDHCCEYMTGGCVVVLGKVGRNVAAGMTGGLAYFLDEDDSFIPKVNREIVKIQRVNAPVGQMQLKSLIEAHVEKTGSGKGYVILEEWDKYLPLFWQLVPPSEEDTPEACADYEKSAADEVTLQSA

SEQ ID NO: 8927 - protein, 1620 aa, Glycine max
MALHSVPSVSHVLRLAEPFPSLHNAHVLLDLAPLRRKPKRRTRRLTAFPSPSSSPLRHSAVKAVLHLDRSTDNNRLHNSSASSSSDSKPQVANLEDILSERGACGVGFIANLENKGSHEIVKDALNALSCMEHRGGCGADNDSGDGSGLMTGVPWELFDNWANTQGIASFDKSHTGVGMVFLPKDAQFLNEAKKVIVNIFRQEGLEVLGWRPVPVNTSVVGYYAKETMPNIQQVFVKIVKEENVDDIERELYICRKLIEKAVSSESWGNELYFCSLSNQTIIYKGMLRSEVLGLFYSDLQNNLYKSPFAIYHRRYSTNTSPRWPLAQPMRLLGHNGEINTIQGNLNWMQSREPSLKSPVWRGRENEIRPFGNPKASDSANLDSAAELLIRSGRSPEEAMMILVPEAYKNHPTLSIKYPEVVDFYDYYKGQMEAWDGPALLLFSDGKTVGACLDRNGLRPARYWRTSDNMVYVASEVGVVPVDESKVVLKGRLGPGMMITVDLPGGQVYENTEVKKRVALSSPYGNWIKENLRSLKPGNFLSASVLDNEAVLRHQQAFGYSSEDVQMVIESMAAQGKEPTFCMGDDIPLAALSQKPHMLFDYFKQRFAQVTNPAIDPLREGLVMSLEVNIGKRRNILETGPENASQVMLSSPVLNEGELESLLKDSYLKPQVLPTFFDISKGIEGSLEKALNKLCEAADEAVRNGSQLLILSDHSEALEPTHPAIPILLAVGTVHQHLIQNGLRMSASIVADTAQCFSTHQFACLIGYGASAVCPYLALETCRQWRLSNKTVNLMRNGKMPTVSIEQAQKNYCKAVKAGLLKILSKMGISLLSSYCGAQIFEVYGLGKEVVDLAFRGSVSKIGGLTFDEVARETLSFWVKAFSEDTAKRLENFGFIQFRPGGEYHANNPEMSKLLHKAVRQKSQSAFSVYQQYLANRPVNVLRDLLEFKSDRAPIPVGKVEPASSIVQRFCTGGMSLGAISRETHEAIAIAMNRIGGKSNSGEGGEDPVRWKPLTDVVDGYSPTLPHLKGLQNGDTATSAIKQVASGRFGVTPTFLANADQLEIKIAQGAKPGEGGQLPGKKVSMYIARLRNSKPGVPLISPPPHHDIYSIEDLAQLIFDLHQVNPKAKVSVKLVAEAGIGTVASGVAKGNADIIQISGHDGGTGASPISSIKHAGGPWELGLTESHQTLIENGLRERVILRVDGGFRSGVDVMMAAIMGADEYGFGSVAMIATGCVMARICHTNNCPVGVASQREELRARFPGVPGDLVNYFLYVAEEVRGILAQLGYEKLDDVIGRTDLFQPRDISLAKTQHLDLNYILSNVGLPKWSSTEIRNQEPHTNGPVLDDVLLADPEVADAIENEKVVNKTIKIYNIDRAVCGRIAGVIAKKYGDTGFAGQLNITFTGSAGQSFACFLTPGMNIRLVGEANDYVGKGIAGGELVITPVDKTGFEPEDAAIVGNTCLYGATGGQVFVRGRAGERFAVRNSLAEAVVEGAGDHCCEYMTGGCVVVLGKVGRNVAAGMTGGLAYILDEDDTFIPKVNREIVKIQRVSAPVGQMQLKSLIEAHVEKTGSTKGAAILKDWDKYLSLFWQLVPPSEEDTPEANAKYDTTTADQVTYQSA

SEQ ID NO: 8928 - protein, 1490 aa, Medicago truncatula
MEHRGGCGADNDSGDGSGLMTAVPWDLFDNWANEQGLASFDKLHTGVGMVFLPKDVELMNKAKKVIVNTFQQEGLEVLGWRPVPVNTSVVGYYAKETMPNIQQVFVKIGKEENTEDIERELYICRKLIEKEVSSESWGNELYFCSLSNRTIVYKGMLRSEVLGLFYSDLQNDLYKSSFAIYHRRYSTNTSPRWPLAQPMRLLGHNGEINTIQGNLNWMQSREPSLKSPVWRGRENEIRPFGNPKASDSANLDSAAELLIRSGRTPEESMMILVPEAYKNHPTLTIKYPEAIDFYDYYKGQMEAWDGPALLLFSDGKTVGACLDRNGLRPARYWRTSDNMVYVASEVGVVPVDESKVISKGRLGPGMMITVDLLGGQVYENMEVKKRVALSNPYGNWIKENLRSLKSENFLSSSVMENDAVLRHQQAFGYSSEDVQMVIESMASQGKEPTFCMGDDIPLAALSQKPHMLFDYFKQRFAQVTNPAIDPLREGLVMSLEVNIGKRRNILEIGPENASQVILSSPVLNEGELESLLKDSHLKPQVLHTFFDITKGIDGSLEKALNKLCDAADEAVRNGSQLLVLSDRSEALEPTHPAIPILLAVGTVHQHLIQNGLRMSASIVADTSQCFSTHQFACLIGYGASAVCPYLALETCRQWRLSNKTVNLMKNGKMPTVSIEQAQKNYCKAVKAGLLKILSKMGISLLSSYCGAQIFEIYGLGKEVVDLAFSGSVSKIGGLTFDELARETLSFWVKAFSEDTAKRLENFGFIVFRPGGEYHANNPEMSKLLHKAVRQKSQNAFSVYQQYLANRPVNVIRDLLEFKSDRAPIPVGKVEPALSIVKRFCTGGMSLGAISRETHEAIAIAMNRIGGKSNSGEGGEDPIRWKPLTDVVDGYSPTLPHLKGLQNGDTATSAIKQVASGRFGVTPTFLANADQLEIKIAQGAKPGEGGQLPGKKVSMYIARLRNSKPGVPLISPPPHHDIYSIEDLAQLIFDLHQVNPKAKVSVKLVAEAGIGTVASGVAKGNADIIQISGHDGGTGASPISSIKHAGGPWELGLTESHQTLVENGLRERVILRVDGGFRSGVDVMMAAIMGADEYGFGSVAMIATGCVMARICHTNNCPVGVASQREELRARFPGVPGDLVNLFLYVAEEVRGTLAQLGYEKLDDIIGRTELLRPRDVSLVKTQHLDLSYILSNVGLPKLSSTEIRNQEPHTNGPVLDDVLLADPKIADAIENEKAVSKTIKIYNVDRSACGRIAGVIAKKYGDTGFAGQLNITFTGSAGQSFGCFLTPGMNIRLVGEANDYVGKGIAGGELVVTPVDKIGFQPEDAAIVGNTCLYGATGGQVFVRGKAGERFAVRNSLAEAVVEGAGDHCCEYMTGGCVVILGNVGRNVAAGMTGGLAYILDEDNTLIPKINREIVKIQRVTAPVGQIQLKKLIEAHVEKTGSNKGEAILKDWDKYLSLFWQLVPPSEEDTPEANAKYDITATEQVTLQSA

SEQ ID NO: 8929 - protein, 1627 aa, Citrullus lanatus
MALPSVSSSISHLRPSSSPSLSPHSPLLSPNHALSLLDFVAFYGRSSRTRRKSSLSYSSSSFPNRSFPHFPSTKSSSSIKALLDLPLPASSSQPLPKVANLDDIISERGACGVGFVANLDNKASHKIIQDALTALGCMEHRGGCGADNDSGDGSGVMTSIPWDLFDNWASGQGIPSFDKLHAGVGMVFLPKDDGHNKEAKEVIASIFRQEGLEVLGWRPVPVKASVVGINAKKTMPNIEQVFVQVVKEENVDDIERELYICRKLIEREANSKSWGSELYFCSLSNQTIVYKGMLRSEVLGLFYDDLQNELYKSPFAIYHRRYSTNTSPRWPLAQPMRLLGHNGEINTIQGNLNWMQSREASLKSSVWRGRENEIRPYGNPRASDSANLDSAAELLIRSGRAPEEALMILVPEAYKNHPTLMIKYPEVVDFYDYYKGQMEAWDGPALLLFSDGKTVGACLDRNGLRPARYWRTSDNFVYVASEVGVLPMDESKVTMKGRLGPGMMITADLQTGQVFENTEVKKRVALSYPYGKWIKENMRSLKPENFLAATVLDTDKLLRSQQAFGYSSEDVQMIIESMAAQGKEPTFCMGDDIPLAILSQKPHMLYDYFKQRFAQVTNPAIDPLREGLVMSLEVNIGKRRNILDIGPENASQVTLSSPVLNEGELESLLKDPYLKAQVLPTFFDIRKGVDGSLEKILNRLCDAADEAVRNGSQLLVLSDRSEELEATRPAIPILLAVGAVHQHLIQNGLRMSATIVADTAQCFSTHQFACLIGYGASAICPYLALETCRHWRLSNKTVNMMRSGKMPTVTIEQAQKNFCKAVKSGLLKILSKMGISLLSSYCGAQIFEIYGLGNEIVDFAFRGSISKIGGLTFDELARETLSFWVKAFSEDTAKRLENFGFIQFRPGGEYHGNNPEMSKLLHKAVRQKNESAYAVYQQHLANRPVNVLRDLLEFKSDRAPIPVGKVEPAASIVQRFCTGGMSLGAISRETHEAIAIAMNRIGGKSNSGEGGEDPIRWRPLADVVDGYSPTLPHLKGLQNGDTATSAIKQVASGRFGVTPTFLVNADQLEIKIAQGAKPGEGGQLPGKKVSAYIARLRNSKPGVPLISPPPHHDIYSIEDLAQLIFDLHQVNPKAKVSVKLVAEAGIGTVASGVAKGNADIIQISGHDGGTGASPISSIKHAGGPWELGLTETHQTLIENGLRERVILRVDGGFKSGVDVLMAAAMGADEYGFGSVAMIATGCVMARICHTNNCPVGVASQREELRARFPGVPGDLVNYFLYVAEEVRGTLAQLGYEKLDDIIGRTELLRPRDISLMKTQHLDLDYILSNVGLPKWSSTEIRNQDVHTNGPILDDILLSDPQILDAIENEKVVQKTVKIYNVDRAVCGRVAGAIAKKYGDTGFAGQLNITFTGSAGQSFACFLTPGMNIRLIGEANDYVGKGMAGGELVVTPTENTGFVPEDAAIVGNTCLYGATGGQVFVRGKAGERFAVRNSLAQAVVEGTGDHCCEYMTGGCVVVLGKVGRNVAAGMTGGLAYILDEDDTLIPKVNKEIVKIQRVTAPVGQMQLKSLIEAHVEKTGSSKGSTILSEWETYLPLFWQLVPPSEEDTPEASAEYVRSATGEVTFQSA

SEQ ID NO: 8930 - protein, 1492 aa, Silene vulgaris
MEHRGGCGSDNDSGDGSGVMTAIPWDLFDIWAKEQGIDTFDRSHTGVGMVFLPKDDALAEEAKKVVLDIFNQEGIEVLGWRSVPTTVSVVGRNAKETMPNIQQLFVRVVREENIDDIERELYICRKLIERAASSETWANELYFCSLSNQTIIYKGMLRSEVLGMFYDDLRNELYTSPFAIYHRRYSTNTSPRWPLAQPMRFLGHNGEINTIQGNLNWMRSRETSLKSPVWRGRESEIRPFGNPRASDSANLDSAAELLIRSGRAAEEALMILVPEAYKNHPTLSIKYPEVLDFYDYYKGQMETWDGPALLLFSDGKTVGACLDRNGLRPARYWRTVDNVVYVASEVGVLPMDESKVIMKGRLGPGMMISVDLTSGQVFENTEVKKRVASAYPYGKWVKENLRSLKPVNFLSGALLENDTILRHQQAFGYSSEDVQMVIESMASQGKEPTFCMGDDIPLAVMSQKPHMLYDYFKQRFAQVTNPAIDPLREGLVMSLEVNIGRRGNILEVGPENASQVILSSPVLNEGELEALLSDPLLKAQVLPTFFDIRKGLDGSLEKTLNRLCEAADEAVRNGSQLLVLSDRSDEPEPTKPAIPILLAVGAVHQHLIQNGLRMSASIVAETAQCFSTHQFACLVGYGASAVCPYLALETCRQWRLSNKTVNLMRTGKMPTVTIEQAQKNFCKAVKSGLLKILSKMGISLLSSYCGAQIFEIYGLGKDVVDLAFCGSVSSIGGLTLDELARETLSFWVKAFSEDTAKRLENFGFIQFRPGGEYHSNNPEMSKLLHKAVRNKSESAYAVYQQHLANRPVNVIRDLIEFKSDRAPIPVGKVEPATSIVQRFCTGGMSLGAISRETHEAIAIAMNRLGGKSNSGEGGEDPIRWKPLTDVVDGYSPTLPHLKGLQNGDTATSAIKQVASGRFGVTPTFLVNADQLEIKVAQGAKPGEGGQLPGKKVSAYIARLRNSKPGVPLISPPPHHDIYSIEDLAQLIYDLHQINPKAKVSVKLVAEAGIGTIASGVAKGNADIIQISGHDGGTGASPISSIKHAGGPWELGLTETHQTLIVNGLRERVILRVDGGFKSGVDVMMAAAMGADEYGFGSLAMIATGCVMARICHTNNCPVGVASQREELRARFPGVPGDLVNYFLYVAEEVRGILAQLGYAKLDDIIGRTDLLKPRDISLMKTQHLDLTYILSNVGLPTMSSTAIRTQEVHTNGPVLDDRILSDPEITDAIENEKIVSKTFEIYNVDRAVCGRIAGVVAKKYGDTGFAGQLNITFTGSAGQSFACFLTPGMYIRLIGEANDYVGKGMAGGELVVTPVENPGFCPEDATIVGNTCLYGATGGQVFVRGKAGERFAVRNSLAQAVVEGTGDHCCEYMTGGCVVVLGKVGRNVAAGMTGGLAYLLDEDDTLIPKVNKEIVKIQRVTAPVGQMLLKSLIEAHVEKTGSSKGAAILKDWDKYLQLFWQLVPPSEEDTPEASADFEQTAVEGEQVTLQSA

SEQ ID NO: 8931 - protein, 1620 aa, Glycine max
MALHSVSSVSHVLRLAEPFPSLHNAHVLLDLAPLRRKPKRRTRRLTAFPLSSPLRHSAVKSVLHLDRSTDNRLHNSSASSSSDSKPQVANLEDIISERGACGVGFIANLENKESHEIVKDALNALSCMEHRGGCGADNDSGDGSGLMTGVPWELFDNWANTQGIASFDKLHTGVGMVFLPKEAQLLNEAKKVIVNIFRQEGLEVLGWRPVPVNTSVVGFYAKETMPNIQQVFVKIVKEENVDDIERELYICRKLIEKAVSSESWGNELYFCSLSNQTIIYKGMLRSEVLGLFYSDLQNDLYKSPFAIYHRRYSTNTSPRWPLAQPMRLLGHNGEINTIQGNLNWMQSREPSLKSPVWRGRENEIRPFGNPKGSDSANLDSAAELLIRSGRSPEEAMMILVPEAYKNHPTLSIKYPEVVDFYDYYKGQMEAWDGPALLLFSDGKTVGACLDRNGLRPARYWRTSDNMVYVASEVGVVPVDESKVVLKGRLGPGMMITVDLLGGQVYENTEVKKRVALSSPYGNWIKENLRTLKLGNFLSASVLDNEAVLRHQQAFGYSSEDVQMVIESMAAQGKEPTFCMGDDIPLAALSQKPHMLFDYFKQRFAQAIQVTNPAIDPLREGLVMSLEVNIGKRRNILEIGPENASQVMLSSPVLNEGELESLLKDSYLKPQVLPTFFDITKGIEGSLEKALNKLCEAADEAVRNGSQLLILSDRSEALEPTHPAIPILLAVGTVHQHLIQNGLRMSASIIADTAQCFSTHHFACLIGYGASAVCPYLALETCRQWRLSNKTVNLMRNGKMPTVSIEQAQKNYCKAVKAGLLKILSKMGISLLSSYCGAQIFEVYGLGKEVVDLAFRGSVSKIGGLTFDEVARETLSFWVKAFSEDTAKRLENFGFIQFRPGGEYHANNPEMSKLLHKAVRQKSQSAFSVYQQYLANRPVNVLRDLLEFKSDRAPIPVGKVEPASSIVQRFCTGGMSLGAISRETHEAIAIAMNRIGGKSNSGEGGEDPIRWKPLTDVVDGYSPTLPHLKGLQNGDTATSAIKQVASGRFGVTPTFLANADQLEIKIAQGAKPGEGGQLPGKKVSMYIARLRNSKPGVPLISPPPHHDIYSIEDLAQLIFDLHQVNPKAKVSVKLVAEAGIGTVASGVAKGNADIIQISGHDGGTGASPISSIKHAGGPWELGLTESHQTLIENGLRERVILRVDGGFRSGVDVMMAAIMGADEYGFGSVAMIATGCVMARICHTNNCPVGVASQREELRARFPGVPGDLVNYFVYVAEEVRGILAQLGYEKLDDVIGRTDLFQPRDISLAKTQHLDLSYILSNVGLPKWSSTEIRNQEPHTNGPVLDDVLLADPEIAYAIENEKVVNKTIKIYNIDRAACGRIAGVIAKKYGDTGFAGQLNITFTGSAGQSFACFLTPGMNIRLVGEANDYVGKGIAGGELVITPVDKTGFEPEDAAIVGNTCLYGATGGQVFVRGRAGERFAVRNSLAEAVVEGAGDHCCEYMTGGCVVVLGKVGRNVAAGMTGGLAYFLDEDNTFIPKVNGEIVKIQRVSAPVGQMQLKSLIEAHVEKTGSTKGAAILKDWEKYLSLFWQLVPPSEEDTPEANAKYDTTTADQVTYQSA

SEQ ID NO: 8932 - protein, 1495 aa, Capsicum annuum
MEHRGGCGADNDSGDGSGLMTSIPWDLFNDWAEKEGIAVFDKLHTGVGMIFLPKDCNQMNEAKKVISNIFNNEGLEVLGWRSVPVDSSVVGYYAKETMPNIQQVFVRIVKEENVDDIERELYICRKLIERAVNSEIWGNELYFCSLSNQTIVYKGMLRSEVLGRFYYDLQSELYTSPLAIYHRRYSTNTSPRWPLAQPMRFLGHNGEINTIQGNLNWMQSREASLKSTVWRDREDEIRPFGNPKASDSANLDSAAELLIRSGRAPEEALMILVPEAYQNHPTLTIKYPEVLDFYNYYKGQMEAWDGPALLLFSDGKTVGACLDRNGLRPARYWRTEDNIVYVASEVGVIPMDDSKVTMKGRLGPGMMISVDLSSGQVFENTEVKKRVALSNPYGEWVKENLRSLKPMNFLSTTVIDGETILRRQQAYGYSSEDVQMVIESMAAQGKEPTFCMGDDIPLAVLSQKPHMLYDYFKQRFAQVTNPAIDPLREGLVMSLEVNLGKRRNILEVGPENASQFILPSPVLNEGELESLLKDSHLKPHVLPTFFDVGKGVDGSLKRSLYKLCEAADEAVRNGSQLLVLSDRFDELEATRPAIPILLAVGAVHQHLIQNGLRMSASIIADTAQCFSTHQFACLIGYGASAVCPYLAFETCRQWRLSTKTVNLMRNGKMPSVTIEQAQKNFCKAVKSGLLKILSKMGISLLSSYCGAQIFEIYGLGKEVVDVAFCGSKSSIGGLTLDELARETLSFWVKAFSEDTAKRLENYGFIQFRQGGEYHGNNPEMSKLLHKAVRQKSESAYSVYQQHLANRPVNVLRDLLEFKSDRSPIPVGRVEPASAIVQRFCTGGMSLGAISRETHEAIAIAMNRLGGKSNSGEGGEDPIRWKPLTDVVDGYSPTLPHLKGLQNGDTATSAIKQIASGRFGVTPTFLANADQLEIKIAQGAKPGEGGQLPGKKVSAYIARLRNSKPGVPLISPPPHHDIYSIEDLAQLIYDLHQVNPKAKVSVKLVAEAGIGTVASGVAKGNADIIQISGHDGGTGASPVSSIKHAGGPWELGLTETHQTLIENRLRERVVLRVDGGFKSGFDVMMAAAMGADEYGFGSVAMIATGCVMARICHTNNCPVGVASQREELRARFPGVPGDLVNYFLYVAEEVRGMLAQLGYEKLDDIIGHTDILRPRDISLMKTRHLDLSYILSNVGLPEWSSSMIRNQEVHSNGPVLDDVLLADPKISDAIENEKVVNKTVEIYNIDRAVCGRIAGAVAKKYGDTGFAGQLNIIFTGSAGQSFACFLTPGMNIRLIGEANDYVGKGMAGGELVVTPVENTGFCPEDATIVGNTCLYGATGGQVFVKGKAGERFAVRNSLAQAVVEGTGDHCCEYMTGGCVVVLGKVGRNVAAGMTGGLAYILDEDETLIRKVNKEIVKIQRVVAPVGQMQLKNLIEAHVEKTGSTKGSLILKDWDKYLPLFWQLVPPSEEDTPEASAEYEQAAVGQVTLQSAEIPLK

SEQ ID NO: 8933 - protein, 1409 aa, Plantago ovata
MEHRGGCGADNDSGDGSGIMTSIPWDLFNKWANEQGIDAFDPLHTGVGMLFLPKDDSLMKQAQTAILNIFKQEGLEVLGWREVPVDASVVGYYAKETMPSIQQVFVKIAKEDDIDDIERELYICRKLTERAASSEAWGNEVYFCSLSNRTIVYKGMLRSEVLGSFYFDLQNDIYKSPFAIYHRRFSTNTSPRWPLAQPMRFLGHNGEINTIQGNLNWMQSRETSLKSPVWRGRENELRPFGNSKASDSANLDSAAELLIRSGRAPEEALMLLVPEAYKNHPTLSIKYPEILDFYDYYKGQMEAWDGPALLLFSDGKTVGACLDRNGLRPARYWKTADNIVYVASEVGVLPMDDSKVTMKGRLGPGMMITVDLQSGQVFENTEVKKRVALSYPYGKWVSENLRELKPVNFLSSTLLDNETILRRQQAYGYSSEDVQMVIESMASQGKEPTFCMGDDIPLAVLSTKPHMLYDYFKQRFAQVTNPAIDPLREGLVMSLEVNLGKRGNILEVGPDNASQVILSSPVLNEGELESLLKDPKLKPHVLHTFFNIRKGVEGSLEKTLYKLCEAADEAVRNGSQLLVLSDRSDDLEATRPAIPILLAVGAVHQHLIQNGLRMQASIVADTAQCFSTHQFACLIGYGASAICPYLALETCRQWRLSSKTVNLMRNGKMPTVTIEQAQKNFCKAVKSGLLKILSKMGISLLSSYCGAQIFEIYGLGKDIVDIAFCGSVSSIGGLTLDELARESLSFWVKAFSEDTAKRLENFGFIQMRPGGEYHGNNPEMSKLLHKAVRQKSESAYSIYQQHLANRPVNVLRDLVEFKSDRSPIPVGKVESASSIVQRFCTGGMSLGAISRETHEAIAIAMNRIGGKSNSGEGGEDPIRWSPLTDVVDGYSPTLPHLKGLQNGDTATSAIKQVASGRFGVTPTFLANADQLEIKVAQGAKPGEGGQLPGKKVSAYIARLRNSKPGVPLISPPPHHDIYSIEDLAQLIYDLHQVNPRAKVSVKLVAEAGIGTVASGVAKGNADIIQISGHDGGTGASPVSSIKHAGGPWELGLTETHQTLISNGLRERVILRVDGGFKSGFDVLMAAAMGADEYGFGSVAMIATGCVMARICHTNNCPVGVASQREELRARFPGVPGDLVNYFLYVAEEVRGMLAQLGYEKLDDVIGHTELLRPRDISLVKTQHLDLGYILSNVGLPKWSSTTIRNQEVHSNGPVLDDTVLADEEIAKAIDNETVVSKTFQIYNVDRAACGRIAGVIAKRYGDTGFAGQLNITFRGSAGQSFACFLTPGMNIRLIGEANDYVGKGMAGGELVVMPVENTGFIPEEAAIVGNTCLYGATGGQVFVRGKAGERFAVRNSLAEAVVEGTGDHCCEYMTGGCVVVLGKVGRNVAAGMTGGLGTFLMKMILLSQR

SEQ ID NO: 8934 - protein, 1621 aa, Solanum lycopersicum
MAVNSVANVPQLLYGQSPKILTGNKDGLFADFLGFYCKSSKRIRRRIGYAATNRRSLINKKCNAVLDLQRGASNASRQSSDIVPKVADLDDILSERGACGVGFIANLDNKASHGIVKDALVALGCMEHRGGCGADNDSGDGSGLMTSIPWDLFNDWAEKEGIAVFDKLHTGVGMVFLPNDSNQMNEAKKVISNIFNNEGLEVLGWRSVPVDSSVVGYYAKVTMPNIQQVFVRVVKEENVDDIERELYICRKLIERAVNSEIWGNELYFCSLSNQTIVYKGMLRSEVLGRFYYDLQNELYTSPLAIYHRRFSTNTSPRWPLAQPMRFLGHNGEINTIQGNLNWMQSREASLKSAVWRDREDEIRPFGNPKASDSANLDSTAELLIRSGRAPEEALMILVPEAYQNHPTLSIKYPEVLDFYNYYKGQMEAWDGPALLLFSDGKIVGACLDRNGLRPARYWRTKDNVVYVASEVGVIPMDESNVTMKGRLGPGMMISVDLSSGQVFENTEVKRRVALSNPYGEWIKENLRSLKPMNFFSTTVMDGETILRRQQAYGYSSEDVQMVIESMAAQGKEPTFCMGDDIPLAVLSQKPHMLYDYFKQRFAQVTNPAIDPLREGLVMSLEVNLGKRRNILEAGPENASQVILPSPVLNEGELESLLKDLHLRPHVLPTFFDVGKGVDGSLKRSLDKLCEAADEAVRNGSQLLVLSDRSDELEATRPAIPILLAVGAVHQHLIQNGLRMSASIVADTAQCFSTHQFACLIGFGASAVCPYLAFETCRQWRLSTKTVNLMRNGKMPSVTIEQAQKNFCKAIKSGLLKILSKMGISLLASYCGAQIFEIYGLGKEVMDIAFCGSKSSIGGLTLDELARETLSFWVKAFSEDTAKRLENYGFLQFRQGGEYHGNNPEMSKLLHKAVRQKSESAYSVYQQHLANRPVNVLRDLLEFKSDRSPIPVGRVEPASAIVQRFCTGGMSLGAISRETHEAIAIAMNRLGGKSNSGEGGEDPIRWKPLTDVIDGYSPTLPHLKGLQNGDTATSAIKQVASGRFGVTPTFLANADQLEIKIAQGAKPGEGGQLPGKKVSAYIARLRNSKPGVPLISPPPHHDIYSIEDLAQLIYDLHQVNPRAKVSVKLVAEAGIGTVASGVAKGNADIIQISGHDGGTGASPVSSIKHAGGPWELGLTETHQTLIENGLRERVVLRVDGGFKSGFDVMMAAAMGADEYGFGSVAMIATGCVMARICHTNNCPVGVASQREELRARFPGVPGDLVNYFLYVAEEVRGMLAQLGYEKLDDIIGRTDILRPRDISLMKTRHLDLSYILSNVGLPEWSSSMIRNQEVHSNGPVLDDVLLADPKISDAIENEKVVNKTVEIYNIDRAVCGRIAGAVAKKYGDTGFAGQLNITFTGSAGQSFACFLTPGMNIRLIGEANDYVGKGMAGGELVVTPVENTGFVPEDATIVGNTCLYGATGGQVFVRGKAGERFAVRNSLAQAVVEGTGDHCCEYMTGGCVVVLGKVGRNVAAGMTGGLAYILDEDETFVPKVNKEIVKIQRVVAPVGQTQLKNLIEAHVEKTGSTKGSVILKDWDKYLPLFWQLVPPSEEDTPEASAEYEQLASGQEVTLQSAEMPLK

SEQ ID NO: 8935 - protein, 1292 aa, Arnica chamissonis
MRLLGHNGEINTIQGNLNWMQSRENSLKSPVWRGRENEIRPFGNPKASDSANLDSAAELFIRSGRTPEEAMMILVPEAYKNHPTLSIKYPEVVDFYNYYKGQMEAWDGPALLLFSDGKTVGACLDRNGLRPARYWRTVDNVVYVASEVGVLPIDDSKVIMKGRLGPGMMITVDLINGQVYENTEVKKRVALSSPYGKWIAENMRILEPANFLSSPTMENETILRHQQAFGYSSEDVQMVIESMASEGKEPTFCMGDDTPLAILSQKSHMLYDYFKQRFAQVTNPAIDPLREGLVMSLEVNLGKRGNILEVGPENASQVTLSSPVLNESELESLFKDPILKSQTIPTFFDIRKGLDGSLEKTLNKICEAADEAVRNGCQLLVLSDRADELEATRPAVPILLAVGAVHQHLIQNGLRMSASIVADTAQCFSTHHFACLIGYGASAVCPYLAFETCRQWRLSKKTLNLMRNGKMQMVTIEKAQNNFKKAVNAGLMKILSKMGISLLSSYCGAQIFEIYGLGKEVVNFAFTGSVSNIGGLTFDELARESLSFWVKAFSEETAKRLENFGFIQMRPGGEYHGNNPEMSKLLHKAVREKRESAYSIYQQHLANRPINVIRDLFEFKSERAPIPVGKVESAASIVERFCTGGMSLGAISRETHEAIAIAMNRIGGKSNSGEGGEDPIRWTPLSDVVDGYSPTLPHLKGLQNGDTATSAIKQVASGRFGVTPTFLVNADQIEIKIAQGAKPGEGGQLPGKKVSAYIARLRNSKPGVPLISPPPHHDIYSIEDLAQLIFDLHQINPKAKVSVKLVAEAGIGTVASGVAKGNADVIQISGHDGGTGASPISSIKHAGGPWELGLTETHQTLITNGLRERVILRVDGGFKSGFDVLMAAAMGADEYGFGSIAMIATGCVMARICHTNNCPVGVASQREELRARFPGVPGDLVNYFLYVAEEVRSTLAQLGYEKLDDIIGHTELLRPRDISLVKTQHLDLSYVLSNVGIPKWSSTTIRKQEVHSNGPVLDDILLSDIEISDAIENEKVVNKTFKIYNVDRAVCGRVAGAVAKKYGDTGFAGQLNITFEGSAGQSFACFLTPGMNIRLVGEANDYVGKGMAGGEVVVKPVENTGFTPEDAAIVGNTCLYGATGGQLFVRGKTGERFAVRNSLAQAVVEGTGDHCCEYMTGGCVVVLGKVGRNVAAGMTGGLAYILDDDDTLIPKINKEIVKIQRVVAPVGQMQLKSLIEAHVEKTGSTKGSAILKEWDKYLPLFWQLVPPSEEDTPEACAEYEQTIAGQVTARSA

SEQ ID NO: 8936 - protein, 1490 aa, Mimulus guttatus
MEHRGGCGADNDSGDGSGIMTSIPWDLFNKWAHEQGMSSFDQLHTGVGMVFLPKDDDLMKQAKQAILDIFKQEGLEVLGWRPVPVDASVVGFYAKETMPNIQQVFVQISKEENIDDIERELYICRKLIERAATSAAWGNDVYFCSLSNQTIVYKGMLRSEILGRFYFDLQNDVYKTPFAIYHRRYSTNTSPRWPLAQPMRFLGHNGEINTIQGNLNWMQSRETSLKSPVWRGRENEIRPFGNSKASDSANLDSAAELLIRSGRNPEEALMLLVPEAYKNHPTLMIKYPEVVDFYDYYKGQMEPWDGPALLLFSDGKTVGACLDRNGLRPARYWRTVDNVVYVASEVGVLPIEDSKVVMKGRLGPGMMITVDLSSGQVFENTEVKKRVAQLNPYGKWVSENLRSLKAVNFLSSTVMDNETILKRQQAYGYSSEDVQMVIESMASQGKEPTFCMGDDIPLAVLSRRPHMLYDYFKQRFAQVTNPAIDPLREGLVMSLEVNLGKRGNILEVGPENVSQVILSNPVLNEGELESLLKDPFLKAQILPTFFSIRKGIEGSLEKRLYKLCEAADEAVRNGAQLLVLSDRSDELDATKPAIPILLAVGAVHQHLIQNGLRMQTSIVADTAQCFSTHQFACLIGYGASAICPYLALETCRQWRLSTKTVNLMRNGKMPTVTIEQAQKNFCKSVRSGLMKILSKMGISLLSSYCGAQIFEIYGLGKDIVDLAFCGSVSSIGGLTLDELARETLSFWVKAFSEDTAKRLENFGFIQFRPGGEYHGNNPEMSKLLHKAVRQKSETAYLVYQQHLANRPVNVLRDLIEFTSDRAPIPVGRVEPALSIVKRFCTGGMSLGAISRETHEAIAIAMNRLGGKSNSGEGGEDPIRWSPLTDVVDGYSPTLPHLKGLQNGDTATSAIKQVASGRFGVTPTFLANADQLEIKIAQGAKPGEGGQLPGKKVSAYIARLRNSKPGVPLISPPPHHDIYSIEDLAQLIYDLHQVNPRAKVSVKLVAEAGIGTVASGVAKGNADIIQISGHDGGTGASPVSSIKHAGGPWELGLTESHQTLISNGLRERVILRVDGGFKSGFDVLMAAAMGADEYGFGSVAMIATGCVMARICHTNNCPVGVASQREELRARFPGVPGDLVNYFLYVAEEVRGMLAQLGYEKLDDVIGHTELLKPRDVSLMKTQHLDLSYILSNVGLPKWSSTVIRNQEVHSNGPVLDDTLLSDPEVANAIDNETVVNKSVKIYNVDRAVCGRIAGTIAKKYGDTGFAGQVNLTFTGSAGQSFACFLTPGMNIRLVGEANDYVGKGMAGGEVVVTPEENPGFAPEDATIVGNTCLYGATGGQLFVRGKAGERFAVRNSLAEAVVEGAGDHSCEYMTGGCVVVLGKVGRNVAAGMTGGLAYILDEDNTLIPKVNKEIVKIQRVVAPVGQMQLKNLIEAHVEKTGSSKGAEILKEWDTYLPLFWQLVPPSEEDTPEACADYEETTSGQVTLQSA

SEQ ID NO: 8937 - protein, 1490 aa, Triphysaria pusilla
MEHRGGCGADNDSGDGSGVMTSIPWEYFNTWAHEQGMSAFDQVHTGVGMVFLPKDDELMQHAKTVIVNIFEQEGLEVLGWRSVPVDTSVVGYYARETLPNIQQVFVQIAKEENIDDIERELYICRKLIERAASSEPWGNDLYFCSLSNQTIVYKGMLRAEVLGRFYFDLQNELYKSPFAIYHRRYSTNTSPRWPLAQPMRFLGHNGEINTIQGNLNWMQSREASLKSPVWNGRENEIRPFGNPKASDSANLDMAAELLIRSGRAPEESLMLLVPEAYKNHPTLSIKYPEVIDFYDYYKGQMEAWDGPALVLFSDGKTVGACLDRNGLRPARYWRTSDNVVYVASEVGVVPTDDSKVVAKGRLGPGMMIAVDLTSGQVFENTEVKKRVALLSPYGKWVNENLRSLKTANFLSAPELDNDTILKRQQAFGYSSEDVQMVIEAMAAQAKEPTFCMGDDAPLAVLSRRPHMLYDYFKQRFAQVTNPAIDPLREGLVMSLEVNLGKRGNILEVGPENASQVILSNPVLNERELESLFQDPYLKPQVLPTFFDIRFGVEGSLEKTLYKLCEAADEAVRNGAQLLILSDRSDELEATRPAIPILLAVGAVHQHLIQNGLRMKASIIADTAQCFSTHQFACLIGYGASAICPYLALETCRQWRLSNKTVNLMRNGKIPTVTIEQAQKNFCKAVRSGLMKILSKMGISLLSSYCGAQIFEIYGLGKDIVDLAFCGSMSSIGGLTLDELSRETLSFWIKAFSEDTAKRLENFGFIQFRPGGEYHGNNPEMSKLLHKAVRQKSETAYSVYQLHLANRPVNVLRDLIEFKSGRSPISVGRVEPAISIVKRFCTGGMSLGAISRETHETIAIAMNRLGGKSNSGEGGEDPIRWSPLSDVVDGYSPTLPHLKGLQNGDTATSAIKQVASGRFGVTPTFLVNTDQLEIKIAQGAKPGEGGQLPGQKVSAYIARLRNSKPGVPLISPPPHHDIYSIEDLAQLIYDLHQVNPRAKVSVKLVAEAGIGTVASGVAKGNADIIQISGHDGGTGASPVSSIKHAGGPWELGLTETHQTLLQNGLRERVILRVDGGFKSGYDVLMAATMGADEYGFGSVAMIATGCVMARICHTNNCPVGVASQREELRARFPAVPDDLVNFFLYVAEEVRGMLAKLGYEKLDDVIGHTELLKARDVSLVKTQHLDLSNILSNVGLPKWTSTEIRNQEVHSNGPVLDDTLLSDPELANAIENETIVNKSVDIYNVDRAVCGRIAGVIAKKYGDTGFAGQLNITFNGSAGQSFACFLTPGMNIRLIGEANDYVGKGMAGGELVVTPVTQTGFVPEDATIIGNTCLYGATGGQVFVRGKAGERFAVRNSLAQAVVEGTGDHCCEYMTGGCVIVLGKVGRNVAAGMTGGLAYLLDEDDTLIPKVNKEIVKIQRVIAPVGQMQLKSLIEAHVEKTGSGKGSEILKDWDKYLSLFWQLVPPSEEDTPEACADYQTSSGQVTFQSAS

SEQ ID NO: 8938 - protein, 1629 aa, Eutrema parvulum
MALQSPGAAGASSSVSRLLSSGKVSSTKTLFSVDFVGSYCLSKGTKRRNELAGFRGYSPLLKSSLRSPLSAKAILNFDRPAGDASASFSDLKPKVAYLEDIVSERGACGVGFIAHLENKATHKIVNDALIALGCMEHRGGCGADNASGDGSGLMTSIPWDLFNDWAEKQGMASFDKLHTGVGMLFLPRDENIRKEAKKVVTSVFEKEGLEVLGWREVPVEPSIVGPYAKKTMPNTQQVFVRIVKEDKVDDVERELYICRKLIERAVASESWASELYFSSLSNQTIVYKGMLRSEVLGLFYSDLQNDLYKSAFAIYHRRFSTNTSPRWPLAQPMRFLGHNGEINTIQGNLNWMTSREASLKSPVWHGREDDIRPISNPKASDSSNLDSAAELLIRSGRTPEESLMILVPEAYKNHPTLMIKYPEAVDFYDYYKGQMEPWDGPALVLFSDGKTVGACLDRNGLRPARYWRTSDNVVYVASEVGVLPMDESKVTMKGRLGPGMMISVDLESGQVYENTEVKKRVASNNPYGKWVSENLRTLKPSNFLSSAIMETEETLRRQQAFGYSSEDVQMVIESMAAQGKEPTFCMGDDTPVAVLSQKPHMLYDYFKQRFAQVTNPAIDPLREGLVMSLEVNIGKRGNILEVGPQNVSQVVLSGPLLNERELEGLLSDPHLKSQVLPTFFDIHRGIDGSLKKALLKLCEAADEAVRNGSQVLVLSDRSDNPEPTRPAIPMLLAVGAVHQHLIENGLRMSASIIADTAQCFSTHHFACLIGYGASAICPHLALETCRQWRLSNKTVNMMRNGKMPTVTIEQAQKNYRKAVNTGLLKVLSKMGISLFSSYCGAQIFEIYGLGKEVVEFSFRGSASRIGGLTLDELARETLTFWVRAFSEDTAKRLENFGFIQFRPGGEYHGNNPEMSKLLHKAVREKSETAYAVYQQHLANRPITVFRDLLEFKSDRKPIPVGKVEPASSIVERFCTGGMSLGAISRETHETIAIAMNRLGGKSNSGEGGEDPIRWKPLTDVVDGYSSTLPHLKGLRNGDTATSAIKQVASGRFGVTPTFLVNADQLEIKVAQGAKPGEGGQLPGKKVSAYIARLRYSKPGVPLISPPPHHDIYSIEDLAQLIFDLHQVNPKAKVSVKLVSEAGIGTVASGVAKANADIIQISGYDGGTGASPISSIKHAGGPWELGLAETQQTLIGNGLRERVIIRVDGGFKSGVDVLIAAAMGADEYGFGTLAMIATGCIMARICHTNNCPVGVASQREELRARFPGLPGDLVNFFLYIAEEVRGILAQLGYEKLDDIIGRRDLLKPRDISLVKTHLDLSYLLSSVGLPKRSSTSIRKQEVHSNGPVLDDTLLQDPEIMDAIENEKTVHKTMNIYNVDRAVCGRIAGVIAKKYGDTGFAGQLNLTFNGSAGQSFACFLSPGMNIRLVGEANDYVGKGMAGGEVVILPVESTGFLPEDATIVGNTCLYGATGGLLFVRGKAGERFAVRNSLAQAVVEGTGDHCCEYMTGGCVVVLGKVGRNVAAGMTGGLAYILDEDNTLLPKVNKEIVKIQRVTSPVGQTQLKSLIQAHVEKTGSSKGATIVEEWDKYLAMFWQLVPPSEEDTPEANSDHHLKMTTTGEEEQVSNTFAV

SEQ ID NO: 8939 - protein, 1467 aa, Eucalyptus grandis
MEHRGGCGADNDSGDGSGVMTSIPWSLFDDWASKQGIASFDKSHTGVGMFFFPRDSDLINEAKKVIVNIFRQEGLEVLGWRPVPVDSSIVGFYAKETMPDIQQVFVRVVKEDSVDDIERELYICRKLIEKVASTEKWGNELYVCSLSNQTLVYKGMLRSQVLGKFYLDLQNDLYASSFAIYHRRYSTNTSPRWPLAQPMRFLGHNGEINTIQGNLNWMQSREASLKSPVWRGRENEIRPFGNPKASDSANLDSAAELLIRSGRAPEESLMILVPEAYNHHPTLSIKYPEVVDFYEYYKGQMETWDGPALLLFSHPQTLYDHIVGVLPMDESKVTMKGRLGPGMMISVDLTSGQVYENTDVKKRVALSNPYGKWVAENMRKLKPVNFQSTTTMENESILRHQQAFGYSSEDVQMIIETMAAQGKEPTFCMGDDIPLAVLSQKPHMLYDYFKQRFAQVTNPAIDPLREGLVMSLEVNIGKRGNILEVGPENASQVSLSSPVLNEGELEELLRDPNLKPYVLRTFFDIRKGIEGSLEKTLNRLCEAADEAVRNGSQLLVLSDRLDELEPTRPAIPILLAVGAVHQHLIENGLRMSCSIVADTAQCFSTHQFACLIGYGASAVCPYLALETCRQWRLSTKTVNLMRNGKMPTVTIEQAQKNFCKAVKSGLLKILSKMGISLLSSYCGAQIFEIYGLGRDVVDLSFRGSVSVIGGLTLNELARETLSFWVKAFSEDTAKRLENFGFIQFRPGGEYHGNNPEMSKLLHKAVRQKSLSAFSIYQQHLANRPVNVLRDLLEFTSDRAPIPVGRVEPASSIVERFCTGGMSLGAISRETHEAIAIAMNRLGGKSNSGEGGEDPIRWSPLTDVVDGYSPTLPHLKGLQNGDTATSAIKQVASGRFGVTPTFLVNADQLEIKIAQGAKPGEGGQLPGKKVSAYIARLRNSKPGVPLISPPPHHDIYSIEDLAQLIYDLHQVNPKAKVSVKLVAEAGIGTVASGVAKGNADVIQISGHDGGTGASPVSSIKHAGGPWELGLTESHQTLIANGLRERVILRVDGGFKSGFDVLMAAAMGADEYGFGSVAMIATGCVMARICHTNNCPVGVASQREELRARFPGVPGDLVNFFLYVAEEVRGMLAQLGYEKLDDVIGRTELLKPRDISLVKTQHLDLSYILSSVGLPKWSSTEIRNQEVHTNGPVLDDAVLADPEISDAIENEKVVSKTFSIHNVDRAVCGRVAGVVAKKYGDRGFAGQLNITFLGSAGQSFACFLTPGMNIRLVGEANDYVGKGMAGGELVITPVENIGCCPEDATIVGNTCLYGATGGQVFVRGKAGERFAVRNSLAQAVVEGTGDHCCEYMTGGCVVVLGKVGRNVAAGMTGGLAYILDEDDTLIPKVNREIVKIQRVKAPVGQMQLKSLIEAHVEKTGSSKGSAILEEWDKYLPLFWQFVPPSEEDTPEACAEYEATASGQVTLQSA

SEQ ID NO: 8940 - protein, 1190 aa, Gossypium hirsutum
MEAWDGPALLLFSDGKTVGACLDRNGLRPARYWRTIDNVVYVASEVGVLPVDDSKVIMKGRLGPGMMITADLLSGQVYENTEVKKRVAAINAYGKWVSENMRPLKPVNFLSTTLLDSETILRRQQAFGYSSEDVQMIIETMAAQGKEPTFCMGDDIPLSILSQKAHMLYDYFKQRFAQVTNPAIDPLREGLVMSLEVNIGKRGNILEVGPENASQVTLSSPVLNEGELESLLKDPQLKAQVLPTFFDIRKGIEGSLDKTLYKLCEAADEAVRNGSQLLVLSDRADELEATRPAIPILLAVAAVHQHLIQNGLRMSASIVADTAQCFSTHQFACLIGYGASAVCPYLALETCRQWRLSSKTVNLMRNGKMPTVTIEQAQTNFCKAIKAGLLKILSKMGISLLSSYCGAQIFEIYGLGKEIVDLAFSGSVSKIGGLTFDELARETLSFWVKAFSEDTAKRLENFGFIQFRSGGEYHANNPEMSKLLHKAVREKSEIAFSIYQQHLASRPVNVLRDLLEFKSNRAPIPVGKVEPALSIVQRFCTGGMSLGAISRETHEAIAIAMNRLGGKSNSGEGGEDPIRWRPLTDVVDGYSPTLPHLKGLQNGDTATSAIKQVASGRFGVTPTFLANADQLEIKIAQGAKPGEGGQLPGKKVSAYIAKLRNSKPGVPLISPPPHHDIYSIEDLAQLIFDLHQVNPKAKVSVKLVAEAGIGTVASGVAKANADIIQISGHDGGTGASPISSIKHAGGPWELGLTETHQTLIENGLRERVILRVDGGFRSGVDVLMAAAMGADEYGFGSLAMIATGCVMARICHTNNCPVGVASQREELRARFPGVPGDLVNFFLYVAEEVRGMLAQLGYEKLDDIIGRTDLLKPRDISLVKTQHLDLNYILSNVGLPKWSSTAIRTQEVHSNGSVLDAILLSDPEVSHAIENEKEVHKTIKIYNVDRAVCGRIAGVIAKRYGDTGFAGQINITFTGSAGQSFACFLTPGMNIRLIGEANDYVGKGMAGGELVVTPVENPGFCPEDATIVGNTCLYGATGGQIFVRGKAGERFAVRNSLAQAVVEGSGDHCCEYMTGGCVVVLGKVGRNVAAGMTGGLAYVLDEDDTLIPKVNKEIVKIQRVTAPVGQMQLKSLIEAHVEKTGSAKGSMILLEWDKYLPLFWQLVPPSEEDTPEACAEYQSTASEKVTLQSA

SEQ ID NO: 8941 - protein, 1629 aa, Arabidopsis lyrata
MALQSPGAAGASSSVSRLLTSAKLSSTKTIFSVDFVGSYCISKGTKRRNELSGFRGYSPLLKSSLRSPFSAKAILNSDRAAGDASASFSDLKPQVAYLEDIISERGACGVGFIANLENKATHKIVNDALIALGCMEHRGGCGSDNTSGDGSGLMTSIPWDLFNEWAEKQGMASFDKTHTGVGMLFLPRDDNIRAEAKKVITSIFEKEGLEVLGWRDVPVEASIVGHNAKQTMPNTEQVFVRIVKDDKVDDVERELYICRKLIERAVASESWASELYFSSLSNQTIVYKGMLRSEVLGLFYPDLQNDLYKSAFAIYHRRFSTNTSPRWHLAQPMRFLGHNGEINTIQGNLNWMTSREASLRSPVWHGRENDIRPISNPKASDSANLDSAAELLIRSGRTPEESLMILVPEAYKNHPTLMIKYPEAVDFYDYYKGQMEPWDGPALVLFSDGKTVGACLDRNGLRPARYWRTSDNVVYVASEVGVLPMDESKVTMKGRLGPGMMISVDLESGQVYENTEVKRRVASYNPYGKWVSKNLRNLKPSNFLSSAIMETDETLRRQQAFGYSSEDVQMVIESMAAQGKEPTFCMGDDTPVAVLSQKPHMLYDYFKQRFAQVTNPAIDPLREGLVMSLEVNIGKRGNILEVGPQNVSQVVLSGPVLNERELEGLFSDPQLKSQVLPTFFDIHRGIEGSLKKGLLKLCEAADEAVRSGSQVLVLSDRSDNPEPTRPAIPMLLAVGAVHQHLIQNGLRMSASIIADTAQCFSTHHFACLIGYGASAICPHLALETCRQWRLSNKTVNMMRNGKMPTVTMEQAQKNYRKAVNTGLLKVLSKMGISLFSSYCGAQIFEIYGLGNEVVEFSFRGSASQIGGLTLDELARETLTFWVRAFSEDTAKRLENFGFIQFRPGGEYHGNNPEMSKLLHKAVREKSETAYAVYQQHLANRPITVFRDLLEFKSDRNPIPVGKVEPASSIVERFCTGGMSLGAISRETHETIAIAMNRLGGKSNSGEGGEDPIRWKPLTDVVDGYSSTLPHLKGLRNGDTATSAIKQVASGRFGVTPTFLVNADQLEIKVAQGAKPGEGGQLPGKKVSAYIARLRNSKPGVPLISPPPHHDIYSIEDLAQLIFDLHQVNPKAKVSVKLVSEAGIGTVASGVAKANADIIQISGYDGGTGASPISSIKHAGGPWELGLAETQKTLIGNGLRERVIIRVDGGFKSGVDVLIAAAMGADEYGFGTLAMIATGCIMARICHTNNCPVGVASQREELRARFPGLPGDLVNFFLYIAEEVRGILAQLGYEKLDDIIGRTDLLKARDISLVKTHLDLSYLLSSVGLPKRSSTSIRKQEVHSNGPVLDDTLLQDPEIMDAIENEKTVHKTMSIYNVDRSVCGRIAGVIAKKYGDTGFAGQLNLTFTGSAGQSFACFLTPGMNIRLVGEANDYVGKGMAGGEVVILPVESTGFRPEDATIVGNTCLYGATGGLLFVRGKAGERFAVRNSLAQAVVEGTGDHCCEYMTGGCVVVLGKVGRNVAAGMTGGLAYILDEDNTLLPKMNKEIVKIQRVTSPVGQTQLKSLIQAHVEKTGSSKGAMIVEEWDKYLAMFWQLVPPSEEDTPEANSDHILKTTTGDEEQVSNILAEK

SEQ ID NO: 8942 - protein, 1629 aa, Arabidopsis thaliana
MALQSPGATGASSSVSRLLSSAKLSSTKTIFSVDFVRSYCISKGTKRRNELSGFRGYSPLLKSSLRSPFSVKAILNSDRAAGDASSSFSDLKPQVAYLEDIISERGACGVGFIANLENKATHKIVNDALIALGCMEHRGGCGSDNTSGDGSGLMTSIPWDLFNEWAEKQGIASFDRTHTGVGMLFLPRDDNIRKEAKKVITSIFEKEGLEVLGWRDVPVEASIVGHNAKQTMPNTEQVFVRIVKDDKVDDVERELYICRKLIERAVASESWASELYFSSLSNQTIVYKGMLRSEVLGLFYPDLQNDLYKSPFAIYHRRFSTNTSPRWHLAQPMRFLGHNGEINTIQGNLNWMTSREASLRSPVWHGRENDIRPISNPKASDSANLDSAAELLIRSGRTPEESLMILVPEAYKNHPTLMIKYPEAVDFYDYYKGQMEPWDGPALVLFSDGKTVGACLDRNGLRPARYWRTSDNVVYVASEVGVLPMDESKVTMKGRLGPGMMISVDLENGQVYENTEVKKRVASYNPYGKWVSENLRNLKPSNYLSSAILETDETLRRQQAFGYSSEDVQMVIESMAAQGKEPTFCMGDDTPVAVLSQKPHMLYDYFKQRFAQVTNPAIDPLREGLVMSLEVNIGKRGNILEVGPQNVSQVVLSGPVLNERELEGLLGDPLLKSQILPTFFDIRRGIEGSLKKGLLKLCEAADEAVRNGSQVLVLSDRSDNPEPTRPAIPMLLAVGAVHQHLIQNGLRMSASIIADTAQCFSTHHFACLIGYGASAICPHLALETCRQWRLSNKTVNMMRNGKMPTVTMEQAQKNYRKAVNTGLLKVLSKMGISLFSSYCGAQIFEIYGLGNEVVEFSFRGSASQIGGLTLDELARETLTFWVRAFSEDTAKRLENFGFIQFRPGGEYHGNNPEMSKLLHKAVREKSETAYAVYQQHLANRPITVFRDLLEFKSDRNPIPVGKVEPASSIVERFCTGGMSLGAISRETHETIAIAMNRLGGKSNSGEGGEDPIRWKPLTDVVDGYSSTLPHLKGLRNGDTATSAIKQVASGRFGVTPTFLVNADQLEIKVAQGAKPGEGGQLPGKKVSAYIARLRNSKPGVPLISPPPHHDIYSIEDLAQLIFDLHQVNPKAKVSVKLVSETGIGTVASGVAKANADIIQISGYDGGTGASPISSIKHAGGPWELGLAETQKTLIGNGLRERVIIRVDGGFKSGVDVLIAAAMGADEYGFGTLAMIATGCIMARICHTNNCPVGVASQREELRARFPGLPGDLVNFFLYIAEEVRGILAQLGYEKLDDIIGRTDLLKARDISLVKTHLDLSYLLSSVGLPKRSSTSIRKQEVHSNGPVLDDTLLQDPEIMDAIENEKTVHKTMSIYNVDRSVCGRIAGVIAKKYGDTGFAGQLNLTFTGSAGQSFACFLTPGMNIRLVGEANDYVGKGMAGGEVVILPVESTGFRPEDATIVGNTCLYGATGGLLFVRGKAGERFAVRNSLAQAVVEGTGDHCCEYMTGGCVVILGKVGRNVAAGMTGGLAYILDEDNTLLPKMNKEIVKIQRVTSPVGQTQLKSLIQAHVEKTGSSKGAMIVEEWDKYLAMFWQLVPPSEEDTPEANSDHILKTTTGDEEQVSSTLAEK

SEQ ID NO: 8943 - protein, 91 aa, Arabidopsis lyrata
KTLELKQIQSNTRNPSLSLYLSQQISLLFEMAISKASIVVLMMVIISVVASAQSEAPAPSPTSGSSAISASFVSAGVAAVAALVFGSALRI

SEQ ID NO: 8944 - protein, 96 aa, Brassica napus
KNLSKLLAFSNHQKKLSLLSNTNGDLKGFRRCSRRGDYLRRSYRRFRSGRGSSSESYVRICCFLAVDRFSWCCSRRSSCFRLCSSDLSLCDRDSYF

SEQ ID NO: 8945 - protein, 96 aa, Brassica napus
GPKNLQSFKTFRINKNPSLLLFLLSLSLQISEMAISKASVVALVAVIISVVATVASAQSESPAPSPTSGSGAFSPSIVSAGVAAVAALVFGSALRI

SEQ ID NO: 8946 - protein, 64 aa, Brassica napus
MAISKASVVALVAVIISVVATVASAQVEAPAPSPTSGSAAFSPSIVSAGVAAVAALVFGSALRI

SEQ ID NO: 8947 - protein, 64 aa, Brassica napus
MAISKASVVALVAVIISVVATVASAQSESPAPSPTSGSGAFSPSIVSAGVAAVAALVFGSALRI

SEQ ID NO: 8948 - protein, 362 aa, Arabidopsis lyrata
MASGDQSKKRKQHYRPQNRPVKKKGSYPLKPGVQGFFISCDGGREYQASQEAINVIDSFFEELIQGTDSKVNPGLFDNPINKKVTFSYSEDEDDEEDESNYGEEEENKGDGDKAVVSEGGNDQVNEKEIASEGSCEVKKLAENETEKEEEDKGNQKNGGDEPPRKKTCTEEANPLAKVNENAEKSIDKLIEAELKELGDKSKRRFMKLDPGCNGLVFIQMKRRDGDPSPKDIAQHAMTSAAATKKHMSRFILRLLPIEVSCYPSEEEISRAIKPLVEQYFPIETENPRKFAVLYGARANTGLDRMKIINTIAKSIPAPHKVDLSNPEMSIVVEVVKTVCLIGVVEKYKELAKYNLRQLTSTN

SEQ ID NO: 8949 - protein, 222 aa, Eutrema halophilum
MRLKRTKKEEDEGKQKNGVDEPPRKKACMEEANASTKVNENAEMSIDKLIDAELKELGDKSKRRFMKLDPGCNGIAFIQMKRRDGDPSPKDIAQHAMTSAAATKKHMSRFILRLVPIEVSCYPSEEEISRAIKPLVEQYFPIETDNPRKFAVLYGARANTGLDRMKIINTVAKSIPAPHKVDLSNPEMSIVVEIVKTVCLIGVVEKYKELAKYNLRQLTSTK

SEQ ID NO: 8950 - protein, 120 aa, Eutrema parvulum
MASSDQSKKRKQRYLPQNRPAKKKGAYPLKPGVQGFFISCDGGREYQASQEAINVIDSFFEELVHGTTGLKVNSSGLLENPINKKVTFSYSEDEDEDEEEDEGDNGKEEENKGGLRIRQK

SEQ ID NO: 8951 - protein, 679 aa, Arabidopsis lyrata
MSWLRTAVSKAVEVGNRKNITRTVKNYADSVVQQAGQAVAEGAKLFQDRIGVGAYKSVNQTIQRLEEAAVSYRGHERALLITRWLNVLKEIDRATDSSLKDKQLSSEEQLASDEAKKREWVLYYDPDIGGEPLNFRDVFLQSQALEGIVLSMIIEPPHDEEITLLLEMFGLCLNGGKEVHDAIVSSMQDLATVFSSYKDEVLVKQDELLQFAQNAITGLKINAEMLRIDAEASDLRKKLEKMNASPIPQETEDKELKEAPLTIEAFKETLAKIRLCSRLEGLLIRKRQLSNGDSPDIHAQKVDKLRVLLESLANSTSKAEKRISENRLQKEEALKARVVKANETGEKEKELGAEIAQLEKQREELEAELKRVNISLAAAQARFRNATEERDQFGEANNQIIAHLKTKEDDLSKSVVACKNEAEVIKTWINFLEDTWLLQCSYIETKDKQTLDELEKHEDYFSDVAFNILSVYKKEVAPLISRIENYVENLKNLGPGSEKPPNADQGDNQVSNPRKILEQEYIDYETKIITTFSIVDNMKEQFEVLQSKLDKKDDRRVKELFDDMEKMRQQFESIARPMLEIEIPSPKSSVTSPKSSATSPKSPKPSSSSMDDSTESTQTQKPELSNPPQAPNPTAGSSQEFNPEAELAELESEFGKVARDYSADEVDGWEFDELEKELQ

SEQ ID NO: 8952 - protein, 672 aa, Eutrema halophilum
MSWLRTAVSKAVEVGNRKNITRTVRNYADSVVQQAGQAVAEGAKLFQDRIGVGAYKSVSQTIQRLEEAAVSYRGHERALLLTRWLSVLKEIDRASGSPVKDKQMSSEELLASDEAKKREWVLYYDPDIGGAPLNFRDVFLQSQALEGIVLSMIIEPPHDEEITLLLEMFGLCLNGGKEVHDAIVSSMQDLATVFSSYKDEVLVKQDELLQFAQNAITGLKISAEMLRIDAEASDLRKKLEKMNASQFPQESEEKELKETPLTIEALKETLAKIRLCSRLEELLIRKRQLSNGDSPDIHAQKVDKLKVLLESLANSSSKAEKRITENRLQKEEALKARVVKANETGEKEKELGAEIAQLEKQRDELEAELKRVNISLAAAQARLHNATEERDQFGEANNQIIAHLKTKEDDLSKSVVACKKEAEVIKTWVNFLEDTWLLQSSYTETKDKQTLDELEKHEDYFSDVAFSILSTYKKEVAPLISRIENYVENLKNLGPGSEKPPNADQGDIQVSNPRKSLEQEYLDYETKIITTFSIVDNMKEHFQVLQNKLEKKDDRRVKELFDDMEKMRQEFESIARPTLEIEIPSPKSSASSPKSPNPRSSLDAPTETTSLTQKPELSNPVEAPATSAGSSREFNPEAELAELESEFGKVARDYSADEVDGWEFDELEKELQ

SEQ ID NO: 8953 - protein, 673 aa, Eutrema parvulum
MSWLRTAVNKAVEVGNRKNITRTVKNYADSVVQQAGQAVAEGAKLFQDRVGVGAYKSVNQTIQRLEEAAVSYRGHERALLITRWLTVLKEIDRASEASVKDKELSAEEQLASDDAKRREWVLYYDPDIGGEPLNFRDVFLQSQALEGIVLSMIIEPPHDEEITLLLEMFGLCLNGGKEVHDAIVSSMLDLATVFSSYKDEVLVKQDELLQFAQNAITGLKISAEMLRIDAEASDLRKKLEKMNSSQLSQESEDKELKEAPLTIEALKETLGKIRLCSRLEGILIRKKQLSNGDSADVHAQKVDKLKVLLESLANSTSKAEKRISENRLQKEEALKARVVKANETGEKEKELGAEIAQLEKERNELEAELKRVNISLAAAQARFRNATEERDQFGEANNQIIAHLKTKEDDLSKSVVACKKEAEVIKTWINFLEDTWLLQCSYTETKDKQTLDELEKHEDYFTDVAFNMLSTYKKEVAPLVRRIENYVENLKNLGPGLEKPPNVDQGDIQVSNPRKSLEQEYLDYETKIITTFSIVDNMKEHFQARQSKPEKKDDRRVKELFDDMEKLRQEFESIARPTLEIETPSPKSSASSPKSPKPSSSSMDAPVEPTSLTQKPELSNPAKASTTTAGSSQEFNPEAELAELESEFGKVARDYSADEVDGWEFDELEKELQ

SEQ ID NO: 8954 - protein, 674 aa, Brassica napus
MSWLRTAVNKAVEVGNRKNITRTVKNYADSVVQQAGQAVAEGAKLFQDRIRVGAYKSVNQTIQRLEEAAVSFRGHERALLITRWLYVLKEIDKATGGASVKDKNVTSEEQIAYDEAKRREWVLYYDPDIGGQPLNFRDVFLQSQALEGIVLSMIMEPPHDEEVTLLLEMFRLCLNGGKEVHDAIVSSMQDLATVFSSYKDEVLVKQDELIQFAQNAITGLKINAEMLRIDAEASELRKKLEKMNASQIPQESEDKEVKAAPLTIEALKETLAKIRLCSRLEALLNRKRQLSNGDSPDIHAQKVDKLKVLLESLANSISKAEKRISENRLQKEEALKARVVKADETGEKEKELSAEIAQLEKQRDELEAELKKVNITLAAAQARFRNATEERDQFGEANNQIIAHLKTKEDDLSKSVVACKKESEVIKTWINFLEDTWLLQCSYTETKDKQTLDELEKHEDYFSDVAFNILTTYKKEVTPLVRRIENYVENLKNLGPGLEKPPNADQGDIQVANPRKSLEQEYLDYETKIIATFSIVDNMKEHFQVLQSKLEKKDDRRVKELFDDMEKLRQEFEAIARPTLEIETPSPKSVASSPKAPKPSSSSMDAPLESTTTVTQKPVVSETAPTTTTAGSSREFNHEAELAELESEFGKVARDYTADEVDGWEFDELEKELQ

SEQ ID NO: 8955 - protein, 631 aa, Brassica napus
LFQDRIRVGAYKSVNQTIQRLEEAAVSFRGHERALLITRWLSVLKEIDKAIGASSVKDKDVSSEEQLASDEAKRREWVLYYDPDIGGQPLNFRDVFLQSQALEGIVLSMIMEPPHDEEVTLLLEMFRLCLNGGKEVHDAIVSSMQDLATVFSSYKDEVLVKQDELIQFAQNAITGLKINAEMLRIDAEAADLRKKLEKMNASQFQQESEDKEGKAAPLTIEALKETLAKIRICSRLEALLVKKRQLSNGDSPDIHAQKVDKLKVLLESLANSISKAEKRISENRLQKEEALKVRVVKADETGEKEKELSAEIAQLEKQRDELEAELKKVNITLAAAQARFRNATEERDQFGEANNQIIAHLKTKEDDLSKSVVACKKESEVIKTWINFLEDTWLLQCSYTETKDKQTLDELEKHEDYFTDVAFNILTTYKKEVTPLVRRIENYVENLKNLGPGLEKPPNADQGDSQVSNPRKSLEQEYLDYETKIIATFSIVDNMKEHFQVLQSKLEKKDDRRVKELFDDMEKLRQEFEAIARPTLEIETPSPKSVASSPKAPKPSSSSMDAPLESTTTVTQKPEVSETAPTTTTTTGSSQEFNHEAELAELESEFGKVARDYTADEVDGWEFDELEKELQ

SEQ ID NO: 8956 - protein, 160 aa, Eutrema parvulum
MSDPNDAGMDAVQRRLMFEDECILVDENDRVVGHDTKYKCHLMEKIEAENLLHRAFSVFLFNSKYELLLQQRSKTKVTFPLVWTNTCCSHPLYRESELIEENVLGVRNAAQRKLLHELGIVAEDVPVNEFTALGRMLYKAPSDGKWASTNLTIYFSSCGM

SEQ ID NO: 8957 - protein, 233 aa, Eutrema halophilum
MTDPNDAGMDAVQRRLMFEDECILVDENDRVVGHDTKYNCHLMEKIEAENLLHRAFSVFLFNSKFELLLQQRSKTKVTFPLVWTNTCCSHPLYRESELIEENVLGVRNAAQRKLLDELGIVAQDVPVDEFTALGRMLYKAPSDGKWGEHELDYLLFIVRDVKVQPNPDEVADIKYVSREELKELVKKADAGDEAVKLSPWFRLVVDNFLMKWWDHVEKGTLIEAADMKTIHKL

SEQ ID NO: 8958 - protein, 362 aa, Arabidopsis lyrata
MLSRSVASAVSPVSSSSLLPNSKPIFCLKTLSGYRSSSFCGGSFRKINHKPLRMTSSNMTPRAMATQQLENADQLIDSVETFIFDCDGVIWKGDKLIEGVPETLDMLRAKGKRLVFVTNNSTKSRKQYGKKFETLGLNVNEEEIFASSFAAAAYLQSINFPKDKKVYVIGEEGILKELELAGFQYLGGPDDGKRQIELKPGFLMEHEHDVGAVVVGFDRYFNYYKIQYGTLCIRENPGCLFIATNRDAVTHLTDAQEWAGGGSMVGALVGSTQREPLVVGKPSTFMMDYLADKFGIQKSQICMVGDRLDTDILFGQNGGCKTLLVLSGVTSISMLESPENKIQPDFYTSKISDFLSPKAATV

SEQ ID NO: 8959 - protein, 362 aa, Unknown
  Sequence found in Organisms: Thellungiella halophila, Eutrema halophilum
MLNRAIASAVSSVTSSSSSVSLLPKSKPFFSVKTLSGSSRSPSFCGGFTRRIDHKPLRMTTRAMATQQLENADQLIDSVETFIFDCDGVIWKGDKLIEGVPETLDMLRAKGKRLVFVTNNSTKSRKQYGKKFETLGLNVNEEEIFASSFAAAAYLQSINFPKDKKVYVIGEEGILKELELAGFQYLGGPDDGKRQIELKPGFLMEHDHDVGAVVVGFDRYFNYYKIQYGTLCIRENPGCLFIATNRDAVTHLTDAQEWAGGGSMVGALVGSTQREPLVVGKPSTFMMDYLADKFGIQKSQICMVGDRLDTDILFGQNGGCKTLLVLSGVTSISMLESPENKIQPDFYTSKISDFLSPKTANV

SEQ ID NO: 8960 - protein, 360 aa, Eutrema parvulum
MLNRAVVASSSSFSLLPNSKPFFSSVKSLSGFRSSSFSGGFIRRIDHKPLRMTSLSSTPKATATKQLENADQLIDSVETFIFDCDGVIWKGDKLIEGVPETLDMLRAKGKRLVFVTNNSTKSRKQYGKKFETLGLNVNEEEIFASSFAAAAYLQSINFPKDKKIYVIGEEGILIELELAGFQYLGGPDDGKRQIELKPGFLMEHDNDVGAVVVGFDRFFNYYKVQYGTLCIRENPGCLFIATNRDAVTHLTDAQEWAGGGSMVGALVGSTQREPLVVGKPSTFMMDYVADKFGIQKSQICMVGDRLDTDILFGQNGGCKTLLVLSGVTSISMLESPENKIQPDFYTSKISDFLTPKAATV

SEQ ID NO: 8961 - protein, 359 aa, Brassica napus
MLNRTTLVSSSSVSLLPNSKPFFSVKAFSGFRSSSFSGGIIRRIDHKPLRVMTPNMTPRAMAAQQLENADQLIDSVETFIFDCDGVIWKGDKLIEGVPETLDMLRAKGKRLVFVTNNSTKSRKQYGKKFETLGLNVNEEEIFASSFAAAAYLQSINFPKDKKVYVIGEEGILKELDLAGFQYLGGPDDGKKQIELKPGFLMEHDNDVGAVVVGFDRYFNYYKIQYGTLCIRENPGCLFIATNRDAVTHLTDAQEWAGGGSMVGALVGSCQREPLVVGKPSTFMMDYLADKFGIEKSQICMVGDRLDTDILFGQNGGCKTLLVLSGVTSISMLESPENKIQPDFYTSKISDFLSLKAANV

SEQ ID NO: 8962 - protein, 354 aa, Brassica juncea
TLVSSSSVSLLPNSKPFFSVKNLSGFRSSSFSGGFIRRINHKPLCVMTPNLTPRAMAAQQLENADQLIDSVETFIFDCDGVIWKGDKLIEGVPETLDMLRAKGKRLVFVTNNSTKSRKQYGKKFETLGLNVNEEEIFASSFAAAAYLQSINFPKDKKVYVIGEEGILKELDLAGFQYLGGPDDGKKQIELKPGFLMEHDNDVGAVVVGFDRYFNYYKIQYGTLCIRENPGCLFIATNRDAVTHLTDAQEWAGGGSMVGALVGSCQREPLVVGKPSTFMMDYLADKFGIEKSQICMVGDRLDTDILFGQNGGCKTLLVLSGVTSISMLESPENKIQPDFYTSKISDFLSLKAANV

SEQ ID NO: 8963 - protein, 359 aa, Brassica napus
MLNRTTLVSSSSVSLLPNSKPFFSVKAFSGFRSSSFSGGIVRRIDHKPLRVMTPNLTPRAMAAQQLENADQLIDSVETFIFDCDGVIWKGDKLIEGVPETLDMLRAKGKRLVFVTNNSTKSRKQYGKKFETLGLNVNEEEIFASSFAAAAYLQSINFPKDKKVYVIGEEGILKELDLAGFQYLGGPDDGKKQIELKPGFLMEHDNDVGAVVVGFDRYFNYYKIQYGTLCIRENPGCLFIATNRDAVTHLTDAQEWAGGGSMVGALVGSCQREPLVVGKPSTFMMDYLADKFGIEKSQICMVGDRLDTDILFGQNGGCKTLLVLSGVTSISMLESPENKIQPDFYTSKISDFLSLKAANV

SEQ ID NO: 8964 - protein, 356 aa, Brassica napus
RTTLVSSSSVSLLPNSKPFFSVKAFSGFRSSSFSGGIIRRIDHKPLRVMTPNMTPRAMAAQQLENADQLIDSVETFIFDCDGVIWKGDKLIEGVPETLDMLRAKGKRLVFVTNNSTKSRKQYGKKFETLGLNVNEEEIFASSFAAAAYLQSINFPKDKKVYVIGEEGILKELDLAGFQYLGGPDDGKKQIELKPGFLMEHDNDVGAVVVGFDRYFNYYKIQYGTLCIRENPGCLFIATNRDAVTHLTDAQEWAGGGSMVGALVGSCQREPLVVGKPSTFMMDYLADKFGIEKSQICMVGDRLDTDILFGQNGGCKTLLVLSGVTSISMLESPENKIQPDFYTSKISDFLSLKAANV

SEQ ID NO: 8965 - protein, 257 aa, Brassica napus
MLRAKGKRWVFVTNNSTKSRKQYGKKFETLGLNVNEEENICFFFCCSCILAVYNFPKDKKVYVIGEEGILKELDLAGFQYLGGPDDGKKQIELKPGFLMEHDNDVGAVVVGFDRYFNYYKIQYGTLCIRENPGCLFIATNRDAVTHLTDAQEWAGGGSMVGALVGSCQREPLVVGKPSTFMMDYLADKFGIEKSQICMVGDRLDTDILFGQNGGCKTLLVLSGVTSISMLESPENKIQPDFYTSKISDFLSLKAANV

SEQ ID NO: 8966 - protein, 367 aa, Raphanus sativus
DIPKETETEEEKMMLNRTLVSSSSLSLLPNSKPFVSSGFRSSSFSGGFIRRIDHKPIRVMTPNLTPRAMAAQQLENADQLIDSVETFIFDCDGVIWKGDKLIEGVPETLDMLRAKGKRLVFVTNNSTKSRKQYGKKFETLGLNVNEEEIFASSFAAAAYLQSINFPKDKKVYVIGEEGILKELDLAGFQYLGGPDDGKKQIELKPGFLMEHDNDVGAVVVGFDRYFNYYKIQYGTLCIRENPGCLFIATNRDAVTHLTDAQEWAGGGSMVGALVGSCQREPLVVGKPSTFMMDYLSDKFGIEKSQICMVGDRLDTDILFGQNGGCKTLLVLSGVTSISMLESPENKIQPDFYTSKISDFLSLKAANV

SEQ ID NO: 8967 - protein, 375 aa, Brassica oleracea
IFQKKRKQKKGRREEKMLNRTTLVSSSSVSLLPNSKPFFSVKAFSGFRSSSFSGGIIRRIDHKPLRVMTPNMTPRAMAAQQLENADQLIDSVETFIFDCDGVIWKGDKLIEGVPETLDMLRAKGKRLVFVTNNSTKSRKQYGKKFETLGLNVNEEEIFASSFAAAAYLQSINFPKDKKVYVIGEEGILKELDLAGFQYLGGPDDGKKQIELKPGFLMEHDNDVGAVVVGFDRYFNYYKIQYGTLCIRENPGCLFIATNRDAVTHLTDAQEWAGGGSMVGALVGSCQREPLVVGKPSTFMMDYLADKFGIEKSQICMVGDRLDTDILFGQNGGCKTLLVLSGVTSISMLESPENKIQPDFYTSKISDFLSLKAANV

SEQ ID NO: 8968 - protein, 375 aa, Brassica rapa
IPKETETEKKGRREEKMLNRTTLVSSSSVSLLPNSKPFFSVKAFSGFRSSSFSGGFIRRIDHKPLRVMTPNLTPRAMAAQQLENADQLIDSVETFIFDCDGVIWKGDKLIEGVPETLDMLRAKGKRLVFVTNNSTKSRKQYGKKFETLGLNVNEEEIFASSFAAAAYLQSINFPKDKKVYVIGEEGILKELDLAGFQYLGGPDDGKKQIELKPGFLMEHDNDVGAVVVGFDRYFNYYKIQYGTLCIRENPGCLFIATNRDAVTHLTDAQEWAGGGSMVGALVGSCQREPLVVGKPSTFMMDYLADKFGIEKSQICMVGDRLDTDILFGQNGGCKTLLVLSGVTSISMLESPENKIQPDFYTSKISDFLSLKAANV

SEQ ID NO: 8969 - protein, 167 aa, Brassica napus
FSGFRSSSFSGGFIRRIDHKPLRVMTPNLTPRAMAAQQLENADQLIDSVETFIFDCDGVIWKGDKLIEGVPETLDMLRAKGKRLVFVTNNSTKSRKQYGKKFETLGLNVNEEEIFASSFAAAAYLQSINFPKDKKVYVIGEEGILKELDLAGFQYLGGPDDGKNKLN

SEQ ID NO: 8970 - protein, 370 aa, Cleome spinosa
MLGRAVVASAVSPVSSSSSSSAFCLSPKLNFSAVWSLSGVQSSPFLGSSLLRCKSDRKPLRMTSSSVAVRAAAQPLENADELIDSVETFIFDCDGVIWKGDKLIEGVPETLDMLRAKGKRLVFVTNNSTKSRKQYGKKFETLGLTVSEEEIFASSFAAAAYLQSINFPKDKKVYVVGEDGILKELELAGIQYIGGPEDGKKQIELKPGFLMEHDKDVGAVVVGFDRYFNYYKIQYATLCIRENPGCLFIATNRDAVTHLTDAQEWAGGGSMNGAIAGSTQREPLVAGKPSTFMMDYLADKFGIQKSQICMVGDRLDTDILFGQNGGCKTLLVLSGVTTLSKLQSPENKIQPDFYTSKISDFLSPKPAAAV

SEQ ID NO: 8971 - protein, 361 aa, Aristolochia fimbriata
MLGRVCHSLLPVSSPPLFLPSIPSCRFLGQSNVSGLRNSLFSRASRSWNCRMAGSNASFSVRASAQQLKNADELIDSVETFIFDCDGVIWKGDSLIDGVPETLDMLRAKGKRLVFVTNNSTKSRKQYGKKFETLGLSVNEEEIFASSFAAAAYLQSIDFPKDKKVYVIGEDGILKELELAGFQYLGGPADGDKKIELKPGFLMEHDENVGAVVVGFDRYFNYYKIQYGTLCIRENPGCLFIATNRDAVTHLTDAQEWAGGGSMVGAIRGSTQREPLVVGKPSTFMMDYLAKKFGILKSQICMVGDRLDTDILFGQNGGCKTLLVLSGVTSLSMLQSPDNAIQPDFYTSKIADFLSLKTTTV

SEQ ID NO: 8972 - protein, 372 aa, Cleome gynandra
MLSRAGAFAVSTVSSSSSSSAFYLSAKPRFFLGGSRYCVHSSLFLGSTVLRYKSHPKPLRMTSSSFELRAVAAAARPLENADELIDSVETFLFDCDGVIWKGDKLIEGVPETLDMLRSKGKRLVFVTNNSTKSRKQYGKKFETLGLTVSEEEIFASSFAAAAYLQSINFPKDKKVYVVGEDGILKELELAGIQYLGGPEDGKKQIELKPGFFMEHDKDVGAVVVGFDRYFNYYKTQYATLCIRENPGCLFIATNRDAVTHLTDAQEWAGGGSMNGAIAGSTQREPLVVGKPSTFMMDYVANKFGIQKSQICMVGDRLDTDILFGQNGGCKTLLVLSGVTSLSKLQSPDNTIQPDFYTDKISDFLSSKAAAAV

SEQ ID NO: 8973 - protein, 354 aa, Arabidopsis lyrata
MCSSKLKNLTQENISQINGRPVLQPKSNQVPTLDRRNSLKKSPPKPLNPIASSKIPSPRLISLNSPPLSPNSKSLRQPPGSCKELLRSSSVKSKPVKSPENSDGGYKEVMSMVIVQKQPGSIAAARREEVAMKQEERKKKISHYGRIKSVKSNEKNLNVEHEKKKRCSFITISSDPIYVAYHDKEWGVPVHDDKLLFELLVLTGAQVGSDWTSVLKRRNTFREAFSGFEAELVADFNEKKIQSIVNDYGINLSQVLAIVDNSKQILKVKRDFGSFNKYIWGFLKHKPVTTKYTSCQKIPVKTSKSETISKDMVRRGFRFVGPTVIHSLMQAAGLTNDHLITCPRHLECTAMAAL

SEQ ID NO: 8974 - protein, 349 aa, Eutrema parvulum
MCSSKSKNMNQEAISQINGRPVLQPKSNQVPTLDRRNSLKKSSPKPLIHPITSKIPSPRSISLNSPPLSPKSKSLRKPAGSDKPKPVTKPVKLSESTDGGCKEVLSTVTVQKQPGSIAAARREEVAIKQEERKKKISHYGRIKSVKSNEKNLNVEHEKKKRCSFITTSSDPIYVAYHDEEWGVPVHDDNLLFELLVLTGAQVGSDWTSVLKRRNTYREAFSGFEAELVAEFNEKKIQSIINDYGIGLSQVLAIVDNSKQILKVKRDFGSFNKYIWGFMKHKPVTTKYTSCQKIPVKTSKSETISKDMVRRGFRFVGPTVIHSLMQAAGLTNDHLITCPRHLECTAMAGL

SEQ ID NO: 8975 - protein, 348 aa, Eutrema halophilum
MCSSKSKNMNQEAISQINGRPVLQPKSNQVPTLDRRNSLKKSPPKPSIHPIPSKIPSPRPTFLNSPPLSPKSKSLRNPAGSEKPKPVKLSESTDGGCREVMSMVIAQKQPGSIAAARREEVAMKQEERKKKISHYGRIKSVKSVKSNEKNLTVEHEKKKRCSFITTSSDPIYVAYHDTEWGVPVHDDKLLFELLVLTGAQVGSDWTSVLKRRNTFREAFSGFEAELVAEFNEKKIHSIVNDYGIGLSQVLAIVDNSKQILKVKRDFGSFNKYIWGFLKHKPVTTKYTSCQKIPVKTSKSETISKDMVRRGFRFVGPTVIHSLMQAAGLTNDHLITCPRHLECTAMAAL

SEQ ID NO: 8976 - protein, 349 aa, Brassica napus
MCSSKSKNMNQEAISQINGRPVLQPKSNQVPTLDRRNSLKKSPPKSLIHPIASKIASPRPISLNSPPLSPNSKPIRKLAYYEKPKPAAKPVKLSERTDGGCREVKSTVTVQKQPGSIAAARREEVAMKQEERKKKISHYGRVKSVLSNEKSLNVEHEKKKRCSFITTSSDPIYVAYHDEEWGVPVHDDNLLFELLVLTGAQVGSDWTSVLKRRNTFREAFSGFEAELVAEFNEKKIQSIVNDYGIGLSQVLAVVDNSKQILKVKRDFGSFNKYIWGFMKHKPVTTKYTSCQKIPVKTSKSETISKDMVRRGFRFVGPTVIHSLMQAAGLTNDHLITCPRHLECMAKAAL

SEQ ID NO: 8977 - protein, 349 aa, Raphanus sativus
  misc_feature (232)..(232): Xaa can be any naturally occurring amino acid
MCSSKSKNMNQEAISQINGRPVLQPKSNQVPTLDRRNSLKKSPPKPLIHPIASKLASPRQISLNSPPLSPNLKPIRKLAGHEKPKQAAKPVKLPESTDGGCREVKSLMTVQKQPGSIAAARRQEVAMKQDERKKKISHYGRVKSVKSNENNLNVEHEKKKRCSFITTSSDPIYVAYHDEEWGVPVHDDNLLFELLVLTGAQVGSDWTSVLKRRNTFREAFSGFEAELVAEFXEKKIQSIVNDYGIGLSQVLAIVDNSKQILKVKRDFGSFNKYIWEFMKHKPVTTEYTSCQKIPVKTSKSETISKDMVRRGFRFVGPTVIHSLMQAAGLTNDHLITCPRHLECKAKAGL

SEQ ID NO: 8978 - protein, 344 aa, Brassica napus
MNQEAISQINGRPVLQPKSNQVPTVDRRNSLKKFPPKSLIHPIASKIASPRPKSLNSPPLSPNSKPIRKLACYEKPKPAAKPVTLSERTDGGCREVKSTVTVQKQPGSIAAARREEVAMKQEERKKKISHYGRVKSVQSNEKNLNVENEKKKKKKRCSFITTSSDPIYVAYHDEEWGVPVHNDNLLFELLVLTEAQVGSDWTSVLKRRNTFREAFSGFEPELVAEFNEKKIQSIVNDYGIGLSQVLAIVDNSKQILKVKRDFGSFNKYIWGFMKHKPVTTKYTSCQKIPVKTSKSETISKDMVRRGFRFVGPTVIHSLMQAAGLTNDHLITCPRHLECMAKAAL

SEQ ID NO: 8979 - protein, 343 aa, Arabidopsis lyrata
MMEVEGSMNRAPDQSSFLRSRRSKALYQFKQQKLPACKPVLTPISVITVFMLMGFVFIPIGLITLRASRDAIEIIDRYDVECIPEEYRTNKLSYITDSSIPKNCTRYLKVQKYMKAPIFIYYQLDNYYQNHRRYVKSRSDQQLLHGLEYSHTSSCEPEESSNGLPIVPCGLIAWSMFNDTFTFSRERTKLKVSRNNIAWKSDREQKFGKNVYPVNFQNGTLIGGAKLDPKIPLSDQEDFIVWMRAAALLSFRKLYGRIEEDLEPGSVVEVNLMNNYNTYSFSGQKKLILSTSNWLGGRNDFLGITYLVVGSSSIVISIIFMLLHLKNPRPYGDNSWNKKSLAS

SEQ ID NO: 8980 - protein, 345 aa, Eutrema parvulum
MEVEGSSSPMNRAPDQSSFLRSRRSKALYQFKQQKLPACKPVLTPTSVITVFMLMGFVFIPIGLVTLRASRDAIEIIDRYDVECIPEEYKSNKLSYISDSLIPKNCTRYLKVQKHMKAPIFIYYQLDNYYQNHRRYVKSRSDQQLLHGREYSHTSACEPEESSNGLPIVPCGLIAWSMFNDTFTFAREKSKLKVSRNNIAWKSDRERKFGKNVYPFNFQNGTLIGGANLDPKIPLSDQEDFIVWMRAAALLSFRKLYGRIEEDLEPGNVVVVNLMNNYNTYSFSGQKKLILSTSSWLGGRNDFLGITYLVVGSSSIIISIIFMLLHLKNPRPYGDNSWNKKSLSG

SEQ ID NO: 8981 - protein, 345 aa, Eutrema halophilum
MEVEGSSTSMNRAPDQSSFLRSRRSKALYQFKQQKLPACKPVLTPTSVITVFLLMGFVFIPIGFLTLRASRDAIEIMDRYDVECIPEEYKSNKLSYITDASIPKNCTRYLKVQKYMKAPIYIYYQLDNYYQNHRRYVKSRSDQQLLHGLEYRHTSACEPEESSNGLPIVPCGLIAWSMFNDTFTFARESTKLKVSRKNIAWKSDREHKFGKNVYPYNFQNGTLIGGAKLDSKIPLSDQEDFIVWMRAAALLSFRKLYGRIEEDLEPRNVVVVNVMNNYNTYSFSGQKKLILSTSSWLGGRNDFLGITYLVVGSSSIIISIIFMLLHLKNPRPYGDNSWNKKSLSG

SEQ ID NO: 8982 - protein, 341 aa, Brassica napus
MEVEGSNTWMNRSPQSSFVRSKALYQFKQQKLPACKPVLTPTSVITVFMLMGFVFIPIGFVTLRASRDAIEIVDRYDVECIPEEYRTNKLSYITDSSILKNCTRYLKVQKFMKAPIFIYYQLDNYYQNHRRYVKSRSDQQLLHGQEYSHTSACEPEESSNGLPIVPCGLIAWSMFNDTFTFTRESAKLKVSRSNIAWKSDREHKFGKDVYPFNFQNGSLIGGAKLDPKVPLSDQEDFIVWMRAAALLSFRKLYGRIEEDLEPGNVVVVNLMNNYNTYSFSGQKKLILSTSSWLGGRNDFLGLTYLVVGASSIVISIIFMLLHLKNPRPYGDNSWNKKSLSS

SEQ ID NO: 8983 - protein, 342 aa, Brassica rapa
  misc_feature (4)..(4): Xaa can be any naturally occurring amino acid
  misc_feature (139)..(139): Xaa can be any naturally occurring amino acid
MMEXEGSNTSMNRSPQSSFVRSKALYQFKQQKLPACKPVLTPTSVITVFMLMGFVFIPIGFVTLRASRDAIEIVDRYDVECIPEEYRTNKLSYITDSSILKNCTRYLKVQKFMKAPIFIYYQLDNYYQNHRRYVKSRSXQQLLHGQEYSHTSACEPEESSNGLPIVPCGLIAWSMFNDTFTFARESAKLKVSRSNIAWKSDREHKFGKDVYPFNFQNGSLIGGAKLDPKVPLSDQEDFIVWMRAAALLSFRKLYGRIEEDLEPGNVVVLNLMNNYNTYSFSGQKKLILSTSSWLGGRNDFLGITYLVVGASSIIISIIFMLLHLKNPRPYGDNSWNKKSLSS

SEQ ID NO: 8984 - protein, 347 aa, Raphanus sativus
MMEVDGSNTSMNRAPPPPPPQSSFLRSSRSKVLYQFKQQKLPACKPVLTPTSVITVFMLMGFVFIPIGFVTLRASRHAIEIVDRYDVECIPEEYRTNKLSYITDSSISKNCTRYLKVQKHMKAPIFIYYQLDNYYQNHRRYVKSRSDQQLLHGREYSHTSACEPEESSNDGLPIVPCGLIAWSMFNDTFTFAQLKVSRNNIAWKSDREHKFGKDVYPFNFQNGSLVGGAKLDPKVPLSDQEDFIVWMRAAALLSFRKLYGRIEEDLEPGSVVVVNLFNNYNTYSFSGQKKLILSTSSWLGGRNDFLGITYIVVGASSIVISIIFILLHLKNPRPYGDNSWNKKSLSS

SEQ ID NO: 8985 - protein, 694 aa, Arabidopsis lyrata
MGLSTNLHSLDLRSTFFTGLRPCPSPIPSNFIKISSISNPRRGISTIRAQVSTISLETSVKERQDEIESLFSKPTSEQDSDRRRNGKNSKNGASGISSGVKLENIRKSYKGVTVLKDVTWEVKRGEKVGLVGVNGAGKTTQLRIITGQEEPDSGNVIKAKPNMKIAFLSQEFEVSMSKTVREEFMSAFKEEMEITEKLEKVQKAIEGSVDDLDLMGRLLDEFDLLQRRAQAVNLDSVDAKISKLMPELGFASEDADRLVASFSGGWQMRMSLGKILLQDPDLLLLDEPTNHLDLDTIEWLEGYLQKQDVPMVIISHDRAFLDQLCTKIVETEMGVSRTFEGNYSQYVISKAEWIETQNAAWEKQQKEIDSTKDLIARLGAGANSGRASTAEKKLEKLQEQELIEKPFQRKQMKIRFPERGTSGRSVVNVKNIDFGFEDKMLFKKANLAIERGEKIAIIGPNGCGKSTLLKLIMGLEKPMKGEVILGEHNVLPNYFEQNQAEVLDLDKTVLETVCEAAEDWRSDDIKGLLGRCNFKADMLDRKVSLLSGGEKARLAFCKFMVTPSTLLVLDEPTNHLDIPSKEMLEEAINEYQGTVIAVSHDRYFIKQIVNRVIEVEDGCLEDYAGDYNYYLEKNLDARAKELEREAELEEKAPKVKAKSKMSKAEKEARKKQKMQAFQQAKQKSKASKNSKRWN

SEQ ID NO: 8986 - protein, 694 aa, Eutrema halophilum
MGLSTNLHSLDLRSTFFTGLRPCPSPVTSNFIKISSISNPRREIPTIRAQVSTISLETSVKERQDDIESLFSKQTTEQDSDRKRNGKNSKNGASGISSGVKLENIRKSYKGVTVLKDVSWEVKRGEKVGLVGVNGAGKTTQLRIITGQEEPDSGNVIKAKPNMKIAFLSQEFEVSMSRTVKEEFMSAFKEEMEITEKLEKVQKAIEGSVDDLDLMGRLLDEFDLLQRRAQAVNLDTVDAKVSKLMPELGFAPEDADRLVASFSGGWQMRMSLGKILLQDPDLLLLDEPTNHLDLDTIEWLEGYLQKQEVPMVIISHDRAFLDQLCTKIVETEMGVSRTFEGNYSQYVISKAEWIETQHAAWEKQQKEIESTRGLIARLGAGANSGRASTAEKKLERIQEQEQIEKPFQRKQMKIRFPERGTSGRSVVAVKNIDFGFEDKMLFKKANLAIERGEKIAIIGPNGCGKSTLLKLIMGLEKPTKGEVILGEHNVLPNYFEQNQAEVLDLDKTVLETVCEAAEDWRSDDIKGLLGRCNFKADMLDRKVSLLSGGEKARLAFCKFMVTPSTLLVLDEPTNHLDIPSKEMLEEAINEYQGTVIAVSHDRYFIKQIVNRVIEVEDGCLEDYAGDYNYYLEKNLDARAKELEREAELEEKAPKVKAKSKMSKAEKEARKKQKMQAFQQAKQKSKASKNSKRWN

SEQ ID NO: 8987 - protein, 694 aa, Eutrema parvulum
MGFSTNLHSLDLRSTFFTGLRPCPSPVTSNFIKISSISSPRREIPTIRAQVSTISLETSVKERQDDIESLFSKQTTQQDSDRKRNGKNSKNGASGISSGVKLENIMKSYKGVTVLKDVSWEVKRGEKVGLVGVNGAGKTTQLRIITGQEEPDSGNVIKAKSDMKIAFLSQEFEVSMSRTVKEEFLSAFKEEMEITEKLEKVQKAIEGSVDDLDLMGRLLDEFDLLQRRAQAVNLDTVDAKVSKLMPELGFAPEDADRLVASFSGGWQMRMSLGKILLQDPDLLLLDEPTNHLDLDTIEWLEGYLQKQEVPMVIISHDRAFLDQLCTKIVETEMGVSRTFEGNYSQYVISKAEWIEAQNAAWEKQQKEIESTKDLIARLGAGANSGRASTAEKKLEKLQEQELIEKPFQRKQMKIRFPERGTSGRSVVAVKNIDFGFEDKMLFKKANLAIERGEKIAIIGPNGCGKSTLLKLIMGLEKPTKGEVILGEHNVLPNYFEQNQAEVLDLDKTVLETVCEAAEDWRSDDIKGLLGKCNFKADMLDRKVSLLSGGEKARLAFCKFMVTPSTLLVLDEPTNHLDIPSKEMLEEAINEYQGTVIAVSHDRYFIKQIVNRVIEVEDGCLEDYAGGYNYYLEKNLEARAKELEREAELEEKAPKVKAKSKMSKAEKEARKKQKMQAFQQAKQKSKASKNSKRWN

SEQ ID NO: 8988 - protein, 582 aa, Brassica napus
MGLSTNLHTINLRSTLFPGGLRPSPIASNFIKVSSFPIPKHHTTATIRSSQLSTITPETSLKEDIESLFSSPTSQQHSDRKRNSSSSSSGVSSGVKLENISKTYKGLTVLKDVSWEVKRGEKVGLVGVNGAGKTTQLRIITGQEEPDSGHVIKARPNMKVAFLSQEFEVSMSRTVKEEFMSAFKEEMEVADKLERVQKAIEGSVDDLELMGRLLDEFDLLQRRAQAVSLDSVDAKISKLMPELGFAAEDADRLVASFSGGWQMRMSLGKILLQDPDLLLLDEPTNHLDLDTIEWLEGYLQKQEVPMVIISHDRAFLDQLCTKIVETEMGVSRTFEGNYSQYVISKAEWIETQNAAWEKQQKEIESTKDLIARLGAGANSGRASTAEKKLEKLQEQELIEKPFQRKQMKIRFPERGTSGRSVVTVKNVDFGFEDKMLFKKANLAIERGEKIAIIGPNGCGKSTLLKLIMGLEKPTKGEVILGEHNVLPNYFEQNQAEVLDLDKTVLETVCEAAEDWRSDDVKGLLGRCNFKADMLDRKVSLLSGGEKARLAFCKFMVTPSNVLVLDEPTNHLAFLLRRCSRKR

SEQ ID NO: 8989 - protein, 687 aa, Brassica rapa
MGLSTNLHTINLRSTLFPGGLRPSPNFIKVSSFPTPRRETSATIRSSQLSTIAPVKEQQNDVESLFSTPTSQQDSDRKRNNGKNSSSGVSSGVKLENISKTYKGLTVLKDVSWEVKRGEKVGLVGVNGAGKTTQLRIITGQEEPDSGHVIKARPNMKVAFLSQEFEVSMSRTVKEEFMSAFKEEMEVADKLERVQKAIEGSVDDLELMGRLLDEFDLLQRRAQAVSLDSVDAKISRLMPELGFAAEDADRLVASFSGGWQMRMSLGKILLQDPDLLLLDEPTNHLDLDTIEWLEGYLQKQEVPMVIISHDRAFLDQLCTKIVETEMGVSRTFEGNYSQYVISKAEWIETQNAAWEKQQKEIESTKDLIARLGAGANSGRASTAEKKLEKLQEQELIEKPFQRKQMKIRFPERGTSGRSVVTVKNVDFGFEDKMLFKKANLAIERGEKIAIIGPNGCGKSTLLKLIMGLEKPTKGEVILGEHNVLPNYFEQNQAEVLDLDKTVLETVCEAAEDWRSDDVKGLLGRCNFKADMLDRKVSLLSGGEKARLAFCKFMVTPSNVLVLDEPTNHLDIPSKEMLEEAINEYQGTVIAVSHDRYFIKQIVNRVIEVEDGCLEDYAGDYNYYLEKNLEARAKAVEREAELEEKAPKVKAKSKMSKAEKEARKKQKMQAFQQAKQKSKASKNSKRWN

SEQ ID NO: 8990 - protein, 693 aa, Cleome gynandra
MGLTTNLHRLDLRSTFFTGLRPCPTPVTSNLLKISSVSYPRREIPSIRAQVSTVSIESSVKQEEDDVESLFSTEPTEDFDRKRNNKQSNNGASGISSGVKLENISKSYKGVTVLKDVSWEVKKGEKVGLVGVNGAGKTTQLRIITGQEEPDSGNVIKAKSNMKIAFLSQEFEVSMSKTVKEEFMSAFKEQMEIAEKLEKVQKAIERSVDNLELMGRLLDEFDLLQRRAQAVDLDTVDAKISKLMPELGFAPEDADRLVASFSGGWQMRMSLGKILLQDPDLLLLDEPTNHLDLDTIEWLEGYLNKQDVPMVIISHDRAFLDQLCTKIVETEMGVSRTFEGNYSQYVISKAEWIEAQYAAWEKQQKEIEATKDLISRLGAGANSGRASTAEKKLERLQEEEQIEKPFQRKQMKIRFPERGRSGRMVVNIKKLEFGFEDKMLFNKADLTIERGEKIAILGPNGCGKSTLLKLIMALEKPMGGEVILGEHNVLPNYFEQNQAEALELDKTVLETVEEAAEDWRSDDIKGLLGRCNFKADMLDRKVSLLSGGEKARLAFCKFMVKPSTLLVLDEPTNHLDIPSKEMLEEAINEYEGTVITVSHDRYFIKQIVNRVIEVRDRGLQDYAGDYNYYLEKNLEAREKEVEREAELEEKAPKVKAKSKMSKAEKEARKKQKMQAFQAAKQKSKASKNAKRWK

SEQ ID NO: 8991 - protein, 693 aa, Cleome spinosa
MGLTTNLHRLDLRSTFFTGLRPCPSPIHSNSMKISSVSNPRRGISCIRAQVSTISVESSVKQEEYDVESLFSTGTTDDFDRNRNNRQSNSGASGVSSGVKLENISKSYKGVTVLKDVSWEVKKGEKVGLVGVNGAGKTTQLRIITGQEEPDSGNVIKAKPNIKIAFLSQEFEVSMSKTVKEEFMSAFKEQMEIAEKLEKVQKAIEKSVDDLELMGRLLDEFDLLQRRAQAVDLDAVDAKISKLMPELGFAPEDADRLVASFSGGWQMRMSLGKILLQEPDLLLLDEPTNHLDLGTIEWLEDYLNKQDVPMVIISHDRAFLDQLCTKIVETEMGVSRTFEGNYSQYVISKAEWVEAQNTAWEKQQKEIEATKDLISRLGAGANSGRASTAEKKLERLQEEEQIEKPFQRKQMKIRFPERGRSGRMVVNMKNLEFGFEDKMLFKKANLSIERGEKIAILGPNGCGKSTLLKLIMGSEKPVGGEVILGEHNVLPNYFEQNQAEALELDKTVLETVVEAAEDWRIDDIKGLLGRCNFKADMLDRKVSLLSGGEKARLAFCKFMVKPSTLLVLDEPTNHLDIPSKEMLEEAINEYEGTVIAVSHDRYFIKQIVNRVIEVRDGGLQDYAGDYNYYLEKNMEARAMELEREAELEEKAPKVKAKSKMSKAEKEARKKQKMQAFQAAKQKSKSLKNSKRWK

SEQ ID NO: 8992 - protein, 624 aa, Raphanus sativus
  misc_feature (249)..(249): Xaa can be any naturally occurring amino acid
  misc_feature (572)..(572): Xaa can be any naturally occurring amino acid
LFSTPTTQQDSNPKRKNSKNNSSSGVSSGVKLENIRKSYKGVTVLKDVSWEVKRGEKVGLAGVNGAGKTTQLRIITGQEEPDSGDVIKAKPNMKVAFLSQEFEVSMSRTVKEEFMSAFGEEMEITERLERVQKAIEGSVDDLELMGRLLDEFDLLQRRAQAVSLDSVDAKISKLMPELGFAPEDADRLVASFSGGWQMRMSLGKILLQDPDLLLLDEPTNHLDLDTIEWLEGYLQKQEVPMVIISHDRXFLDQLCTKIVETEMGVSRTFEGNYSQYVISKAEWIETQNAAWEKQQKEIESTKDLIARLGAGANSGRASTAEKKLEKLQEQELIEKPFQRKQMKIRFPERGTSGRSVVTVKNVDFGFEDKMLFKKANLAIERGEKIAIIGPNGCGKSTLLKLIMGLEKPTKGEVILGEHNVLPNYFEQNQAEVLDLDKTVLETVCEAAEDWRSDDIKGLLGRCNFKADMLDRKVSLLSGGEKARLAFCKFMVTPSNVLVLDEPTNHLDIPSKEMLEEAINEYQGTVIAVSHDRYFIKQIVNRVIEVEDGCLEDYAGDYNYYLEKNLEARAKAXEREAELEEKAPKVKAKSKMSKAEKEARKKQKMQAFQQAKQKSKASKNSKRWN

SEQ ID NO: 8993 - protein, 683 aa, Eutrema parvulum
MGLTTNLHSLNLRSTFFTNPLPCPTPFTLKLSSVSNSRQEISNSRAQVPSIGSNSSASELESLFSSEDHDRKWIVKQSNDGASAISSGVRLENISKSYEGMTVLKDVNWEVKKCEKVGLIGVNGAGKTTQLRIITGQEEPDSGNVVRAKPNLKVAFLSQEFEVSMSKTVKEEFMSVFTEEMEIARKLEKLQKAIEGTVDDLDLMGRLLDEFDSLQRRAQELDLDSVDAKISKLMPELGFASKDGDRLVASFSSGWQMRMSLGKILLQNPDLLLLDEPTNHLDLDTIEWLESYLNKKDVPMVIISHDRAFLDQLCSKIVETEMGVSRTFEGNYSQYVISKAEWVEAQYAAWEKQQKEIEATKNLISRLSAGANSGRASSAEKKLEKLQQEEQIEKPFQRKQMKITFPECGVSGRSVITVKNLEFGFGDKMLFNKANLAIERGEKIAIIGPNGCGKSTLLKLIMGLEKPMRGEVILGEHNILPNYFEQNQAEALDLDKTVIETVVEAAVDWRIDDIKGLLGRCNFKADMLDRKVSLLSGGEKARLAFCKFMVKPSTLLVLDEPTNHLDIPSKEMLEEAINEYKGTVIAVSHDRYFIKQIVNRVIEVRDGCLKDYAGDYNYYLERNMEARAKELEREAELEEKAPKVKAKSKMSKAEKEARKKQKMRAFQASKQKSKSSKNAKRWN

SEQ ID NO: 8994 - protein, 690 aa, Theobroma cacao
MGLSTKLHRIDLRSTFFTSLRPSFTPNSSSLISPKTLKFRPTKITAQVSTLSVETSVKDPQNDIESLFSTNTVEEVDRKRANKRSNTGSSGISSGVKLENISKSYKGVTVLKNVSWEVKKGEKVGLVGVNGAGKTTQMRIITGLEEPDSGNVIKAKPNMKVAFLNQEFEVSMSRTVREEFMSAFKEEMEIADRLERVQKAIEGATEDLELMGRLLDEFDLLQRRAQAVDLDEVDAKVSKLMPELGFSPEDSDRLVASFSSGWQMRMSLGKILLQEPDLLLLDEPTNHLDLDTIEWLEGYLDKQEVPMVIISHDRAFLDQLCTKIVETDMGVSRTFEGNYSQYVEAKAAWVENQCAAWEKQQKEIEQTKDLINRLGAGANSGRASSAEKKLERLQEEGQLEKPFQRKQMKIRFPERGRSGRSVITVKNLEFGYEDDLLFNRANLTIERGEKIAIIGPNGCGKSTLLKLIMGLEKPRGGEVVLGEHNVLPNYFEQNQAEALDLDKTVLQTVEEVAEDWRIDDIKGLLGRCNFKADMLERKVSLLSGGEKARLAFCKFMVKPSTLLVLDEPTNHLDIPSKEMLEEAIREYSGTVITVSHDRYFIRQIVNRVVEVKDGHLQDYMGDYNYYLEKNLEARAKELEREADLEEKAPKVKAKSKMSKAEKEARKKQKMQAFQAAKQKSKGLKNSKRWK

SEQ ID NO: 8995 - protein, 599 aa, Brassica napus
VSSGVKLENISKTYKGLTVLKDVSWEVKRGEKVGLVGVNGAGKTTQLRIITGQEEPDSGHVIKARPNMKVAFLSQEFEVSMSRTVKEEFMSAFKEEMEVADKLERVQKAIEGSVDDLELMGRLLDEFDLLQRRAQAVSLDSVDAKISRLMPELGFAAEDADRLVASFSGGWQMRMSLGKILLQDPDLLLLDEPTNHLDLDTIEWLEGYLQKQEVPMVIISHDRAFLDQLCTKIVETEMGVSRTFEGNYSQYVISKAEWIETQNAAWEKQQKEIESTKDLIARLGAGANSGRASTAEKKLEKLQEQELIEKPFQRKQMKIRFPERGTSGRSVVTVKNVDFGFEDKMLFKKANLAIERGEKIAIIGPNGCGKSTLLKLIMGLEKPTKGEVILGEHNVLPNYFEQNQAEVLDLDKTVLETVCEAAEDWRSDDVKGLLGRCNFKADMLDRKVSLLSGGEKARLAFCKFMVTPSNVLVLDEPTNHLDIPSKEMLEEAINEYQGTVIAVSHDRYFIKQIVNRVIEVEDGCLEDYAGDYNYYLEKNLEARAKAVEREAELEEKAPKVKAKSKMSKAEKEARKKQKMQAFQQAKQKSKASKNSKRWN

SEQ ID NO: 8996 - protein, 690 aa, Gossypium hirsutum
MDLSTKFHRLDLRSTFFTSMRPSLTRNSSSFVSPQTLKFRPTKVNAQVSTLSVETSVKEPQNDIESLFSTNTVEEIDRKRGDKQSNTGASGISSGVKLENISKSYKGVTVLKNVNWEVKKGEKVGLVGVNGAGKTTQMRIITGQEEPDSGNVIKAKPNMKVAFLNQEFQVSMSRTVREEFMSAFKEEMEISERLERVQKAIEGSTEDLELMGRLLDEFDLLQRRAQAVDLDEVDAKVSKLMPELGFSPEDSDRLVASFSSGWQMRMSLGKILLQEPDLLLLDEPTNHLDLDTIEWLEGYLKKQDVPMVIISHDRAFLDQLCTKIVETDMGVSRTFEGNYSQYVEAKAAWIETQYAAWEKQQKEIEQTRDLISRLGAGANSGRASSAEKKLERLQEEGQIEKPFQRKQMKIRFPERGRSGRSVVTIKNLEFGYEDELLFNRANLAIERGEKIAIIGPNGCGKSTLLRLIMRLEKPRGGEVILGEHNVLPNYFEQNQAEALDLDKTVLQTVEEVAEDWRIDDIKGLLGRCNFKADMLDRKVSLLSGGEKARLAFCKFMVKPSTLLILDEPTNHLDIPSKEMLEEAIREYSGTVITVSHDRYFIRQIVNRVVEVKDGHLQDYAGDYNYYLEKNLEARVKELEREADLEEKAPRLKAKSKMSKAEKEARKKQKMQAFQAAKQKSKGLKNSKRWK

SEQ ID NO: 8997 - protein, 684 aa, Eutrema halophilum
MSLTTNLHSLNLGSTFFTSPLPCPTPPFTLKLSSVSNLRREIPNIRAQVPSLSSNSSVNELESLFSSEDHNRKLNGKQSNNGASAISSGVRLENISKSYQGVTVLKDVNWEVKKGEKVGLIGVNGAGKTTQLRIITGQEEPDSGNVIRAKPNLKTAFLSQEFEVSMSKTVKEEFMSVLKEEMEIARKLDNLQEAIQGAVDDLELMGRLLDEFDSLQRRAQEADLDSVDAKISKLMSELGFVSEDADRLVASFSSGWQMRMSLGKILLQNPDLLLLDEPTNHLDLDTIEWLEGYLNKQEVPMVIISHDRAFLDQLCTKIVETEMGVSRTFEGNYSQYVISKAEWFEAQYTAWEKQQKEIEATKDLISRLSSGGNSGRASSAEKKLERLQEEEQIEKPFQRKQMKIRFPECGLSGRSVVTVKNLEFGFEDKKLFNKANLAIERGEKIVIIGPNGCGKSTLLKLIMGLEKPMRGEVILGEHNVLPNYFEQNQAEALDLDKTVIETVVEAAVDWRIDDIKGLLGRCNFKADMLDRKVSLLSGGEKARLAFCKFMVKPSTLLVLDEPTNHLDIPSKEMLEEAINEYKGTVIAVSHDRYFIKQIVNRVIEVRDGGLKDYAGDYNYYLEKNVEARERELQREAELEEKAPKAKAKSKMSKAEREARKKQKMRAFQASKKKSKSSKNAKRWN

SEQ ID NO: 8998 - protein, 678 aa, Arabidopsis thaliana
MVLTTNLYSLNLRSTFFFTNTITCPTLFTFKLSSVSNPRRVFPNIRAHVSAASSNSELESLLSTDRKLISKQSNNGASSISSGVRLENISKSYEGITVLKDVTWEVKKGEKVGLIGVNGAGKTTQLRIITGQEEPDSGNVIWAKPNLKVAFLSQEFEVSMGKTVKEEFMCTFKEEMEIARKLENLQKAIEEAVDDLELMGKLLDEFDLLQRRAQEVDLDSIHAKISKLMSELGFVSEDADRLVASFSSGWQMRMSLGKILLQNPDLLLLDEPTNHLDLDTIEWLEGYLIKQDVPMVIISHDRAFLDQLCTKIVETEMGVSRTFDGNYSQYVISKAELVEAQYAAWEKQQKEIEATKDLISRLSAGANSGRASSAEKKLEKLQEEELIEKPFQRKQMKIRFPECGLSGRSVVTVKNLVFGFDDKMLFNKANLAIERGEKVAIIGPNGCGKSTLLKLIMGLEKPMRGEVILGEHNVLPNYFEQNQAEAQDLDKTVIETVVEAAVDWRIDDIKALLGRCNFKADMLDRKVSLLSGGEKARLAFCKFMVKPSTLLVLDEPTNHLDIPSKEMLEEAINEYKGTVITVSHDRYFIKQIVNRVIEVRDGGLMDYAGDYNYFLEKNVEARARELEREAELEEKAPKVKAKSKMSKAEREARKKQKMKAFQASKKKSKSSKNAKRWN

SEQ ID NO: 8999 - protein, 678 aa, Arabidopsis lyrata
MGLTTNLHSLNLRSAFFFTNPLPCHTLFTFKLSSVSNPRREFPNIIAQASATSSNSELDSLFSTDRKLIGKQSNNGASSISSGVRLENISKSYEGVTVLKDVTWEVKKGEKVGLIGVNGAGKTTQLRIITGQEEPDSGNVIWAKPNLKVAFLSQEFEVSMGKTVKEEFMSAFKEEMEVARKLERLQKAIEEAVDDLELMGKLLDEFDLLQRRAQEVDLDSIDAKISKLMSELGFVSEDADRLVASFSSGWQMRMSLGKILLQNPDLLLLDEPTNHLDLDTIEWLEGYLNKQDVPMVIISHDRAFLDQLCTKIVETEMGVSRTFEGNYSQYVISKAEWVEAQYASWEKQQKEIEATKDLISRLSGGANSGRASSAEKKLEKLQEEEQIEKPFQRKQMKIRFLECGLSGRSVVTVKNLGFGFEDKILFNKANLAIERGEKVAIIGPNGCGKSTLLKLIMGLEKPMRGEVILGEHNVLPNYFEQNQAEALDLDKTVIETVVEAAVDWRIDDIKALLGRCNFKADMLDRRVSLLSGGEKARLAFCKFMVKPSTLLVLDEPTNHLDIPSKEMLEEAINEYKGTVITVSHDRYFIKQIVNRVIEVRDGGLMDYAGDYNYYLEKNVEARARELEKEAELEEKGPKVKAKSKMSKAEREARKKQKMKAFQASKKKSKSSKNAKRWN

SEQ ID NO: 9000 - protein, 700 aa, Populus trichocarpa
MDLSTKLHSTFFTGSTFFNPRQKSTLFKPNPSLLSTKYNTNPFKFPTRRSNYKTKARLSTATVETSGADSKTDIESLFSSNSDVEFDRKRSNKQSNGGASGISSGIKLENISKSYKGVTVLKDVTWEVKKGEKVGLVGVNGAGKTTQLRIITGQEEPDSGNVIKAKANMKIAFLSQEFEVSMSRTVKEEFMSAFKEEMEIAERLEKVQKAIEGAVEDLDLMGRLLDEFDLLQRRAQAVDLDEVDAKISKLMPELGFSPEDSDRLVASFSGGWQMRMSLGKILLQDPDLLLLDEPTNHLDLDTIEWLEGYLQKQDVPMVIISHDRAFLDQLCTKIVETDMGVSRTFEGNYSQYIISKAEWVEAQLAAWEKQQKEIEHTRELISRLGAGANSGRASSAEKKLERLQEEDQIEKPFQHKQMKIRFPERGRSGRSVVAINNLEFGFEDKVLFNKTNLMIERGEKIAIIGPNGCGKSTLLKLIMGLEKPTGGQIMVGEHNVLPNYFEQNQAEALDLDKTVIQTVEEVAEDWRLDDIKGLLGRCNFKADMLDRKVSLLSGGEKARLAFCKFMVKPSTLLVLDEPTNHLDIPSKEMLEEAISEYSGTVITVSHDRYFIKQIVNRVVEVKDDKLQDYAGDYNYYLEKNLDAREKELEREAELEDKAPKVKAKSKMSKAEKEARKKQKMKAFQAAKQKSKGSKNAKRWN

SEQ ID NO: 9001 - protein, 689 aa, Gossypium hirsutum
MVLCTKLHRLDLRSTFFTSLRPSFTPNPSSSVSPKTFKFRPTKITAQVSTLSVETSVKDPESDIESLFSSNTEEIDRKRSNKQSNTGASGISSGVKLENISKSYKGVTVLKDVSWEVKKGEKVGLVGVNGAGKTTQMRIITGQEEPDSGNVIKAKSNMKIAFLNQEFEVSMSRTVREEFMSAFKEEMDISDRLERVQKAIEGATEDLELMGRLLDEFDLLQRRAQAVDLDEVDAKVSKLMPELGFSPEDSDRLVASFSSGWQMRMSLGKILLQEPDLLLLDEPTNHLDLDTIEWLEGYLNKQDVPMVIISHDRAFLDQLCTKIVETDMGVSRTFEGNYSQFVEAKAAWVESQYAAWEKQQQEIEQTKDLINRLGAGANSGRASSAEKKLERLQEEGQIEKPFQRKQMKIRFPERGRSGRSVVTIKNLEFGYEDELLVNRANLSIERGEKIAIIGPNGCGKSTLLKLIMGLENPSGGEVLLGEHNVLPNYFEQNQAEALDLDKTVLQTVEEVAEDWRIDDIKGLLGRCNFKADMLDRKVSLLSGGEKARLAFCKFMVKPSTLLVLDEPTNHLDIPSKEMLEEAIREYSGTVITVSHDRFFIKQIVNRVVEVKDGHLQDYVGDYNYFLEKNLEAREKELEREAELDEKAPKVKAKSKMSKAEKEAQKKQKRQAFQAAKQKSKGQKNAKRWN

SEQ ID NO: 9002 - protein, 710 aa, Manihot esculenta
MDLSTKFHRLDLHSSFFTSSPLFGTRKSPLRLPRFKHSSKPIKNNPSSIKVVASSVSRRGTSKITAQLSTATVETSVAEPETDIESLFSSNSSDEFGRKGAHKQSNSGASGISSGIKLENISKSYKGVTVLKDVTWEVKKGEKVGLVGVNGAGKTTQLRIITGQEEPDSGNVIKAKPNMKIAFLSQEFEVSLSRTVKEEFMSAFEEEMEISGRLEKVQKAIEGSVDDLELMGRLLDEFDLLQRRAQAVDLDEVDAKISKLMPELGFAPEDSDRLVASFSSGWQMRMSLGKILLQDPDLLLLDEPTNHLDLDTIEWLEGYLQKQDVPMVIISHDRAFLDQLCTKIVETEMGVARTYEGNYSQFLLSKAAWIEAQHAAWEKQQKEIEHTKDLISRLGAGANSGRASSAEKKLERLQEEDQVEKPFQRKQMKIRFPERGRSGRNVVSIKNLEFSYEDKVLFNRTNLTIERGEKIAIIGPNGCGKSTLLKLIMGLEKPKAGDIILGEHNVLPNYFEQNQAEALDLDKTVIQTVEEVAEDWRIDDIKGLLGRCNFKADMLDRKVSLLSGGEKARLAFCKFMVKPSTLLVLDEPTNHLDIPSKEMLEEAITEYQGTVITVSHDRYFIKQIVNRVIEVKDGQLQDYAGDYNYYLEKNLDARARELEREAELEERAPKVKAKSKMSKAEKEARKKQKMQAFQAAKQKSKGLKNSKRWN

SEQ ID NO: 9003 - protein, 689 aa, Euphorbia peplus
MELSAKFHCLDLHSPFLTGSSSRPSIFKPSTNNPISLHFRKPTQKISARISTATVETSVADPDTDIESLFSSTDEFNKRGAKKQFTGASGITSGIKLENITKTYKGLTVLKNVTWEVKKGEKVGLVGVNGAGKTTQLRIITGQEVPDSGNVIKAKSNMKVSFLSQEFEVSLSRTVKEEFMSAFHEEMEIAGRLERVQKAIEGSVDDLELMGRLLDEFDLLQRRAQAVDLDMVDSKISKLMPELGFSPEDSDRLVASFSGGWQMRMSLGKILLQDPDLLLLDEPTNHLDLDTIEWLEGYLQKQDVPMVVISHDRAFLDQLCTKIVETEMGVARTYVGNYSQFILSKAAWIEAQNAAFEKQQKEIEHTKDLITRLGAGANSGRASSAEKKLEKLLEEDQIEKPFQRKQMKIRFPERGSSGRIVAEVKNLEFSYEDKVLFNKSNLTIERGEKIAIIGPNGCGKSTLLKLIMGLQKPSAGEIVLGEHNVLPNYFEQNQAEALDLDKTVLQTVEEVAEDWRVDDIKGLLGRCNFKADMLDRKVSLLSGGEKARLAFCKFMVKPSTLLVLDEPTNHLDIPSKEMLEEAISEYEGTVIAVSHDRYFIKQIVNRVIEVEDGQLRDYAGDYNYYLEKNLDARERALEREAELEEKAPKTKAKSKLSKAEKEARKKQKMKAFQAAKQKSKGTKNSKRWN

SEQ ID NO: 9004 - protein, 227 aa, Brassica napus
QTCSTQNVSTRFDSCMDLPVLDSYLHYTYDAANSSLSVAFVATPPRSGDWVAWAINPTGTRMLGSQAFLAYSPRAGARPMVDTYNISSYNLTPGRLTFDFWNLRAESMPGNRIVIYASVKVPMGANSVNQVWQIGGNVTNGRPGRHPMNPANMASTGVLRLTGSNAPSSAPGSAPGSVPGSAQGPTTPGASTTPGQAGGPGNAGSMSTSVISGLIWNLVMLATIFIF

SEQ ID NO: 9005 - protein, 263 aa, Brassica oleracea
  misc_feature (27)..(27): Xaa can be any naturally occurring amino acid
  misc_feature (234)..(235): Xaa can be any naturally occurring amino acid
LLLVLAVACFISPAISQTCSTQNVSTXFDSCMDLPVLDSYLHYTYDAANSSLSIAFVATPPRSGDWVAWAINPTGTRMLGSQAFLAYSPRAGARPMVDTYNINSYNLTPGRLTFDFWNLRAESMPGNRIVIYASVKVPMGANSVNQVWQTGGNVTNGRPGRHPMNPANMASTGVLRLTGSNAPSSAPGSAPGSAPGSVPGSAQGPTTPGASTTPGQAGGPGNAGSMSTSVNFVXXLEFWLCWLLFSSFEYDFIIFTLLFFFFA

SEQ ID NO: 9006 - protein, 380 aa, Brassica oleracea
MAMRRVIRASCVSSSSTGYLARKFHASSGDSKKIVGVFYKANEYASKNPNFLGCVENALGIRNWLESQGHHYIVTDDKEGPDCELEKHIPDLHVLISTPFHPAYVTAERIKKAKNLQLLLTAGIGSDHIDLQAAAAAGLTVAEVTGSNVVSVAEDELMRILILMRNFVPGYNQVVNGEWNVAGIAYRAYDLEGKTVGTVGAGRIGKLLLQRLKPFGCNLLYHDRLQMGPEMEKETGAKYVESLDEMLPKCDVVVVNTPLTEKTRGMFNKEMIGKMKKGVLIVNNARGAIMDRQAVVEAVESGHIGGYSGDVWDPQPAPKDHPWRYMPNQAMTPHISGTTIDAQLRYAAGTKDMLEKYFKGEDFPAQNYIVKDGELAPQYR

SEQ ID NO: 9007 - protein, 384 aa, Arabidopsis thaliana
MAMRQAAKATIRACSSSSSSGYFARRQFNASSGDSKKIVGVFYKANEYATKNPNFLGCVENALGIRDWLESQGHQYIVTDDKEGPDCELEKHIPDLHVLISTPFHPAYVTAERIKKAKNLKLLLTAGIGSDHIDLQAAAAAGLTVAEVTGSNVVSVAEDELMRILILMRNFVPGYNQVVKGEWNVAGIAYRAYDLEGKTIGTVGAGRIGKLLLQRLKPFGCNLLYHDRLQMAPELEKETGAKFVEDLNEMLPKCDVIVINMPLTEKTRGMFNKELIGKLKKGVLIVNNARGAIMERQAVVDAVESGHIGGYSGDVWDPQPAPKDHPWRYMPNQAMTPHTSGTTIDAQLRYAAGTKDMLERYFKGEDFPTENYIVKDGELAPQYR

SEQ ID NO: 9008 - protein, 382 aa, Cleome gynandra
MAMRALIKSFTSSSSSSSTAYLARRFHASSADSKKIVGVFYKANEYASKNPNFLGCVENALGIREWLESKGHQYIVTDDKEGPDCELEKHIPDLHVLISTPFHPAYMTAERIKKAKNLKLLLTAGIGSDHIDLNAAAAAGLTVAEVTGSNVVSVAEDELMRILILMRNFLPGYHQVINGEWNVAGIAYKAYDLEGKTIGTVGAGRIGRLLLQRLKPFGCNLLYHDRLKMEQEMESLLGAKYEENLNDMLPKCDVIVINTPLTEKTRGMFNKEMIKKMKKGVLIVNNARGAIMDRHAVVEAVDNGHIGGYSGDVWDPQPAPKDHPWRYMANQAMTPHISGTTIDAQIRYAEGTKDMLERYFKGEDFPAQNYIVKDGELAPQYR

SEQ ID NO: 9009 - protein, 382 aa, Tropaeolum majus
MAMKRVATSTIKAFASSAPSFTITRQLHASPGSKKIVGVFYKANEYASKNPNFLGCAENALGIHDWLESQGHKYIVTDDKEGPDCELEKHIPDLHVLISTPFHPAYVTAERIKKAKNLQLLLTAGIGSDHIDLNAAAAAGLTVAEVTGSNVVSVAEDELMRILILMRNFVPGYKQVINGEWDVASIAYRAYDLEGKTVGTVGAGRIGKLLLQRLKPFNCNLLYHDRLKMDQEMEAQTGAKYEENLEKLLPQCDVIVVNTPLTEKTRGLFNKDMIAKMKKGVLIVNNARGAIMDTQAVVDAINSGHIGGYSGDVWNPQPAPKDHPWRYMPNHAMTPHISGTTIDAQIRYAAGVKDMLEKYFKGEDFPAQNYIVKDGEIASQYR

SEQ ID NO: 9010 - protein, 387 aa, Carica papaya
MAMKRAATSAIKAFASSQTSFSGLSTNFARNLHASPGSKKIVGVFYKANEYATENPNFVGCVENALGIRNWLESQGHQYIVTDDKEGPNCELEKHIPDLHVLISTPFHPAYVTAERIKKAKNLQLLLTAGIGSDHIDLKAAAAAGLTVAEVTGSNVVSVAEDEVMRVLILMRNFVPGYQQVVNGEWNVAAIACRSYDLEGKTVGTVGAGRIGRLLLQRLKPFNCNLLYHDRVKMDPELESQIGAKFEEDLDKMLPKCDVIVVNTPLTEKTRGMFNKERIAKMKKGVRIVNNARGAIMDTQAVVDACNSGQIGGYSGDVWNPQPAPKDHPWRYMPNQAMTPHISGTTIDAQLRYAAGVKDMLDRYFKGEDFPAENYIVKDGQLASQYR

SEQ ID NO: 9011 - protein, 385 aa, Olea europaea
MAMKRVATSAIRAFNSSGIPSSSSIFTRELHATPGSKKIVGVFYKANEYASMNPNFLGCVENALGIRDWLESQGHQYIVTPDKEGPDCELEKHIPDLHVLITTPFHPAYVTAERIKKAKNLQLLLTAGIGSDHIDLKAAADAGLTVAEVTGSNTVSVAEDELMRILILVRNFLPGYHQVITGDWNVAAIAHRAYDLEGKTVGTVGAGRIGKLLLQRLKPFNCNLLYHDRLKMDPELESQLGAKFEEDLDAMLPKCDIIVINTPLTEKTKGMFNKEKIAKLKKGVLIVNNARGAIMDTQAVADACSSGHIAGYSGDVWYPQPAPKDHPWRYMPNQAMTPHISGTTIDAQLRYAAGTKDMLERYFKGEDFPPQNYIVKDGELASQYR

SEQ ID NO: 9012 - protein, 384 aa, Momordica charantia
MAMKQAATTAVRALSSSATSQSSSLVRHLHASPGSKKIVGVFYKANEYAALNPNFVGCVEGALGIREWLESQGHQYIVTDDKEGLDSELEKHIPDLHVLISTPFHPAYVTAERIKKAKNLQLLLTAGIGSDHVDLNAAAAAGLTVAEVTGSNVVSVAEDELMRILILVRNFLPGHHQVINGEWNVAGIAHRAYDLEGKTVGTVGAGRIGKLLLQRLKPFNCNLLYHDRLKIDPELEKQIGAQFEEDLDAMLPKCDVLVINTPLTDKTRGLFNKERIAKCKKGVLIVNNARGAIMDTQAVVDACNSGHIGGYSGDVWNPQPAPKDHPWRYMPNQAMTPHISGTTIDAQLRYAAGVKDMLERYFKGEEFPAQNYIVKEGELAPQYR

SEQ ID NO: 9013 - protein, 385 aa, Nicotiana tabacum
MAMRRVASTAARAFASSSPSPSSLVFTRELQASPGSKKIVGVFYKANEYAEMNPNFVGCAENALGIREWLESKGHQYIVTPDKEGPDCELEKHIPDLHVLITTPFHPAYVTAERIKKAKNLQLLLTAGIGSDHVDLKAAAAAGLTVAEVTGSNVVSVAEDELMRILILVRNFLPGHHQVINGEWNVAGIAYRAYDLEGKTVGTVGAGRIGRLLLQRLKPFNCNLLYHDRVKMDSELENQIGAKFEEDLDKMLSKCDIVVVNTPLTEKTKGMFDKERIAKMKKGVLIVNNARGAIMDTQAVVDACNSGHIAGYSGDVWYPQPAPKDHPWRYMPNQAMTPHISGTTIDAQLRYAAGTKDMLDRYFKGEDFPAQNYIVKDGELAPQYR

SEQ ID NO: 9014 - protein, 355 aa, Fraxinus spp
MQHPGARRLLGYFTRQTNSASMNPNFLGCVENALGIRDWLESQGHQYIVTSDKEGPDCELEKHIPDLHVLITTPFHPAYVTAERIKKAKNLQLLLTAGIGSDHIDLKAAADAGLTVAEVTGSNVVSVAEDELMRILILVRNFLPGHHQVITGDWNVAAIAHRAYDLEGKTVGTFGAGRIGKLLLQRLKPFNCNLLYHDRLKMDPELESQLGAKFEEDLDVMLPKCDILVINTPLTEKTKGMFNKERIAKLKKGVLIVNNARGAIMDTQAVADACSSGHIAGYSGDVWNPQPAPKDHPWRYMPNQAMTPHISGTTIDAQLRYAAGTKDMLERYFKGEDFPPQNYIVKDGELASQYR

SEQ ID NO: 9015 - protein, 384 aa, Platanus occidentalis
MAMKRAAASTIRSVCASRVSNSSPLARNLHASPGSKKIVGVFYKANEYAAMNPNFVGCVEGALGIREWLESQGHQYIVTDDKEGPNCELEKHIPDLHVLISTPFHPAYVTAERIKKAKNLQLLLTAGIGSDHVDLKAAAAAGLTVAEVTGSNVVSVAEDELMRILILVRNFVPAHHQVINGEWNVAAISHRAYDLEGKTVGTVGAGRIGKLLLQRLKPFNCNLLYHDRIKMDPEMEKQTGAKFEEDLDVMLPKCDIIVVNMPLTEKTRGMFNKERIAKLKKGVLIVNNARGAIMDTQAVVDACSSGHIAGYSGDVWNPQPAPKDHPWRYMPNQAMTPHISGTTIDAQLRYAAGVKDMLERYFKGEDFPPQHYIVKEGKLASQYL

SEQ ID NO: 9016 - protein, 384 aa, Vinca minor
MAMKRVAVSTIRAFASSATSSSSFFTRHLHASPGSKKIVGVFYNANEYASMNPNFVGCTENALGIRDWLESQGHQYVVTADKEGPDCELEKHIPDLHVLITTPFHPAYVTAERIKKAKNLQLLLTAGIGSDHIDLKAAADAGLTVAEVTGSNTVSVAEDELMRILILVRNFLPGYQQVITGDWNVAGIAYRAYDLEGKTVGTVGAGRIGRLLLQRLKPFNCNLLYHDRLQMDSKLENEIGAKYEEDLDKMLPKCDIIVINMPLTEKTKGMFNKERIALLKKGVLIVNNARGAIMDTQAVADACASGHIAGYSGDVWYPQPAPKDHPWRYMPNHAMTPHISGTTIDAQLRYAAGTKDMLDKYFKGEDFPAQNYIVKDGELASQYK

SEQ ID NO: 9017 - protein, 384 aa, Citrullus lanatus
MAMKQAATAAIRALSSSVTSKSSPLVRHLHASAGSKKIVGVFYKANEYAAMNPNFVGCVEGALGIRDWLESQGHQYIVTDDKEGLNSELEKHIPDLHVLITTPFHPAYVTAERIKKAKSLQLLLTAGIGSDHVDLNAAAAAGLTVAEVTGSNVVSVAEDELMRILILVRNFLPGYHQVINGEWNVAGIAHRAYDLEGKTVGTVGAGRIGKLLLQRLKPFNCNLLYHDRLKIDPELEKQIGAQFEEDLEAMLPKCDVLVINTPLTDKTRGLFNKERIAKCKKGVLIVNNARGAIMDTQAVVDACNSGHIGGYSGDVWNPQPAPKDHPWRYMPNQAMTPHISGTTIDAQLRYAAGVKDMLERYFKGEEFPAQNYIVKEGELAPQYR

SEQ ID NO: 9018 - protein, 384 aa, Cucumis melo
MAMKQAATTAIRALSSSLISHSSPLVRQLHASAESKKIVGVFYKANEYAAMNPNFVGCVEGALGIREWLESQGHEYIVTDDKEGLDSELEKHIPDLHVLITTPFHPAYVTAERIKKAKNLQLLLTAGIGSDHVDLNAAAAAGLTVAEVTGSNVVSVAEDELMRILILVRNFLPGYHQVVNGEWNVAGIAHRAYDLEGKTIGTVGAGRIGKLLLQRLKPFNCNLLYHDRLKIDPELEKQIGAQFEEDLDAMLPKCDVLVINTPLTDKTRGLFNKERIAKCKKGVLIVNNARGAIMDTQAVVDACNSGHIGGYSGDVWNPQPAPKDHPWRYMPNQAMTPHISGTTIDAQLRYAAGIKDMLERYFKGEEFPAQNYIVKEGQLAPQYR

SEQ ID NO: 9019 - protein, 379 aa, Eucalyptus grandis
MAMKRAGVSAIRALCSSANFARHAHSTAGSKKIVGVFYKANEYAELNPNFLGCVERGLGIHDWLESQGHQYIVTDDKEGPDCELEKHIPDLHVLITTPFHPAYVTAERIKKAKNLQLLLTAGIGSDHIDLKAAADAGLTVAEVTGSNVVLVAEDELMRILILVRNFLPGYHQVISGDWNVAGIAYRAYDLEGKTVGTVGAGRIGKLLLQRLKPFNCNLLYHDRLKMDPELEKQTGAKFEEDLDVMLQKCDIVVVNTPLTEKTRGMFDKERISKMKKGVLIVNNARGAIMDTQAVADACSSGHIGGYSGDVWFPQPAPKDHPWRYMPNQAMTPHISGTTIDAQLRYAAGTKDMLDRYFRGEEFPLQNYIVREGELAPQYR

SEQ ID NO: 9020 - protein, 381 aa, Solanum lycopersicum
MAMRRVASTAARAIASPSSLVFTRELQASPGPKKIVGVFYKANEYAEMNPNFLGCAENALGIREWLESKGHQYIVTPDKEGPDCELEKHIPDLHVLISTPFHPAYVTAERIKKAKNLQLLLTAGIGSDHVDLKAAAAAGLTVAEVTGSNTVSVAEDELMRILILVRNFLPGHHQVINGEWNVAGIAHRAYDLEGKTVGTVGAGRIGRLLLQRLKPFNCNLLYHDRLKMDSELENQIGAKFEEDLDKMLSKCDIVVINTPLTEKTKGMFDKERIAKLKKGVLIVNNARGAIMDTQAVVDACNSGHIAGYSGDVWYPQPAPKDHPWRYMPNQAMTPHISGTTIDAQLRYAAGTKDMLDRYFKGEDFPAENYIVKDGELAPQYR

SEQ ID NO: 9021 - protein, 381 aa, Vinca minor
MAMKRVAFSTIRAFSSSSSSFLTRHLHASSGSKKIVGVFYNANEYASMNPNFVGCTENALGIRDWLESQGHQYVVTADKEGPHCELEKHIPDLHVLITTPFHPAYVTAERIKKAKNLQLLLTAGIGSDHIDLKAAAEAGLTVAEVTGSNTVSVAEDELMRILILVRNFVPGYQQVITGDWNVAGISYRAYDLEGKTVGTVGAGRIGRLLLQRLKPFNCNLLYHDRLKMDSALENEIGAKYEEDLDKMLPKCDIIVINMPLTEKTIGMFNKEKIALLKKGVLIVNNARGAIMDTQAVADACASGHIAGYSGDVWYPQPAPKDHPWRYMPNHAMTPHVSGTTIDAQLRYAAGTKEMLDKYFKGEDFPAQNYIVKDGELASQYK

SEQ ID NO: 9022 - protein, 384 aa, Citrus sinensis
MAMKRVASSAINAFASSGYLRSSSRFSRHYASSGSKKIVGVFYKGNEYASMNPNFLGCVEGGCGLREWLESKGHQYIVTDDKEGPDCELEKHIPDLHVLISTPFHPAYVTAERIKKAKNLQLLLTAGVGSDHIDLKAAAAAGLTVAEVTGSNVVSVAEDELMRILILVRNFLPGHHQVISGEWNVAGVAYRAYDLEGKTVGTVGCGRIGKLLLQRLKPFNCNLLYHDRVKMDPQLEKETGAKFEEDLDTMLPKCDIVVVNTPLTEKTRGMFDKDRIAKMKKGVLIVNNARGAIMDTQAVVDACSSGHIAGYSGDVWNPQPAPKDHPWRYMPNQAMTPHVSGTTIDAQLRYAAGVKDMLDRYFKGEDFPVQNYIVKAGELAPQYR

SEQ ID NO: 9023 - protein, 142 aa, Citrus sinensis
MAMKRVASSAINAFASSGFLRSSSRFSRHYASSGSKKIVGVFYKGNEYASMNPNFLGCVEGGCGLREWLESKGHQYIVTDDKEGPDCELEKHIPDLHVLISTPFHPAYVTAERIKKAKNLQLLLTAGVGSDHIDLKLLLLLV

SEQ ID NO: 9024 - protein, 381 aa, Capsicum annuum
MAMRRVASTAARAFASPSSLVFTRQLQASPGPKKIVGVFYKANEYAEMNPNFLGCAENALGIREWLESKGHEYIVTPDKDGPDSELEKHIPDLHVLISTPFHPAYVTAERIKKAKNLQLLLTAGIGSDHVDLKAAAAAGLTVAEVTGSNTVSVAEDELMRILILVRNFLPGHHQVINGDWNVAGIAYRAYDLEGKTVGTVGAGRIGRLLLQRLKPFNCNLLYHDRLKMDPELESQIGAKFEEDLDKMLSKCDIVVINTPLTEKTKGMFDKEKIAKLKKGVLIVNNARGAIMDTQAVVDACNSGHIAGYSGDVWYPQPAPKDHPWRYMPNQAMTPHISGTTIDAQLRYAAGTKDMLDRYFKGEDFPAENYIVKDGELAPQYR

SEQ ID NO: 9025 - protein, 384 aa, Citrus clementina
MAMKRVASSAINAFASSGYLRSSSRFSRHYASSGSKKIVGVFYKGNEYASMNPNFLGCVEGGCGLREWLESKGHQYIVTDDKEGPDCELEKHIPDLHVLISTPFHPAYVTAERIKKAKNLQLLLTAGVGSDHIDLNAAAAAGLTVAEVTGSNVVSVAEDELMRILILVRNFLPGHHQVISGEWNVAGVAYRAHDLEGKTVGTVGCGRIGKLLLQRLKPFNCNLLYHDRVKMDPQLEKETGAKFEEDLDTMLPKCDIVVVNTPLTEKTRGMFDKDRIAKMKKGVLIVNNARGAIMDTQAVVDACSSGHIAGYSGDVWNPQPAPKDHPWRYMPNQAMTPHVSGTTIDAQLRYAAGVKDMLDRYFKGEDFPVQNYIVKAGELAPQYR

SEQ ID NO: 9026 - protein, 384 aa, Cucumis sativus
MAMKQAATTAIRALSSSLTSHSSPLLRHLHASAESKKIVGVFYKANEYAAMNPNFVGCVEGALGIREWLESQGHEYIVTDDKEGLDSELEKHIPDLHVLITTPFHPAYVTAERIKKAKNLKLLLTAGIGSDHVDLNAAAAAGLTVAEVTGSNVVSVAEDELMRILILVRNFLPGYHQVVNGEWNVAGIAHRAYDLEGKTVGTVGAGRIGKLLLQRLKPFNCNLLYHDRLKIDPELEKQIGAQFEEDLDAMLPKCDVLVINTPLTDKTRGLFNKERIAKCKKGVLIVNNARGAIMDTQAVVDACNSGHVGGYSGDVWNPQPAPKDHPWRYMPNQAMTPHISGTTIDAQLRYAAGVKDMLERYFKGEEFPAQNYIVKEGQLAPQYR

SEQ ID NO: 9027 - protein, 382 aa, Ipomoea nil
MAMRRVAASGLRAFASYGNPSLLTRQLHASPGSKKIVGVFYKANEYASMNPNFVGCVENALGIRDWLESQGHQYIVTPDKEGPDSELEKHIPDLHVLITTPFHPAYVTAERIKKAKNLQLLLTAGIGSDHIDLNAAAAAGLTVAEVTGSNTVSVAEDELMRILILVRNFLPGYHQVIKGEWDVAGIAYRAYDLEGKTVGTVGAGRIGRLLLQRLKPFNCNLLYHDRLKMDPALEKEIGATFEEDLDTMLSKCDIVVINTPLTDKTKGMFDKNRIAKMKKGVLVVNNARGAIMDTQAVADACSSGHIAGYSGDVWYPQPAPKDHPWRYMPNQAMTPHISGTTIDAQLRYAAGTKDMLDRYFKGEEFPAQNYIVKDGQLASQYR

SEQ ID NO: 9028 - protein, 381 aa, Solanum tuberosum
MAMSRVASTAARAITSPSSLVFTRELQASPGPKKIVGVFYKANEYAEMNPNFLGCAENALGIREWLESKGHQYIVTPDKEGPDCELEKHIPDLHVLISTPFHPAYVTAERIKKAKNLQLLLTAGIGSDHVDLKAAAAAGLTVAEVTGSNTVSVAEDELMRILILVRNFLPGHHQVINGEWNVAAIAHRAYDLEGKTVGTVGAGRIGRLLLQRLKPFNCNLLYHDRLKMDSELENQIGAKFEEDLDKMLSKCDIVVINTPLTEKTKGMFDKERIAKLKKGVLIVNNARGAIMDTQAVVDACNSGHIAGYSGDVWYPQPAPKDHPWRYMPNQAMTPHISGTTIDAQLRYAAGTKDMLDRYFKGEDFPAENYIVKDGELAPQYR

SEQ ID NO: 9029 - protein, 381 aa, Solanum lycopersicum
MAMRRVASTAARAIASPSSLVFTRELQASPGPKKIVGVFYKANEYAEMNPNFLGCAENALGIREWLESKGHQYIVTPDKEGPDCELEKHIPDLHVLISTPFHPAYVTAERIKKAKNLQLLLTAGIGSDHVDLKAAAAAGLTVAEVTGSNTVSVAEDELMRILILVRNFLPGHHQVINGEWNVAAIAHRAYDLEGKTVGTVGAGRIGRLLLQRLKPFNCNLLYHDRLKMDSELENQIGAKFEEDLDKMLSKCDIVVINTPLTEKTKGMFDKERIAKLKKGVLIVNNARGAIMDTQAVVDACNSGHIAGYSGDVWYPQPAPKDHLWRYMPNQAMTPHISGTTIDAQLRYAAGTKDMLDRYFKGEDFPAENYIVKDGELAPQYR

SEQ ID NO: 9030 - protein, 290 aa, Ambrosia trifida
MAMKRSAAAATRALISSSSSSILTRDLHASSGKKKIVGVFYKAHEYAKMNPNFLGCVENALGIRDWLESQGHEYIVTDDKEGPDCELEKHIPDAHVIITTPFHPGYITAERIKKAKNLQLLLTAGIGSDHVDLKAAAAAGLTVAEVTGSNVVSVAEDELMRILILVRNFLPGYHQVISGDWNVAGIAYRAYDLEGKTVGTVGCGRIGRLLLQRLKPFGCNLLYHDRIKMDSELENQIGASYEEDLDKMLPKCDVVVINTPLTEKTKGMFDKERIAKLKKEFSLLTMLEEL

SEQ ID NO: 9031 - protein, 339 aa, Ambrosia trifida
MSSAKMNPNFLGCVENALGIRDWLESQGHEYIVTDDKEGPDCELEKHIPDAHVIITTPFHPGYITAERIKKAKNLQLLLTAGIGSDHVDLKAAAAAGLTVAEVTGSNVVSVAEDELMRILILVRNFLPGYHQVISGDWNVAGIAYRAYDLEGKTVGTVGCGRIGRLLLQRLKPFGCNLLYHDRIKMDPELENQIGASYEEDLDKMLPKCDVVVINTPLTEKTKGMFDKERIAKLKKGVLIVNNARGAIMDTQAVADACSSGHIGGYSGDVWYPQPAPKDHPWRYMPNQAMTPHISGTTIDAQLRYAAGVKDMLDNYFKGEDFPAQHYIVKEGELASQYR

SEQ ID NO: 9032 - protein, 383 aa, Ambrosia trifida
MAMKRSAAAATRAILSSSSSSSILTRDLHASSGKKKIVGVFYKAHEYAKMNPNFLGCVENALGIRDWLESQGHEYIVTDDKEGPDCELEKHIPDAHVIITTPFHPGYITAERIKKAKNLQLLLTAGIGSDHVDLKAAADAGLTVAEVTGSNVVSVAEDELMRILILVRNFLPGYHQVISGDWNVAGIAYRAYDLEGKTVGTVGCGRIGRLLLQRLKPFGCNLLYHDRIKMDSELESQIGASYEEDLDKMLPKCDIVVINTPLTEKTKGMFDKERIAKLKKGVLIVNNARGAIMDTQAVADACSSGHIGGYSGDVWYPQPAPKDHPWRYMPNQAMTPHISGTTIDAQLRYAAGVKDMLDNYFKGEDFPAQHYIVKEGELASQYR

SEQ ID NO: 9033 - protein, 383 aa, Vitis vinifera
MAMMKRVAESAVRAFALGSTSGALTRHLHASAGSKKIVGVFYKANEYAAMNPNFVGCVEGALGIRDWLESQGHQYIVTDDKEGPDCELEKHIPDLHVLISTPFHPAYVTAERIKKAKNLQLLLTAGIGSDHIDLKAAAAAGLTVAEVTGSNVVSVAEDELMRILILVRNFLPGHHQVISGEWNVAGIAYRAYDLEGKTVGTVGAGRIGRLLLQRLKPFNCNLLYHDRIKMDPELENQIGAKFEEDVDVMLPKCDIIVINMPLTEKTKGMFNKERIAKLKKGVLIVNNARGAIMDTQAVADACSSGHIAGYSGDVWYPQPAPKDHPWRYMPNQAMTPHISGTTIDAQLRYAAGVKDMLDRYFKGEDFPAQHYIVKEGQLASQYQ

SEQ ID NO: 9034 - protein, 381 aa, Ambrosia trifida
MAMKRSAVAATRALISSSSSILTRDLHASSGKKKIVGVFYKAHEYAKMNPNFLGCVENALGIRDWLESQGHEYIVTDDKEGPDCELEKHIPDAHVIITTPFHPGYITAERIKKAKNLQLLLTAGIGSDHVDLKAAADAGLTVAEVTGSNVVSVAEDELMRILILVRNFLPGYHQVISGDWNVAGIAYRAYDLEGKTVGTVGCGRIGRLLLQRLKPFGCNLLYHDRIKMDSELESQIGASYEEDLDKMLPKCDIVVINTPLTEKTKGMFDKERIAKLKKGVLIVNNARGAIMDTQAVADACSSGHIGGYSGDVWYPQPAPKDHPWRYMPNQAMTPHISGTTIDAQLRYAAGVKDMLDNYFKGEDFPAQHYIVKEGELASQYR

SEQ ID NO: 9035 - protein, 388 aa, Fagopyrum esculentum
MAMKRVATSALKAFSATSVNSLSSSSSLLARDFHASGGSKKIVGVFYKANEYASMNPNFVGCVEGALGIREWLESQGHQYIVTDDKEGPDCELEKHIDDLHVLITTPFHPAYVTAERIKKAKNLQLLLTAGIGSDHIDLQAAAASGLTVAEVTGSNVVSVAEDELMRILILVRNFVPGYQQVINGEWNVAGIAYRAYDLEGKTVGTVGAGRIGRLLLQRLQPFNCNLLYHDRIRMDPELENQTGAKFEEDLEKMLPKCDVIVINMPLTEKTRGMFNKETIAKLKKGVLIVNNARGAIMDAQAVADAISNGQIGGYSGDVWYPQPAPKDHPWRTMPNHAMTPHISGTTIDAQLRYAAGVKDMLDRYFKGEDFPPQHYIVKEGQLASQYR

SEQ ID NO: 9036 - protein, 379 aa, Linum usitatissimum
LKRAATSATRAFASSSSGSLSRHLHASAGSKKIVGVFYKANEYAEKNPNFLGCAEHALGIREWLESQGHHYIVTDDKDGPNSELEKHIPDLHVLISTPFHPAYVTAERIKKAKNLQLLLTAGIGSDHIDLPAAAAAGSTVAEVTGSNVVSVAEDELMRILILMRNFLPGHHQVINGEWDVAGIAYRAYDLEGKTIGTVGCGRIGKLLLQRLKPFGCNLLYHDRLKMEPELETQIGAKFEEDVDAMLPKCDVVVINTPLTEKTKGMFDKDRILKMKKGVLIVNNARGAIMDTQAVVDACSSGHIGGYSGDVWYPQPAPKDHPWRYIPNQAMTPHISGTTIDAQLRYAAGVKDMLDRYFKGEDFPPQHYIVKEGKLASQYQ

SEQ ID NO: 9037 - protein, 387 aa, Populus trichocarpa
MAMKRAATSAIRAFSSSSPASSVSSGSSTRLLHASAESKKIVGVFYKANEYASLNPNFVGSLEGALGIRDWLESQGHQYIVTDDKEGLDSELEKHIPDLHVLITTPFHPAYVTAERIKRAKNLQLLLTAGIGSDHIDLEAAAAAGLTVAEVTGSNVVSVAEDELMRILILVRNFLPGYHQVINGEWNVAAIAYRAYDLEGKTVGTVGAGRIGKLLLQRLKPFNCNLLYHDRLKMDPELEKQTGAKFEEDLDSLLSKCDVVVINTPLTEKTRGMFDKERIAKMKKGVLIVNNARGAIMDTQAVVDACSSGQIGGYSGDVWNPQPAPKDHPWRYMPNHAMTPHISGTTIDGQLRYAAGVKDMLDRYFKGEEFPPQNYIVKEGKLASQYL

SEQ ID NO: 9038 - protein, 382 aa, Helianthus annuus
MAMKRSAAAATRALSSATSSSILTRDLHSSSGKKKIVGVFYKAHEYAKMNPNFMGCVENALGIRDWLESQGHEYIVTDDKEGPDCELEKHIPDAHVIITTPFHPGYITAERIKKAKNLQLLLTAGIGSDHVDLKAAADAGLTVAEVTGSNVVSVAEDELMRILILVRNFLPGYHQVINGDWNVAGIAYRAYDLEGKTVGTVGCGRIGRLLLQRLKPFGCNLLYHDRIKMDPELENQIGASYEEDLDKMLPKCDVVVINTPLTEKTKGMFDKEKIAKMKKGVLIVNNARGAIMDTQAVADGCSSGHIGGYSGDVWYPQPAPKDHPWRYMPNQAMTPHISGTTIDAQLRYAAGVKDMLENYFKGEDFPAQHYIVKEGELASQYR

SEQ ID NO: 9039 - protein, 386 aa, Tripterygium wilfordii
MALKRVASSVIRALGSSSAGLDSSITLTRSLHASAGGKKIVGVFYKANEYASLNPNFVGSAERALGIREWLESQGHEYIVTDDKEGPNCELEKHIPDLHVLITTPFHPAYVTAERIKKAKNLQLLLTAGIGSDHVDLKAAAAAGLTVAEVTGSNVVSVAEDELMRILILVRNFVPGHQQVIKGEWNVAGIAYRAYDLEGKTVGTVGAGRIGKLLLQRLKPFNCNLLYHDRLKMDPELETQIGAKFEEDLDGMLAKCDVVVINTPLTEKTRGLFDKARIAKMKKGVLIVNNARGAIMDTQAVVDACSSGHIAGYSGDVWNPQPAPKDHPWRYMPNQAMTPHISGTTIDAQLRYAAGTKDMLERYFKGEEFPPQNYIVKEGKIAPQYQ

SEQ ID NO: 9040 - protein, 385 aa, Manihot esculenta
MAMKRAATSAIRAFPSSFGISGSSALGRHLHASAGSKKIVGVFYKANEYAAMNPNFLGCAEGALGIREWLESKGHRYIVTDDKEGPDCELEKHIPDLHVLITTPFHPAYVTAERIKKAKNLQLLLTAGIGSDHIDLKAAADAGLTVAEVTGSNVVSVAEDELMRILILLRNFLPGYHQVINGEWNVAGIAYRAYDLEGKTVGTVGAGRIGRLLLQRLKPFNCNLLYHDRLKMDPELENQTGAKFEEDLDAMLPKCDIIVINTPLTEKTRGLFNKDKIAKMKKGVLIVNNARGAIMDTQAVVDACSSGQIGGYSGDVWYPQPAPKDHAWRYMPNQAMTPHISGTTIDAQLRYAAGVKDMLDRYFKGEEFPLQNYIVKEGKIASQYQ

SEQ ID NO: 9041 - protein, 385 aa, Malus domestica
MAMKRVLVSAVRGLASSGSSASSTTFTRHLHASGGSKKIVGVFYKAKEYAELNPNFLGCEERALGIRDWLESQGHKYIVTDDKEGPNCELDKHIEDLHVLITTPFHPAYVTAERIKKAKNLQLLLTAGIGSDHIDLKAAAAAGLTVAEVTGSNVVSVAEDELMRILILVRNFVPGYQQIVSGEWNVAGIAYRAYDLEGKTVGTVGAGRIGRLLLQRLKPFNCNLLYHDRVKIDPELEKQTGAKFEEDLDAMLPKCDVIVVNTPLTEKTRGLFDKERIAKCKKGVLIVNNARGAIMDTQAVVDACSSGHIAGYSGDVWNPQPAPKDHPWRYMPNHAMTPHISGTTIDAQLRYAAGTKDMLDRYFKGEEFPAQNYIVKDGKLASQYQ

SEQ ID NO: 9042 - protein, 383 aa, Cirsium arvense
MAMKRAAATAIRAISSANSSASILTRHLHASAEKKKIVGVFYKAHEYAEMNPNFLGCAENALGIRNWLESQGHEYIVTDDKEGPDCELEKHISDMHVLITTPFHPAYVTAERIKKAKNLQLLLTAGIGSDHVDLQAAAAAGLTVAEVTGSNVVSVAEDELMRILILVRNFLPGHHQVITGDWNVAGIAYRAYDLEGKTVGTVGCGRIGRLLLQRLKPFGCNLLYHDRIKMDPELENQIGASYEEDLDKMLPKCDIIVINTPLTEKTKGMFDKERIAKLKKGVLIVNNARGAIMDTQAVVDGCSSGHIGGYSGDVWYPQPAPKDHPWRYMPNQAMTPHISGTTIDAQLRYAAGVKDMLENYFKGEDFPAQHYIVKEGELASQYR

SEQ ID NO: 9043 - protein, 384 aa, Cucurbita pepo
MAMKQAATAAIRAFSSSVPSQSSPLVRHLHASAGSKKIVGVFYKANEYAAMNPNFVGCVEGSLGIREWLESQGHQYIVTDDKEGLNCELEKHIPDLHVLITTPFHPAYVTAERIKKAKNLELLLTAGIGSDHVDLNAAAAAGLTVAEVTGSNVVSVAEDELMRILILVRNFLPGHHQVIKGEWNVAGIAHRAYDLEGKTIGTVGAGRIGKLLLQRLKPFNCNLLYHDRLKIDPELEKQIGAKFEEDMDAMLPKCDVLVINTPLTDKTRGLFNKERIAKCKKGVLIVNNARGAIMDTEAVVDACNSGHIGGYSGDVWNPQPAPKDHPWRYMPNQAMTPHISGTTIDAQLRYAAGVKDMLDRYFKGQDFPAQNYIVKEGELAPQYR

SEQ ID NO: 9044 - protein, 383 aa, Primula obconica
MAMKRAAVSAIRVLSVNSTPSILTTRQLHASPGSKKIVGVFYKANEYASMNPNFLGCEENALGIRKWLESQGHKYIVTDDKEGPNCELEKHIPDLHVLITTPFHPAYVTAERIKKAKNLQLVLTAGIGSDHVDLNAAAAAGLTVAEVTGSNVVSVAEDELMRILILVRNFLPGYHQVIKGDWDVAAIAYRAYDLEGKTVGTVGAGRIGKLLLQRLKPFNCNLLYHDRLKMDAELEAQTGAKFEEDLDKMLPKCDIIVINMPLTDKTKGMFDKEKISKLKKGVLIVNNARGAIMDTQAVVDACSSGHIAGYSGDVWYPQPAPKDHPWRYMPNQAMTPHISGTTIDAQLRYAAGTKDMLDRYFKGEEFPAQNYIVKEGELASQYR

SEQ ID NO: 9045 - protein, 432 aa, Flaveria ramosissima
IIIIDLFKGDDEIRTTLVSRKHFSFCIFRSSSSEFQRNTGDGDGDGDGDVNGDEAICSHCNSCYLLCYFKLHSNQRPSCFFREKKIVGVFYKAHEYAQMNPNFLGCVENALGIRNWLESQGHEYIVTDDKEGPDCELEKHIPDAHVIITTPFHPGYITAERIKKAKNLQLLLTAGIGSDHVDLNAAAAAGLTVAEVTGSNVVSVAEDELMRILILVRNFLPGYHQVITGDWNVAGIAYRAYDLEGKTVGTVGCGRIGRLLLQRLKPFGCNLLYHDRIKMDPEMEGQIGAKFEEDLDKMLPKCDIVVINTPLTEKTRGMFDKERIAKMKKGVLIVNNARGAIMDTQAVADGCSSGHIAGYSGDVWFPQPAPKDHPWRYMPNQAMTPHISGTTIDAQLRYAAGVKGMLENYFKGEDFPAQHYIVKEGELASQYR

SEQ ID NO: 9046 - protein, 378 aa, Arnica chamissonis
MAMKRAAGPASRAISASILTRDLHASSGKKKIVGVFYKAHEYAQMNPNFVGCVENALGIRNWLESQGHEYIVTDDKEGPDCELEKHISDAHVIITTPFHPGYITAERIKKAKNLQLLLTAGIGSDHVDLKAAADAGLTVAEVTGSNVVSVAEDELMRILILVRNFLPGYHQVITGDWNVAGIAYRAYDLEGKTVGTVGCGRIGRLLLQRLKPFGCNLLYHDRLKMDPELESQIGAKFEEDLDKMLPKCDIVVINTPLTEKTKGMFDKERIAKMKKGVLIVNNARGAIMDTQAVVDGCSSGHIGGYSGDVWYPQPAPKDHPWRYMPNQAMTPHISGTTIDAQLRYAAGVKDMLENYFKGEDFPAQHYIVKEGELASQYR

SEQ ID NO: 9047 - protein, 382 aa, Theobroma cacao
MAMKQVASSAIKALANSGSSSVLTRQLHASPGSKKIVGVFYKANEYYEKNPNFVGCVEGALGLREWLESQGHQYIVTDDKEGPDCELEKHIPDLHVLISTPFHPAYVTAERIKKAKNLQLLLTAGIGSDHVDLKAAAEAGLTVAEVTGSNVVSVAEDELMRILILVRNFLPGHHQVITGDWNVAGIAYRAYDLEGKTVGTIGAGRIGRLLLQRLKPFNCNLLYHDRVKIDPELEKQTGAKFEEDLDAMLPKCDIIVINMPLTEKTRGMFDKDRIAKLKKGVLIVNNARGAIMDTQAVADACSSGHIAGYSGDVWYPQPAPKDHPWRFMPNQAMTPHISGTTIDAQLRYAAGVKDMLDRYFKGEEFPAQNYIVKEGELAPQYR

SEQ ID NO: 9048 - protein, 382 aa, Ricinus communis
MAMKKAAASAICALASSSTSSAFSRHLHASAGSKKIVGVFYKANEYASMNPNFSGCAEGALGIRDWLESQGHQYIVTDDKEGPHCELEKHIPDLHVLITTPFHPAYVTAERIKKAKNLQLLLTAGIGSDHIDLKAAAEAGLTVAEVTGSNVVSVAEDELMRILILVRNFLPGYHQVISGDWNVAGIAYRAYDLEGKTVGTVGAGRIGRLLLQRLKPFNCNLLYHDRIKMDPELENQTGAKYEEDLDAMLPKCDIVVINTPLTEKTRGLFNKDRIAKLKKGVLIVNNARGAIMDTQAVADACSSGHIGGYSGDVWYPQPASKDHPWRYMPNQAMTPHISGTTIDAQLRYAAGVKDMLDRYFKGEEFPLQNYIVKEGKLASQYQ

SEQ ID NO: 9049 - protein, 381 aa, Solanum phureja
MAMSRVASTAARAITSPSSLVFTRELQASPGPKKIVGVFYKANEYAEMNPNFLGCAENALGIREWLESKGHQYIVTPDKEGPDCELEKHIPDLHVLISTPFHPAYVTAERIKKAKNLQLLLTAGIGSDHVDLKAAAATGLTVAEVTGSNTVSVAEDELMRILILVRNFLPGHHQVINGEWNVAAIAHRAYDLEGKTVGTVGAGRIGRLLLQRLKPFNCNLLYHDRLKMDSELENQIGAKFEEDLDKMLSKCDIVVINTPLTEKTKGMFDKERIAKLKKGVLIVNNARGAIMETQAVVDACNSGHIAGYSGDVWYPQPAPKDHPWRYMPNQAMTPHISGTTIDAQLRYAAGTKDMLDRYFKGEDFPAENYIVKDGELAPQYR

SEQ ID NO: 9050 - protein, 384 aa, Mimulus guttatus
MAMKRAAVSAVRAFTSSGNPAPSVLARGLHASPGSKKIVGVFYNANEYASMNPNFLGCVENALGIRDWLETQGHEYIVTADKDGPHSELEKHMSDLHVLISTPFHPAYVTAERIKKAKNLQLLLTAGIGSDHIDLKAAAAAGLTVAEVTGSNVVSVAEDELMRILILVRNFLPGHHQVINGEWNVAAIAHRAYDLEGKTVGTVGAGRIGRLLLQRLKPFNCNLLYHDRLQMDAELESQIGATYEEDLDAMLPKCDIIVINTPLTEKTKGMFDKERIAKLKKGVLIVNNARGAIMDTQAVVDACSSGHIAGYSGDVWYPQPAPKDHPWRYMPNQAMTPHISGTTIDAQLRYAAGVKDMLECYFKGEDFPEQNYIVKDGELASQYR

SEQ ID NO: 9051 - protein, 98 aa, Humulus lupulus
MAMKRVAVSAFQALSSSSSSSSPLTRHLHASAGSKKIVGVFYKANDYAKLNPNFVGCAEGALGIRDWLESQGHQYIVTDDKEDLAVNLRNIFLIWKFL

SEQ ID NO: 9052 - protein, 382 aa, Amsonia hubrichtii
MAMKRVAASAIRAFASSGDSSFLTRNLHASPGSKKIVGVFYKGNEYAAMNPNFLGCTENALGIRDWLESQGHEYIVTADKEGPDCELEKHIPDLHVLITTPFHPAYVTAERIKKAKNLQLLLTAGIGSDHIDLKAAADAGLTVAEVTGSNTVSVAEDELMRILILIRNFLPGYHQAITGDWNVAGIAYRAYDLEGKTVGTVGAGRIGRLLLQRLKPFNCNLLYHDRIKMEPELENQIGAKFEEDLDAMLPKCDIIVMNTPLTEQTKGMFNKERIAKLKKGVLIVNNARGALMDTQAVVDACSSGHIAGYSGDVWYPQPAPKDHPWRYMPNHAMTPHVSGTTIDGQLRYAAGVKDMLDKYFKGEDFPAQNYIVKDGELASQYK

SEQ ID NO: 9053 - protein, 382 aa, Cirsium arvense
MAMKRAAATAVRAISSANSGSILTRQLHASAEKKKIVGVFYKAHEYAEMNPNFLGCAENALGIRKWLESQGHEYIVTDDKEGPDCELEKHISDMHVLITTPFHPAYVTAERIKKAKNLQLLLTAGIGSDHVDLQAAAAAGLTVAEVTGSNTVSVAEDELMRILILVRNFLPGHHQVISGDWNVAGIAYRAYDLEGKTVGTVGCGRIGRLLLQRLKPFGCNLLYHDRIKMDQELENQIGAKFEEDLDKMLPKCDIIVINTPLTEKTKGMFDKEKIAKLKKGVLIVNNARGAIMDTQAVVDGCSSGHIGGYSGDVWYPQPAPKDHPWRYMPNQAMTPHISGTTIDAQLRYAAGVKDMLENYFKGEDFPAQHYIVKEGELASQYR

SEQ ID NO: 9054 - protein, 383 aa, Zingiber officinale
MAMLRAAKHAMRALGSRAPDASPFARMLHASTGSKKIVGVFYKANEYASMNPKFVGCVEGSLGIRDWLESQGHQYIVTDDKEGPNCELEKHIPDMHVLITTPFHPAYVTEERIKKAKNLQLLLTAGIGSDHIDLKAAAAAGLTVAEVTGSNTVSVAEDELMRILILVRNFLPGYHQVINGDWNVAAIAYRAYDLEGKTVGTVGAGRIGKLLLQRLKPFNCNLLYHDRLKMEPDLEKEIGAKFEEDLDKMLPKCDVIVINTPLTEKTRGLFNKERIGKLKKGVLIVNNARGAIMDTQAVADACSSGHIAGYSGDVWNPQPAPKDHPWRYMPNHAMTPHISGTTIDGQLRYAAGTKDMLDRYFKGQDFPAQNYIVKEGKLASQYQ

SEQ ID NO: 9055 - protein, 385 aa, Linum usitatissimum
MAMIATLKRAATSATRAFASSPSGSLSRHLHASAGSKKIVGVFYKANEYAEKNPNFLGCAEHALGIRDWLESQGHHYIVTDDKDGPNSELEKHIPDLHVLISTPFHPAYVTAERIKKAKNLQLLLTAGIGSDHIDLPAAAAAGLTVAEVTGSNVVSVAEDELMRILILMRNFLPGHHQVIKGEWDVAGIAYRAYDLEGKTIGTVGCGRIGKLLLQRLKPFGCNLLYHDRLKMEPELETQIGAKFEEDVDAMLPKCDVVVINTPLTEKTKGMFDKERISKMKKGVLIVNNARGAIMDTQAVVDACSSGHIGGYSGDVWYPQPAPKDHPWRYMPNQAMTPHISGTTIDAQLRYAAGVKDMLDRYFKGEDFPPQHYIVKEGKLASQYQ

SEQ ID NO: 9056 - protein, 383 aa, Manihot esculenta
MRRAAISAIRSFTSSSRISGSPAISRDLHASAGSKKIVGVFYKANEYAAMNPNFLGCAEGALGIRDWLESQGHRYIVTDDKEGPHSELEKHIPDLHVLVSTPFHPAYVTAERIKKAKNLQLLLTAGVGSDHIDLKAAAAAGLTVAEVTGSNVVSVAEDELMRILILVRNFLPGYRQVINGEWNVAGIAYRAYDIEGKTVGTVGAGRIGRLLLQRLKPFNCNLLYHDRLRMDPELENQTGAKFEEDLDAMLPKCDIIVINTPLTEKTRGLFNKDRIAKMKKGVLIVNNARGAIMDTQAVVDACSIGHIGGYSGDVWHPQPAPKDHPWRYMPNHAMTPHISGTTIDAQLRYAAGVKDMLDRYFKGEEFPPQNYIVKDGKIASQYQ

SEQ ID NO: 9057 - protein, 384 aa, Triphysaria pusilla
MAMKRAVASAVGAITSSGNPASSVLARYLHASPGSKKIVGVFYKANEYASMNPDFVGCAENALGIREWLESKGHHYIVTPDKDGPDCELEKHIPDLHVLISTPFHPAYVTAERIKKAKNLQLLLTAGIGSDHIDLQAAADAGLTVAEVTGSNVVSVAEDELMRILILVRNFLPGHHQVINGDWNVAAIAHRAYDLEGKTVGTVGAGRIGRLLLQRLKPFNCNLLYHDRLKMEPELESEIGAKFEEDLDAMLPKCDIIVINTPLTEKTKGMFDKDKIAKLKKGVLIVNNARGAIMDTQAVVDACSSGHIAGYSGDVWYPQPAPKDHPWRYMPNQAMTPHISGTTIDAQLRYAAGVKDMLERYFKGEDFPPQHYIVKDGELASQYR

SEQ ID NO: 9058 - protein, 383 aa, Aquilegia formosa
MATRKAVVLGAQSLLRSSSTSSPSIRNLHASSESKKIVGVFYKANEYASMNPNFVGCAEGALGIRDWLESQGHQYIVTDDKDSPNSELEKHIPDLHVLISTPFHPAYVTAERIKKAKNLQLLLTAGIGSDHIDLKAAAAAGLTVAEVTGSNVVSVAEDELMRILILVRNFVPGYKQVITGDWNVAAIAHRAYDLEGKTVGTVGAGRIGRLLLQRLKPFNCNLLYHDRVKMDSDLESQTGAKYEEDLDAMLPKCDIIVINMPLTEKTAGMFNKEKIAKLKKGVLIVNNARGAIMDTQAVADACSSGHIAGYSGDVWFPQPAPKDHPWRYMPNQAMTPHISGTTIDAQLRYAAGVKDMLDKYFKGEDFPAQNYIVKEGELASQYR

SEQ ID NO: 9059 - protein, 223 aa, Primula obconica
MRILILVRNFLPGYHQVIKGDWDVAAIAYRAYDLEGKTVGTVGAGRIGKLLLQRLKPFNCNLLYHDRLKMDAELEAQTGAKFEEDLDKMLPKCDIIVINMPLTDKTKGMFDKEKISKLKKGVLIVNNARGAIMDTQAVVDACSSGHIAGYSGDVWYPQPAPKDHPWRYMPNQAMTPHISGTTIDAQLRYAAGTKDMLDRYFKGEEFPAQNYIVKEGELASQYR

SEQ ID NO: 9060 - protein, 382 aa, Flaveria ramosissima
MAMKRSAATATRAISSAISNSILTRDLHASSGKKKIVGVFYKAHEYAQMNPNFLGCVENALGIRNWLESQGHEYIVTDDKEGPDCELEKHIPDAHVIITTPFHPGYITAERIKKAKNLQLLLTAGIGSDHVDLNAAAAAGLTVAEVTGSNVVSVAEDELMRILILVRNFLPGYHQVITGDWNVAGIAYRAYDLEGKTVGTVGCGRIGRLLLQRLKPFGCNLLYHDRIKMDPEMENQIGASFEEDLDKMLPKCDVVVINTPLTDKTKGMFDKERIAKMKKGVLIVNNARGAIMDTQAVADGCSSGHIAGYSGDVWFPQPAPKDHPWRYMPNQAMTPHISGTTIDAQLRYAAGVKGMLENYFKGEDFPAQHYIVKEGELASQYR

SEQ ID NO: 9061 - protein, 385 aa, Malus domestica
MASKGVIASAVRALASSGSSASSTTFTRHLHASGGSKKIVGVFYKANEYAELNPNFLGSQERALGIRDWLESQGHEYIVTDDKEGPNCELEKHIEDLHVLITTPFHPAYVTAERIKKAKNLELLLTAGIGSDHIDLKAAAAAGLTVAEVTGSNVVSVAEDELMRILILVRNFVPGYQQIVTGEWNVAGIAHRAYDLEGKTVGTVGAGRIGRLLLQRLKPFNCNLLYHDRVKIDPELEQQTGAKFEEDLDAMLPKCDVIVVNTPLTEKTRGLFDKERIAKCKKGVLIVNNARGAIMDTQAVVDACSSGHIAGYSGDVWNPQPAPKDHPWRYMPNHAMTPHISGTTIDAQLRYAAGTKDMLDRYFKGEEFPAQNYIVKDGKLASQYQ

SEQ ID NO: 9062 - protein, 374 aa, Valeriana officinalis
MALKRAASSVGSSFLARHLHASSGNKKIVGVFYKANEYAAMNPNFVGCQENALGIRDWLESKGHEYIVTDDKEGPDCELEKHIPDLHVLITTPFHPAYVTAERIKKAKNLQLLLTAGIGSDHVDLQAAAAAGLTVAEVTGSNTVSVAEDELMRILILVRNFLPGHHQVINGEWNVAAIAHRAYDLEGKTVGTVGAGRIGKLLLQRLKPFNCNLLYHDRLKMEPELENEIGAKFEEDLDAMLPKCDIIVINTPLTEKTKGMFNKEKIAKLKKGVLIVNNARGAIMDTQAVVDACSSGHIAGYSGDVWYPQPAPKDHPWRYMPNQAMTPHISGTTIDAQLRYAAGVKDMLDRYFKGEEFPAQHYIVKEGELASQYR

SEQ ID NO: 9063 - protein, 223 aa, Fagopyrum esculentum
MRILILVRNFVPGYQQVINGEWNVAGIAYRAYDLEGKTVGTVGAGRIGRLLLQRLQPFNCNLLYHDRIRMDPELENQTGAKFEEDLEKMLPKCDVLVINMPLTEKTRGMFNKETIAKLKKGVLIVNNARGAIMDAQAVADAISSGQIGGYSGDVWYPQPAPKDHPWRTMPNHAMTPHISGTTIDAQLRYAAGVKDMLDRYFKGEDFPPQHYIVKEGQLASQYR

SEQ ID NO: 9064 - protein, 278 aa, Cirsium arvense
MHVLITTPFHPAYVTAERIKKAKNLQLLLTAGIGSDHVDLQAAAAAGLTVAEVTGSNVVSVAEDELMRILILVRNFLPGHHQVITGDWNVAGIAYRAYDLEGKTVGTVGCGRIGRLLLQRLKPFGCNLLYHDRIKMDPELENQIGASYEEDLDKMLPKCDIIVINTPLTEKTKGMFDKERIAKLKKGVLIVNNARGAIMDTQAVVDGCSSGHIGGYSGDVWYPQPAPKDHPWRYMPNQAMTPHISGTTIDAQLRYAAGVKDMLENYSREKTSRLNITL

SEQ ID NO: 9065 - protein, 386 aa, Euonymus alatus
MALKRVASSAIRAFGSSSARFDSSITLTRDLHASAGGKKIVGVFYKANEYAKLNPNFLGSAERALGIREWLESQGHEYIVTDDKEGPNSELEKHIPDLHVLISTPFHPAYVTAERIKKAKNLQLLLTAGIGSDHVDLKAAAAAGLTVAEVTGSNVVSVAEDELMRILILVRNFVPGHQQIITGEWNVAGIAYRAYDLEGKTVGTVGAGRIGKLLLQRLKPFNCNLLYHDRLKIDPELETQLGAKFEEDLDDMLAKCDIVVINTPLTEKTRGLFDKARIAKLKKGVLIVNNARGAIMDTQAVVDACSSGHIGGYSGDVWNPQPAPKDHPWRYMPNHALTPHISGTTIDAQLRYAAGTKDMLESYFKGEEFLPQNYIVKDGIIAPQYQ

SEQ ID NO: 9066 - protein, 384 aa, Coffea canephora
MAMKRVAASALRAFTSSGNSTSSLLTRRLHASPGSKKIVGVFYDAKEYAAKNPNFLGCTENALGIRQWLESQGHQYIVTSDKEGPHCELEKHIPDLHVLITTPFHPAYVTAERIKKAKNLQLLLTAGIGSDHVDLKAAADAGLTVAEVTGSNVVSVAEDELMRVLILVRNFVPGHHQVISGDWNVAGIAYRAYDLEGKTVGTVGAGRIGRLLLQRLKPFNCNLLYHDRIKMDPELENQTGAKFEEDLDKMLPKCDIIVINMPLTEKTRGMFDKDRIARLKKGVLIVNNARGAIMDTQAVVDGCSSGQIGGYSGDVWNPQPAPKDHPWRYMPNQAMTPHISGTTIDAQIRYAAGVKDMLDRYFKGEDFPPQHYIVKDGELASQYR

SEQ ID NO: 9067 - protein, 387 aa, Cirsium arvense
MAMKRAAATAIRAISSANSSANSSASILTRHLHASAEKKKIVGVFYKAHEYAEMNPNFLGCAENALGIRNWLESQGHEYIVTDDKEGPDCELEKHISDMHVLITTPFHPAYVTAERIKKAKNLQLLLTAGIGSDHVDLQAAAAAGLTVAEVTGSNVVSVAEDELMRILILVRNFLPGHHQVITGDWNVAGIAYRAYDLEGKTVGTVGCGRIGRLLLQRLKPFGCNLLYHDRIKMDPELENQIGASYEEDLDKMLPKCDIIVINTPLTEKTKGMFDKERIAKLKKGVLIVNNARGAIMDTQAVVDGCSSGHIGGYSGDVWYPQPAPKDHPWRYMPNQAMTPHISGTTIDAQLRYAAGVKDMLENYFKGEDFPAQHYIVKEGELASQYR

SEQ ID NO: 9068 - protein, 388 aa, Euphorbia peplus
MAVRRAGVSAIRALSSSSSSSSPISASILSRHLHASADSKKIVGVFYKANEYASMNPNFVGCAEGGLGIRDWLESQGHQYIATDDKEGPDCELEKHIDDLHVLITTPFHPAYVTAERIKKAKNLQLLLTAGIGSDHIDLNAAAAAGLTVAEVTGSNVVSVAEDELMRILILVRNFLPGYHQVIAGDWNVAGIAYRAYDLEGKTVGTVGAGRIGKLLLQRLKPFNCNLLYHDRLKMDPELENQIGAKFEEDVDAMLPKCDIVVINTPLTDKTMGMFNKERIAKMKKGVLIVNNARGAIMDTQAVADACSSGQIGGYSGDVWYPQPAPKDHPWRHMPNQAMTPHISGTTIDAQLRYAEGVKDMLARYFKGEEFPLQNYIVKEGKLASQYQ

SEQ ID NO: 9069 - protein, 262 aa, Flaveria ramosissima
MLLRGKEDCRCFYKAHEYAQMNPNFLGCVENALGIRNWLESQGHEYIVTDDKEGPDCELEKHIPDAHVIITTPFHPGYITAERIKKAKNLQLLLTAGIGSDHVDLNAAAAAGLTVAEVTGSNVVSVAEDELMRILILVRNFLPGYHQVITGDWNVAGIAYRAYDLEGKTVGTVGCGRIGRLLLQRLKPFGCNLLYHDRIKMDPEMENQIGASFEEDLDKMLPKCDVVVINTPLTDKTKGMFDKERIAKMKKGFSLLTMREEL

SEQ ID NO: 9070 - protein, 262 aa, Flaveria ramosissima
MLLRGKEDCRCFLQAHEYAQMNPNFLGCVENALGIRNWLESQGHEYIVTDDKEGPDCELEKHIPDAHVIITTPFHPGYITAERIKKAKNLQLLLTAGIGSDHVDLNAAAAAGLTVAEVTGSNVVSVAEDELMRILILVRNFLPGYHQVITGDWNVAGIAYRAYDLEGKTVGTVGCGRIGRLLLQRLKPFGCNLLYHDRIKMDPELENQIGASFEEDLDKMLPKCDIVVINTPLTEKTRGMFDKERIAKMKKGFSLLTMPEEL

SEQ ID NO: 9071 - protein, 381 aa, Thalictrum flavum
MALRKAAELGAKSLFRSSSSPFTRNLHASSESKKIVGVFYKANEYASMNPNFVGCAEGALGIRDWLESQGHQYIVTDDKDGPNSELEKHIPDLHVLISTPFHPAYVTAERIKKAKNLQLLLTAGIGSDHIDLKAAAAAGLTVAEVTGSNVVSVAEDELMRILILVRNFVPGYKQVITGDWNVAAIAHRAYDLEGKTVGTVGAGRIGRLLLQRLKPFNCNLLYHDRLQMDSDLESQIGAKFEEDLDAMLPKCDIIVINMPLTEKTAGMFNKEKIAKLKKGVLIVNNARGAIMDTQAVADACSSGHIAGYSGDVWFPQPAPKDHPWRYMPNQAMTPHISGTTIDAQLRYAAGVKDMLDRYFKGEDFPAQHYIVKEGELASQYR

SEQ ID NO: 9072 - protein, 386 aa, Tragopogon dubius
MAMAIAMKRAAAAATRAISSANSGSILTRHLHASSGKKKIVGVFYKAHEYAEMNPNFVGCAENALGIRNWLESQGHEYIVTDDKEGPDCELEKHIPDLHVLITTPFHPAYVTAERIKKAKNLQLLLTAGIGSDHVDLKAAAAAGLTVAEVTGSNVVSVAEDELMRILILVRNFLPGHNQVISGDWNVAGIAYRAYDLEGKTVGTVGCGRIGRLLLQRLKPFGCNLLYHDRIKMDSELENQIGASYEEDLDKMLPKCDIIVINTPLTEKTKGMFDKERIAKLKKGVLIVNNARGAIMDTQAVVDGCNSGHIGGYSGDVWYPQPAPKDHPWRYMPNQAMTPHISGTTIDAQLRYAAGVKEMLENYFKGEEFAPQHYIVKEGELAPQYR

SEQ ID NO: 9073 - protein, 383 aa, Fragaria vesca
MAMKGAIVSAAKALASPRSSSTVLSRHLHASPGSKKIVGVFYKANEYAKLNPDFLGCEENALGIRDWLESQGHKYIVTDDKEGPNCELEKHIEDMHVLITTPFHPAYVTAERIKKAKNLQLLLTAGIGSDHIDLKAAAAAGLTVAEVTGSNTVSVAEDELMRILILMRNFVPGYQQAVNGDWKVAAISYRAYDLEGKTVGTVGAGRIGKLLMQRLKPFNCNILYHDRIKADAEFEKETGAKFEEDLDKMLPKCDVVVVNTPLTEKTRGMFDKERISKLKKGVLIVNNARGAIMDTQAVVDACNSGHIAGYSGDVWNPQPAPKDHPWRYMPNHAMTPHTSGTTIDGQLRYAAGTKDMLDRYFKGEEFPAQNYIVKEGKLASQYQ

SEQ ID NO: 9074 - protein, 384 aa, Chelidonium majus
MAMRKAAAALGSRTLGAGLLYRSPFQRHLHATPGSKKIVGVFYKANEYASMNPNFVGCVEGGLGIRNWLESQGHQYIVTDDKEGPDSELEKHIPDLHVLISTPFHPAYVTAERIKKAKNLQLLLTAGIGSDHIDLKAAAAAGLTVAEVTGSNTVSVAEDELMRILILTRNFLPGYHQVINGEWNVAAIAYRAYDLEGKTVGTVGAGRIGKLLLQRLKPFNCNLLYHDRLKMDPELENQIGAKYEEDVDAMLPKCDILVINTPLTEKTKGMFNKERIAKLKKGVLIVNNARGAIMDAQAVADACSSGHIGGYSGDVWYPQPAPKDHPWRYMPNHAMTPHISGTTIDAQLRYAEGTKDMLDKYFKGEDFPSANYIVKEGQLASQYL

SEQ ID NO: 9075 - protein, 379 aa, Eucalyptus grandis
MAMKHAGVSAIRALCSSPSLTRRVHSTAGSKKIVGVFYKANEYAELNPNFVGTVERGLGIRDWLESQGHQYVVTDDKEGPDCELEKHLSDLHVLITTPFHPAYVTAERIKKAKNLQLLLTAGIGSDHIDLKAAAEAGLTVAEVTGSNVVSVAEDELMRILILVRNFLPGYHQVINGDWNVAGIAHRAYDLEGKTVGTVGAGRIGRLLLQRLKPFNCNLLYHDRVKIDPELEVQTGAKFEEDLDAMLPKCDIIVLNTPLTEKTRGMLDKERISKMKKGVLIVNNARGALVDTQAVADACASGHIGGYSGDVWFPQPAPKDHPWRYMPNQAMTPHISGTTIDAQLRYAAGTKDMLDRYFKGEEFPLQNYIVKEGVLAPQYQ

SEQ ID NO: 9076 - protein, 284 aa, Flaveria ramosissima
MAIKRSAASATRAISSSISKSILTRDLHASSGKKKIVGVFYKAHEYAQMNPNFLGCVENALGIRNWLESQGHEYIVTDDKEGPDCELEKHIPDAHVIITTPFHPGYITAERIKKAKNLQLLLTAGIGSDHVDLNAAAAAGLTVAEVTGSNVVSVAEDELMRILILVRNFLPGYHQVITGDWNVAGIAYRAYDLEGKTVGTVGCGRIGRLLLQRLKPFGCNLLYHDRIKMDPELENQIGASFEEDLDKMLPKGDIVVINTPLTEKTRGMFDKERIAKMKKRGSHC

SEQ ID NO: 9077 - protein, 382 aa, Amorphophallus konjac
MAMRKALAQATQALGSGSAAPLLSRQLHATPGSKKIVGVFYKANEYAAMNPNFVGCVEGSLGIRDWLESQGHQYIVTDDKEGPNSELEKHIEDMHVLITTPFHPAYVSAERIKKAKNLQLLLTAGIGSDHIDLKAAAAAGLTVAEVTGSNVVSVAEDELMRILILVRNFLPGYHQVVKGEWNVAGIAYRAYDLEGKTVGTVGAGRIGKLLLQRLKPFNCNLLYHDRLKMEPELESQLGAKFEADLDAMLPKCDIVVINTPLTEKTRGMFNKERIAKLKKGVLIVNNARGAIMDTQAVADACASGHIAGYSGDVWYPQPAPKDHPWRYMPNHAMTPHISGTTIDAQLRYAAGVKEMLDCYFKGKDFLPQNYIVKEGQLAPQYL

SEQ ID NO: 9078 - protein, 379 aa, Artemisia annua
MAMAFAMKRAATRAISGSIISRHLHASAGPKKIVGVFYKAHEYAEMNPNFVGCVENALGIRKWLESQGHEYIVTDDKEGPDCELEKHIPDAHVIITTPFHPGYITAERIKKAKNLQLLLTAGIGSDHVDLPAAAAAGLTVAEVTGSNVVSVAEDELMRILILVRNFLPGYKQVVNGDWNVAGIAYRAYDLEGKTVGTVGCGRIGRLLLQRLKPFGCNLLYHDRIKMDPELESQTGASFEEDLDKMLSKCDIVVVNTPLTEKTKGLFDKERIAKLKKGVLIVNNARGAIMDTQAVVDGCNSGHIGGYSGDVWYPQPAPKDHPWRYMPNQAMTPHISGTTIDAQLRYAAGVKDMLENYFKGEDFPPQHYIVKKGELASQYR

SEQ ID NO: 9079 - protein, 385 aa, Prunus persica
MAMKGVIASAVRTLASSGSSASSTTFTRHLHASAGSKKIVGVFYKANEYAELNPNFLGCEERALGIKDWLESQGHKYIVTDDKDGPDCELDKHIQDLHVLISTPFHPAYVTAERIKKAKNLQLLLTAGVGSDHIDLKAAAAAGLTVAEVTGSNVVSVAEDELMRILILVRNFVPGYTQIVNGEWKVAGIAHRAYDLEGKTVGTVGAGRIGKLLLQRLKPFNCHLLYHDRFKIDPELEQQIGAKFEEDLDAMLPKCDVIVINTPLTEKTRGLFDKERIAKCKKGVLIVNNARGAIMDTQAVVDASSSGHIAGYSGDVWNPQPAPKDHPWRYMPNHAMTPHISGTTIDAQLRYAAGVKDMLDRYFKGEDFPAQNYIVKDGKIASQYQ

SEQ ID NO: 9080 - protein, 376 aa, Zea mays
MAMWRAAARQLVDRALGSRAAHTSTGSKKIVGVFYKAGEYADKNPNFVGCVEGALGIRGWLESQGHQYIVTDDKEGPNCELEKHIEDMHVLITTPFHPAYVTAERIKKAKNLELLLTAGIGSDHIDLPAAAAAGLTVAEVTGSNTVSVAEDELLRILILLRNFLPGYQQVVQGEWNVAGIAHRAYDLEGKTVGTVGAGRIGRLLLQRLKPFNCNLLYHDRLQIDPELEKEIGAKFEEDLDAMLPKCDVIVINTPLTEKTRGMFNKERIAKMKKGVIVVNNARGAIMDAQAVADACSSGHIAGYGGDVWFPQPAPKDHPWRYMPNHAMTPHISGTTIDAQLRYADGVRDMLDRYFKGEDFPVQNYIVKEGQLASQYQ

SEQ ID NO: 9081 - protein, 377 aa, Brachypodium distachyon
MAMWRAAARQLVDRALVGSRAAHTSAGSKKIVGVFYKAGEYADKNPNFVGCVEGALGIRNWLESKGHQYIVTDDKEGLDSELEKHIEDMHVLITTPFHPAYVSAERIKKAKNLELLLTAGIGSDHIDLPAAAAAGLTVAEVTGSNTVSVAEDELMRILILLRNFLPGYQQVVQGDWNVAGIAHRAYDLEGKTVGTVGAGRIGRLLLQRLKPFNCNLLYHDRLQINPELEKEIGAKFEEDLDAMLPKCDVIVINTPLTEKTRGMFNKEKIAKMKKGVIVVNNARGAIMDTQAVADACSSGHIAGYGGDVWFPQPAPKDHPWRYMPNHAMTPHISGTTIDAQLRYAAGVKDMLDRHFKGEDFPAENYIVKEGELASQYR

SEQ ID NO: 9082 - protein, 387 aa, Taraxacum officinale
MMMAIAMKRAAAAAATRAISSANSGSIFTRHLHASSGKKKIVGVFYKAHEYAEMNPNFVGCAENALGIRNWLESQGHEYIVTDDKEGLDCELEKHIPDLHVLITTPFHPAYVTAERIKKAKNLQLLLTAGIGSDHVDLKAAAAAGLTVAEVTGSNTVSVAEDELMRILILVRNFLPGHHQVISGDWNVAGIAHRAYDLQGKTVGTVGCGRIGRLLLQRLKPFGCNLLYHDRIKMEPELENEIGAEYEEDLDKMLPKCDIIVVNTPLTEKTKGMFDKERIGKLKKGVLIVNNARGAIMDTQAVVDGCNSGHIGGYSGDVWYPQPAPKDHPWRYMPNQAMTPHISGTTIDAQLRYAAGVKDMLENYFKGEEFPPQHYIVKEGELAPQYR

SEQ ID NO: 9083 - protein, 373 aa, Cynara scolymus
  misc_feature (355)..(355): Xaa can be any naturally occurring amino acid
MALAMKRAAATAVRAISSANSASILTRQLHASAEKKKIVGVFYKAHEYAEMNPNFLGCAENALGIRNWLESQGHEYIVTDDKEGPDCELEKHISDMHVLITTPFHPAYVTAERIKKAKNLQLLLTAGIGSDHVDLQAAAAAGLTVAEVTGSNVVSVAEDELMRILILVRNFLPGHHQVISGDWNVAGIAYRAYDLEGKTVGTVGCGRIGRLLLQRLKPFGCNLLYHDRIKMDQELENQIGAKFEEDLDKMLPKCDIIVINTPLTEKTKGMFDKERIAKLKKGVLIVNNARGAIMDTQAVVDGCSSGHIGGYSGDVWYPQPAPKDHPWRYMPNQAMTPHISGTTIDAQLRYAAGVXDMLENYFKGEDFPAHIIL

SEQ ID NO: 9084 - protein, 379 aa, Eucalyptus grandis
MAMKRAGVSAIRALCSSPDLTRGVHSTAGSKKIVGVFYKANEYAELNPNFVGTVERGLGIRDWLESQGHQYVVTDDKEGPDCELEKHLSDLHVLITTPFHPAYLTAERIKKAKNLQLLLTAGIGSDHIDLKAAAEAGLTVAEVTGSNVVSVAEDELMRILILVRNFLPGYHQVINGDWNVAGIAHRAYDLEGKTVGTVGAGRIGRLLLQRLKPFNCNLLYHDRIKIDPELEVQTGAKFEEDLDTMLPKCDIIVLNTPLTEKTRGMLDKERISKLKKGVLIVNNARGALVDTQAVADACTSGHIGGYSGDVWFPQPAPKDHPWRYMPNQAMTPHISGTTIDAQLRYAAGTKDMLDRYFKGEEFPLQNYIVREGVLAPQYR

SEQ ID NO: 9085 - protein, 229 aa, Musa acuminata
MAMLRAAKHAMRSLGSTAPEAAPFSRMLHASPGSKKIVGVFYKANEYASLNPKFVGCVEGSLGIRDWLESQGHQYIVTDDKEGPNCELEKHIHDMHVLITTPFHPAYVTAERIKRAKNLQLLLTAGIGSDHIDLKAAAEAGLTVAEVTGSNVVSVAEDELMRILILVRNFVPGYLQVIKGDWNVAGIAYRAYDLEGKTVGTVGAGRIGKLLLQRLKPFNCNLLYHDRIR

SEQ ID NO: 9086 - protein, 376 aa, Setaria italica
MAMWRAAARQLVDRAIGSRAAHTSAGSKKIVGVFYKAGEYADKNPNFVGCVEGALGIRNWLESQGHHYIVTDDKEGPNCELEKHIEDMHVLITTPFHPAYVTAERIKKAKNLELLLTAGIGSDHIDLPAAAAAGLTVAEVTGSNTVSVAEDELLRILILLRNFLPGYQQVVQGEWNVAGIAHRAYDLEGKTVGTVGAGRIGRLLLQRLKPFNCNLLYHDRLKIDPELEKEIGAKFEEDLDAMLPKCDVIVINTPLTEKTRGMFNKERIAKVKKGVIIVNNARGAIMDTQAVADACSSGHIAGYGGDVWFPQPAPKDHPWRYMPNHAMTPHISGTTIDAQLRYAEGVKDMLDRYFKGEDFPVQNYIVKEGQLASQYQ

SEQ ID NO: 9087 - protein, 376 aa, Sorghum bicolor
MAMWRAAARQLVDRALGSSAAHTSAGSKKIVGVFYKAGEYADKNPNFVGCVEGALGIRGWLESQGHQYIVTDDKEGPNCELEKHIEDMHVLITTPFHPAYVTAERIKKAKNLELLLTAGIGSDHIDLPAAAAAGLTVAEVTGSNTVSVAEDELLRILILLRNFLPGYQQVVQGEWNVAGIAHRAYDLEGKTVGTVGAGRIGRLLLQRLKPFNCNLLYHDRLQIDPELEKEIGAKFEEDLDAMLPKCDVIVINTPLTEKTRGMFNKERIAKMKKGVIIVNNARGAIMDTQAVADACSSGHIAGYGGDVWFPQPAPKDHPWRYMPNHAMTPHISGTTIDAQLRYAEGARDMLDRYFKGEDFPVHNYIVKEGQLASQYQ

SEQ ID NO: 9088 - protein, 376 aa, Saccharum officinarum
MAMWRAAARKLVDRALGSRAAHTSAGSKKIVGVFYKAGEYADKNPNFVGCVEGALGIRGWLESQGHQYIVTDDKEGPNCELEKHIEDMHVLITTPFHPAYVTAERIKKAKNLELLLTAGIGSDHIDLPAAAAAGLTVAEVTGSNTVSVAEDELLRILILLRNFLPGYQQVVQGEWNVAGIAHRAYDLEGKTVGTVGAGRIGRLLLQRLKPFNCNLLYHDRLQIDPELEKEIGAKFEEDLDVMLPKCDVIVINTPLTEKTRGMFNKERIAKMKKGVIVVNNARGAIMDTQAVADACSSGHIAGYGGDVWFPQPAPKDHPWRYMPNHAMTPHISGTTIDAQLRYAEGVRDMLDRYFKGEDFPVHNYIVKEGQLASQYQ

SEQ ID NO: 9089 - protein, 386 aa, Lactuca sativa
MMMAIAMKRAAATAARAISTANSGSILTRHLHASSGKKKIVGVFYKAHEYAEMNPNFVGCAENALGIRNWLESQGHEYIVTDDKEGPDCELEKHIPDLHVLITTPFHPAYVTAERIKKAKNLQLLLTAGIGSDHVDLKAAAAAGLTVAEVTGSNTVSVAEDELMRILILVRNFLPGHHQVISGDWNVAGIAHRAYDLEGKTVGTVGCGRIGRLLLQRLKPFGCNLLYHDRIQMDSELENQIGATFEEDLDKMLPKCDIIVINTPLTEKTKGMFDKERIGKLKKGVLIVNNARGAIMDTQAVVDGCNSGHIGGYSGDVWYPQPAPKDHPWRYMPNQAMTPHISGTTIDAQLRYAAGVKDMLENYFKGEEFPPQHYIVKEGELASQYR

SEQ ID NO: 9090 - protein, 384 aa, Actinidia deliciosa
MAMKRAAASAVRALASSGNSNSSILTRELHTSPGSKKIVGVFYKANEYAAMNPNFLGCVERALGIGDWLKSQGHQYIVTDDKEGPDCELEKHISDMHVLITTPFHPAYVTAERIKKAKNLQLLLTAGIGSDHVDLKAAAAAGLTVAEVTGSNVVSVAEDELMRVLILTRNFLPGYHQVIKGDWNVAAIAHRAYDLEGKTVGTVGAGRIGRLLLQRLKPFNCHLLYHDRIKMDPELENQIGAKFEEDLDVMLPKCDIIVINMPLTEKTKGMFNKERIAKLKKGVLIVNNARGAIMDTQAVVDACSSGHIAGYSGDVWNPQPAPKDHPWRYMPNQAMTPHISGTTIDAQLRYAAGVKDMLDRYFKGEEFPPQHYIVKEGELASQYR

SEQ ID NO: 9091 - protein, 91 aa, Phalaenopsis aphrodite
MDTQAVVDACNSGHIAGYSGDVWNPQPAPKDHPWRYMPNQAMTPHVSGTTIDGQLRYAAGVKDMLDKYFKGEDFPQQNYIVKEGKLASQYL

SEQ ID NO: 9092 - protein, 376 aa, Avena sativa
MAMLRAAGRQLVDRAVGSRAAHTSAGSKKIVGVFYQAGEYADKNPNFVGCVEGALGIRDWLESKGHNYIVTDDKEGMNSELEKHIEDMHVLITTPFHPAYVTAERIKKAKNLELLLTAGIGSDHIDLPAAAAAGLTVAEVTGSNTVSVAEDELMRILILLRNFLPGYQQVVQGEWNVAGIAHRAYDLEGKTVGTVGAGRIGRLLLQRLKPFNCNLLYHDRLQINPELEKEIGAKFEEDLDAMLPKCDVIVINTPLTEKTRGMFNKEKIAKMKKGVIIVNNARGAIMDTQAVADACSSGHVAGYGGDVWFPQPAPKEHPWRYMPNHAMTPHISGTTIDAQLRYAAGVKDMLDRYFKGEDFPAENYIVKEGELASQYK

SEQ ID NO: 9093 - protein, 376 aa, Pennisetum glaucum
MAMWRAAARQLVDRAIGSRAAHTSPGSKKIVGVFYKAGEYADKNPNFVGCVEGALGIRNWLESQGHHYIVTDDKEGPNCELEKHIEDMHVLITTPFHPAYVTAERIKKAKNLELLLTAGIGSDHIDLPAAAAAGLTVAEVTGSNTVSVAEDELLRILILVRNFLPGYQQVVQGEWNVAGIAHRAYDLEGKTIGTVGAGRIGRLLLQRLKPFNCNLLYHDRLKIDRELEKEIGAKFEEDLDAMLPKCDVIVINTPLTEKTRGMFNKERIAKMKKGVIIVNNARGAIMDTQAVADACSSGHIAGYGGDVWFPQPAPKDHPWRYMPNHAMTPHISGTTIDAQLRYAEGVKDMLNRYFKGEDFPVQNYIVKEGQLASQYQ

SEQ ID NO: 9094 - protein, 385 aa, Orobanche aegyptiaca
MKRAAASVVRAFTSSGNPSAPSSILARHIHASVAGSKKIVGVFYKANEYASMNPNFVGCVENALGIREWLESQGHHYIVTPDKDGPDCELDKHIPDLHVLITTPFHPAYVTAERIKNAKNLQLLLTAGIGSDHIDLKAAADAGLTVAEVTGSNVVSVAEDELMRILILVRNFLPGYHQVINGDWNVAAISHRAYDLQGKTVGTVGAGRIGRLLLQRLKPFDCNLLYHDRVKMDTELESEIGAKFEEDLDAMLPKCDVIVINTPLTEKTKGMFDKDRIAKLKKGVLIVNNARGAIMDTQAVVDACSSGHIAGYSGDVWYPQPAPKDHPWRYMPNQAMTPHISGTTIDAQLRYAAGVKDMLERYFKGEDFLAANYIVKDGELASQYR

SEQ ID NO: 9095 - protein, 595 aa, Arabidopsis thaliana
MAMAFPLSYTPTITVKPVTYSRRSNFVVFSSSSNGRDPLEENSVPNGVKSLEKLQEEKRRAELSARIASGAFTVRKSSFPSTVKNGLSKIGIPSNVLDFMFDWTGSDQDYPKVPEAKGSIQAVRNEAFFIPLYELFLTYGGIFRLTFGPKSFLIVSDPSIAKHILKDNAKAYSKGILAEILDFVMGKGLIPADGEIWRRRRRAIVPALHQKYVAAMISLFGEASDRLCQKLDAAALKGEEVEMESLFSRLTLDIIGKAVFNYDFDSLTNDTGVIEAVYTVLREAEDRSVSPIPVWDIPIWKDISPRQRKVATSLKLINDTLDDLIATCKRMVEEEELQFHEEYMNERDPSILHFLLASGDDVSSKQLRDDLMTMLIAGHETSAAVLTWTFYLLTTEPSVVAKLQEEVDSVIGDRFPTIQDMKKLKYTTRVMNESLRLYPQPPVLIRRSIDNDILGEYPIKRGEDIFISVWNLHRSPLHWDDAEKFNPERWPLDGPNPNETNQNFSYLPFGGGPRKCIGDMFASFENVVAIAMLIRRFNFQIAPGAPPVKMTTGATIHTTEGLKLTVTKRTKPLDIPSVPILPMDTSRDEVSSALS

SEQ ID NO: 9096 - protein, 475 aa, Eutrema halophilum
MSFNRNLLNIIIVLCVCLSWDCNEGAQEREKREIDSHTIQLSSLFPSSSSCVLSSRASKTKSSLHVTHRHGTCSRLTSGKAKSPDHVEVLRLDQARVKSIHSKLSKKLTDRVRQSQSTDLPAKDGSTFGSGNYVVTVGIGTPKHDLSLIFDTGSDLTWTQCEPCVRSCYSQKEPIFNPSSSSSYYNVSCSSSACGSLSSATGNAGSCSASNCLYGIQYGDQSFSVGFLAKEKFTLTSSDVFDGLYFGCGENNQGLFTGVAGLLGLGRDKLSFPSQTATTYNKMFSYCLPSSASYTGHLTFGSAGISRSVKYTPISTITDGTSFYGLDIVGITVGGQKLAIPSTVFSTPGALIDSGTVISRLPPKAYAALRSAFKAKMSKYPSTSAVSILDTCFDLTGFKTVTIPKVAFSFSGGAVVELGSKGILYPFKVSQVCLAFAGNSDDNNAAIFGNVQQQTLEVVYDGAGGRVGFAPNGCS

SEQ ID NO: 9097 - protein, 476 aa, Eutrema parvulum
MSFNRKLLNIIIILCVCLIWSCTDGARKLESEEIDSHTIQLSSLFPSSSSPCVLSTRASNIKSSLHVTHRHGTCSPLTSGKATSPDHVEILRLDQARVNSIHSKLSKKLTDRVRQSQSTDLPAKDGSTYGSGNYVVTVGIGTPKHDLSLIFDTGSDLTWIQCQPCVQTCYSQKEPIFNPSSSSSYSNVSCSSAACGSLSSSTGNAGSCSASNCVYGIQYGDQSFSVGFLAKEKFALTSSNVFDGVYFGCGENNQGLFTGVAGLLGLGRDKLSFPSQTATTYSKIFSYCLPSSASYTGHLTFGSAGISKSVKYTPISTITDGTSFYGLDIVGITVGGQKLAIPSTVFSTPGALIDSGTVISRLPPKAYAALRSAFKAKMSQYPNTSAISILDTCFDLSGFKTVTIPKVAFSFSGGAVVELGSKGILYAFKSSKVCLAFAGNSDDNNAAIFGNVQQQTLEVVYDGAAGRVGFAPNGCS

SEQ ID NO: 9098 - protein, 475 aa, Arabidopsis lyrata
MSINRNLLNIIIILCVCLNLGCNEGAQEREIDDSHTIQVSSLFPASSSSCVLSPRASTTKSSLHVTHRHGTCSRLNNGKATSPDHVEILRLDQARVNSIHSKLSKKLTTNHVSQSQSTDLPAKDGSTLGSGNYIVTVGLGTPKNDLSLIFDTGSDLTWTQCQPCVRTCYDQKEPIFNPSKSTSYYNVSCSSAACGSLSSATGNAGSCSASNCIYGIQYGDQSFSVGFLAKDKFTLTSSDVFDGVYFGCGENNQGLFTGVAGLLGLGRDKLSFPSQTATAYNKIFSYCLPSSASYTGHLTFGSAGISRSVKFTPISTITDGTSFYGLNIVAITVGGQKLPIPSTVFSTPGALIDSGTVITRLPPKAYAALRSSFKAKMSKYPTTSGVSILDTCFDLSGFKTVTIPKVAFSFSGGAVVELGSKGIFYAFKISQVCLAFAGNSDDSNAAIFGNVQQQTLEVVYDGAGGRVGFAPNGCS

SEQ ID NO: 9099 - protein, 474 aa, Arabidopsis thaliana
MSINRNLLNIIIILCICLNLGCNDGAQERETDSHTIQVSSLLPSSSSSCVLSPRASTTKSSLHVTHRHGTCSRLNNGKATSPDHVEILRLDQARVNSIHSKLSKKLATDHVSESKSTDLPAKDGSTLGSGNYIVTVGLGTPKNDLSLIFDTGSDLTWTQCQPCVRTCYDQKEPIFNPSKSTSYYNVSCSSAACGSLSSATGNAGSCSASNCIYGIQYGDQSFSVGFLAKEKFTLTNSDVFDGVYFGCGENNQGLFTGVAGLLGLGRDKLSFPSQTATAYNKIFSYCLPSSASYTGHLTFGSAGISRSVKFTPISTITDGTSFYGLNIVAITVGGQKLPIPSTVFSTPGALIDSGTVITRLPPKAYAALRSSFKAKMSKYPTTSGVSILDTCFDLSGFKTVTIPKVAFSFSGGAVVELGSKGIFYVFKISQVCLAFAGNSDDSNAAIFGNVQQQTLEVVYDGAGGRVGFAPNGCS

SEQ ID NO: 9100 - protein, 320 aa, Brassica napus
MCSKMAFALTIPRFHSPISRKPTTTCSSPPSKTQSAHFSHGRSISLRRRLFLLPVKATTDQSGQVGGEEVDSKILPYCSINKNEKRSIGEMEQEFLQAMQSFYYEGKAVMSNEEFDNLKEELMWEGSSVVMLSSDEQRFLEASMAYVSGNPILSDEEYDKLKMKLKMDGSEIVCEGPRCSLRSKKVYSDLAVDYFKMFLLNVPATVVALGLFFFLDDLTGFEITYLLELPEPFSFIFTWFAAVPAIVYLALSLTKLIIRDSLILKGPCPNCGTENTSFFGTILSISNDGSTNNVKCSGCGTAMVYDSSTRLITLPEGGNA

SEQ ID NO: 9101 - protein, 320 aa, Brassica oleracea
MCSKMAFTLTIPRFNSPISRKPTTTCSSPPSKTQSAHFSQGRFISLRRRLFLLPVKATTDQSGQVGGEEVDSKILPYCSINKNEKRSIGEMEQEFLQAMQSFYYEGKAVMSNEEFDNLKEELMWEGSSVVMLSSDEQRFLEASMAYVSGNPILSDEEYDKLKMKLKMDGSEIVCEGPRCSLRSKKVYSDLAVDYFKMFLLNVPATVVALGLFFFLDDLTGFEITYLLELPEPFSFIFTWFAAVPAIVYLALSLTKLIIRDSLILKGPCPNCGTENTSFFGTILSISNDGSTNNVKCSGCGTAMVYDSSTRLITLPEGGNA

SEQ ID NO: 9102 - protein, 320 aa, Unknown
  Sequence found in Organisms: Brassica napus, Brassica rapa
MCSKMAFTLTIPRFHSPVSRKSTTTCSSPPSRTHSAQFSPRRSISLRRRLFLLPVKATTDQSGQVGGEEVDSKILPYCSINKNEKRSIGEMEQEFLQAMQSFYYEGKAVMSNEEFDNLKEELMWEGSSVVMLSSDEQRFLEASMAYVSGNPIMSDEEYDKLKMKLKMDGSEIVCEGPRCSLRSKKVYSDLAVDYFKMFLLNVPATVVALGLFFFLDDLTGFEITYLLELPEPFSFIFTWFAAVPAIVYLALSLTKLIIRDSLILKGPCPNCGTENTSFFGTILSISNDGSTNNVKCSGCGTAMVYDSSTRLITLPEGGNA

SEQ ID NO: 9103 - protein, 322 aa, Raphanus sativus
MCSKMAFTLTIPRFHSPISRKPTTTTTCSSPPSRTQSAHFSHERSISLRRRLFLLPVKATTDQSGQVGGEEVDSKILPYCSINKNEKRSIGEMEQEFLQAMQSFYYEGKAVMSNEEFDNLKEELMWEGSSVVMLSSDEQRFLEASMAYVSGNPIMTDEEYDKLKMKLKMDGSEIVCEGPRCSLRSKKVYSDLAVDYFKMFLLNVPATVVALGLFFFLDDLTGFEITYLLELPEPFSFIFTWFAAVPAIVYLALSLTKLIIRDSLILKGPCPNCGTENTSFFGTILSISNDGSTNNVKCSGCGTAMVYDSSTRLITLPEGGNA

SEQ ID NO: 9104 - protein, 324 aa, Eutrema halophilum
MCSKMAFTLTIPRFYSAISRKPTTCSSSSFSSSPSRPQCAYFSYRRSISLRRRLFLLPVKATTDQSGPVGGEEVDSKILPYCSINKNEKRSLGEMEQEFLQAMQSFYYEGKAIMSNEEFDNLKEELMWEGSSVVMLSSDEQRFLEASMAYVSGNPILSDEEYDKLKMKLKMDGSDIVCEGPRCSLRSKKVYSDLAVDYFKMFLLNVPATVVALGLFFFLDDLTGFEITYLLELPEPFSFIFTWFAAVPAIVYLALSLTKLIIKDFLILKGPCPNCGTENTSFFGTILSISNDGSTNNVKCSGCGTEMVYDSSSRLITLPEGGKA

SEQ ID NO: 9105 - protein, 326 aa, Eutrema parvulum
MCSKMAFTLTFPRFYSANSRKPTTCSSPSPSFSSSLSRTQSAHFSHGRSISLRRRLFLLPVKATTDQSGQVGGEEVDSKILPYCSINKNEKRSLGEMEQEFLQAMQSFYYEGKAIMSNEEFDNLKDELMWEGSSVVMLSSDEQRFLEASMAYVSGNPILNDEEYDKLKMKLKMDGSEIVCEGPRCSLRSKKVYSDLAVDYFKMFLLNVPATVVALGLFFFLDDLTGFEITYLLELPEPFSFIFTWFAAVPAIVYLALSLTKLIIKDFLILKGPCPNCGTENTSFFGTILSISNDGTTNNVKCSGCGTEMIYDSSSRLITLPEGGKA

SEQ ID NO: 9106 - protein, 313 aa, Arabidopsis thaliana
MAFTLTIPRFSAISRKPITCSSSRTQCPAPFTHGRSISLRRRLTLLPLKASTDQSGQVGGEEVDSKILPYCSINKNEKRTIGEMEQEFLQAMQSFYYEGKAIMSNEEFDNLKEELMWEGSSVVMLSSDEQRFLEASMAYVSGNPILSDEEYDKLKMKLKMDGSEIVCEGPRCSLRSKKVYSDLAIDYFKMFLLNVPATVVALGLFFFLDDITGFEITYLLELPEPFSFIFTWFAAVPAIVYLALSLTKLILKDFLILKGPCPNCGTENVSFFGTILSIPNDSNTNNVKCSGCGTEMVYDSGSRLITLPEGGKA

SEQ ID NO: 9107 - protein, 289 aa, Brassica napus
KTQSAHFSQGRFISLRRRLFLLPVKATTDQSGQVGGEEVDSKILPYCSINKNEKRSIGEMEQEFLQAMQSFYYEGKAVMSNEEFDNLKEELMWEGSSVVMLSSDEQRFLEASMAYVSGNPIMSDEEYDKLKMKLKMDGSEIVCEGPRCSLRSKKVYSDLAVDYFKMFLLNVPATVVALGLFFFLDDLTGFEITYLLELPEPFSFIFTWFAAVPAIVYLALSLTKLIIRDSLILKGPCPNCGTENTSFFGTILSISNDGSTNNVKCSGCGTAMVYDSSTRLITLPEGGNA

SEQ ID NO: 9108 - protein, 310 aa, Arabidopsis lyrata
MAFTLTIPRFSAISRKPITCSSSKTAHFTHGRSISLRRRLLLLPLKASTDQSGQVGGEEVDSKILPYCSINKSEKRTIGEMEQEFLQAMQSFYYEGKAIMSNEEFDNLKEELMWEGSSVVMLSSDEQRFLEASMAYVSGNPILSDEEYDKLKMKLKMDGSEIVCEGPRCSLRSKKVYSDLAIDYFKMFLLNVPATVVALGLFFFLDDITGFEITHLLELPEPFSFIFTWFAAVPAIVYLALSLTKLILKDFLILKGPCPNCGTENVSFFGTILSIPNDSNTNNVKCSGCGTEMIYDSGSRLITLPEGGKA

SEQ ID NO: 9109 - protein, 324 aa, Cleome spinosa
MGSKMAFTLTSPRFFSAISRKPTTRFSPSSPTTSKAQWNLFSHGRSVPLRRRLFLLPTKATTDQSGQVGGEEVDDSKILPYCSINKNEKKTIGEMEQEFLQAMQAFYYEGKAVMSNEEFDNLKEELMWEGSSVVMLSSDEQRFLEASMAYVSGNPIMNDEEYDNLKLKLKMDGSEIVVEGPRCSLRSKKVYSDLSVDYFKMFLLNVPATVVALGLFFFLDDLTGFEITYLLELSEPFSFIFTWFAAVPVIVWLALSLTKLIVKDFLILKGPCPNCGTENVSFFGTILSISSGGTNNNVKCANCATEMVYDSKTRLITLPEGGKA

SEQ ID NO: 9110 - protein, 320 aa, Cleome spinosa
MAFTLTSPRFFSSISRKPTTCVSPSSPPSSRAQCSNHFSHGRSGSVSRRLFLLPTKATTDQSGQVGGEEVDGKILPYCSINKNEKKTIGEMEQEFLQAMQAFYYEGKAIMSNEEFDNLKEELMWEGSSVVMLSSDEQRFLEASMAYVSGNPLMNDEEYDKLKLKLKMDGSEIVAEGPRCSLRSKKVYSDLSVDYFKMFLLNVPATVVALGLFFFLDDLTGFEITYLLELSEPYSFIFTWFAAVPLIVWLALSLTKLIVNDFLILKGPCPNCGTENLSFFGTILSISNGGSTNNLKCSNCGTEMVYDSKTRLITLPEGGKA

SEQ ID NO: 9111 - protein, 324 aa, Cleome gynandra
MGSKMAFTLTSPRFFSAISRKPTTCFSPPSPSSSRVQWIHFCHGRSVSIRRRLFLLSIKATTDQSGQVGGEEEVDSKILPYCSIDKNAKRTLGEMEQEFLQAMQAFYYEGKAIMSNEEFDNLKEELMWEGSSVVMLSSDEQRFLEASMAYVSGNPIMSDEEYDKLKLQLKMDGSGIVAEGPRCSLRSKKVYSDLSLDYFKMFLLNVPATVVALGLFFFLDDLTGFEITYLLELPEPFSFIFTWFAAVPFIVWLALSLTKLIVKDFSILKGPCPNCGTENVSFFGTILSISSGGTTNNVKCTNCGTELVYDSKTRLITLPEGGKA

SEQ ID NO: 9112 - protein, 324 aa, Cleome gynandra
MGSKMAFTLTIPRFFSAFSRKPITCFSPSSPLPSRTQWNHVIHGQSVSVRRRLFLLPTQATTDQSGQVGGEEEVDSKILPYCSINKNEKKTLGEMEQEFLQAMQAFYYEGKAIMSNEEFDNLKEELMWEGSSVVMLSSDEQRFLEASMAYVSGKPIMSDEEYDKLKLKLKIDGSDIVVEGPRCSLRSKKVYSDLSVDYFKMFLLNVPATVVALGLFFFLDDLTGFEITYLLELPEPFSFIFTWFAAVPFIVWLSISLTKLIVKDFLILKGPCPNCGTENVSFFGTILSISSGGTSNNVKCTGCGTEMVYDSNTRLITLPEGAKA

SEQ ID NO: 9113 - protein, 324 aa, Eutrema parvulum
MGSKMLFSLTSPRLFSAVSRKPTTSVSPSPPSSSSRTQWAQLSPGRSISLRKRVFLLPAKATTEQSGQVGGEDVDSNIMPYCSINKAEKKSIGEMEQEFLQAMQSFYYDGKAVMSNEEFDNLKEELMWEGSSVVMLSSDEQRFLEASMAYVSGNPILNDQEYDKLKLKLKMDGSEIVCEGPRCSLRSKKVYSDLAVDYFKMLLLNVPATVVALGLFFFLDDVTGFEITYILELPEPFSFIFTWFAAVPLIVYLALSITKLIIKDFVILKGPCPNCGTENVSFFGTILSISSGGKTNAVKCTNCGTALVYDSDSRLITLPEGSQA

SEQ ID NO: 9114 - protein, 324 aa, Brassica juncea
MGSKMLFSLTSPRLFSVVSRKPTTCLSSPSPPSSSRAQWAQVSPGRSISLRKRFFLLPAKATTEQPGQVGGEDVDSNIMPYCSINKAEKKSIGEMEQEFLQALQSFYYDGKAVMSNEEFDNLKEELMWEGSSVVMLSSDEQRFLEASMAYVSGNPILNDEEFDKLKLKLKIDGSEIVCEGPRCSLRSKKVYSDLAVDYFKMLLLNVPATVVALGLFFFLDDITGFEITYILELSEPYSFIFTWFAAVPLIVYLALTITKLIIKDFLILKGPCPNCGTENTSFFGTILSISSGGKTNTVKCTNCGTAMEYDSGSRLITLPEGSQA

SEQ ID NO: 9115 - protein, 320 aa, Brassica rapa
MGSKMLFSLTSPRLFSAVSRKPTASLSSPSPRTQWAQLSPGRSISLRKRFFLLPAKATTEQSGQGGGEDVDSNIMPYCSINKAEKKSIGEMEQEFLQALQSFYYDGKATMSNEEFDNLKEELMWEGSSVVMLSSDEQRFLEASMAYVSGNPILNDEEFDKLKLKLKIDGSEIVCEGPRCSLRSKKVYSDLAVDYFKMLLLNVPATVVALGLFFFLDDITGFEITYILELSEPYSFIFTWFAAVPLIVYLALTITKLIIKDFLILKGPCPNCGTENTSFFGTILSISSGGKTNTVKCTNCGTAMEYDSGSRLITLPEGSQA

SEQ ID NO: 9116 - protein, 320 aa, Brassica napus
MGSNMLFSLTSPRLFSAVSRKPTASLSSPSPRTQWAQLSPGRSISLRKRFFLLPAKATTEQSGQGGGEDVDSNIMPYCSINKAEKKSIGEMEQEFLQALQSFYYDGKATMSNEEFDNLKEELMWEGSSVVMLSSDEQRFLEASMAYVSGNPILNDEEFDKLKLKLKIDGSEIVCEGPRCSLRSKKVYSDLAVDYFKMLLLNVPATVVALGLFFFLDDITGFEITYILELSEPYSFIFTWFAAVPLIVYLALTITKLIIKDFLILKGPCPNCGTENTSFFGTILSISSGGKTNTVKCTNCGTAMEYDSGSRLITLPEGSQA

SEQ ID NO: 9117 - protein, 321 aa, Eutrema halophilum
MGSKTLFSLTSPRLFSAVSRKPTVSFSPPSSSRSQWAQLSPGRSISLRRRFFLLPAKATTEQSGQVEGEEVDSNINAYCSINKAQKKSIGEMEQEFLQALQSFYYDGKAIMSNEEFDNLKDELMWEGSSVVMLSSDEQRFLEASMAYVSGNPILNDEEYDKLKLKLKMDGSDIVCEGPRCSLRSKKVYSDLAVDYFKMLLLNVPATVVALGLFFFLDDITGFEITYILELPEPFSFIFTWFAAVPLIVYLALSITKLIIKDFLILKGPCPNCGTENVSFFGTILTISSGGKTNAVKCSNCGTAMEYDSGSRLITLPEGSQA

SEQ ID NO: 9118 - protein, 320 aa, Brassica napus
MGSKMLFSLTSPRLFSAVSRRPTASLSSPSPRTQWAQLSPGRSISLRKRFFLLPAKATTEQSGQGGGEDVDSNIMPYCSINKAEKKSIGEMEQEFLQALQSFYYDGKATMSNEEFDNLKEELMWEGSSVVMLSSDEQRFLEASMAYVSGNPILNDEEFDKLKLKLKIDGSEIVCEGPRCSLRGKKVYSDLAVDYFKMLLLNVPATVVALGLFFFLDDITGFEITYILELSEPYSFIFTWFAAVPLIVYLALTITKLIIKDFLILKGPCPNCGTENTSFFGTILSISSGGKTNTVKCTNCGTAMEYDSGSRLITLPEGSQA

SEQ ID NO: 9119 - protein, 319 aa, Unknown
  Sequence found in Organisms: Brassica napus, Brassica rapa
MGSKMLFSLTSPRLFSAVSRKPTTSFSSPSSSRTQWAPLSPGRSVPLRKRFFLLPSKATTEQSGQAGGEDVDSNIMPYCSINKAEKKTIGEMEQEFLQAMQSFYYDGKAIMSNEEFDNLKEELMWEGSSVVMLSSDEQRFLEASMAYVSGNPILNDQEFDQLKLKLKMDGSEIVCEGPRCSLRSKKVYSDLAVDYFKMLLLNVPASVVALGLFFFLDDITGFEITYILELSEPFSFIFTWFAAVPLIVYLASSITKLIIKDFLILKGPCPNCGTENVSFFGTILSISSGGKTNNVKCTNCGTAMEYDSGSRLITLPEAS

SEQ ID NO: 9120 - protein, 317 aa, Raphanus sativus
MGSKMLFSLTSPRLFSAVSRKPTTPPCFSSRTQWSQLTPGRSVPLRKRFFLLPAKATTEQSGQVGGEDVDSNIMPYCSINKAEKKSIGEMEQEFLQAMQSFYYDGKAIMSNEEFDNLKEELMWEGSSVVMLSSDEQRFLEASMAYVSGNPILNDEEFDNLKLKLKMDGSEIVCEGPRCSLRSKKVYSDLAVDYFKMLLLNVPASVVALGLFFFLDDITGFEITYILELPEPFSFIFTWFAAVPLIVYLASTITKLIIKDFLILKGPCPNCGTENVSFFGTILSISSGGKTNNVKCTNCGTAMEYDSGSRLITLPEGS

SEQ ID NO: 9121 - protein, 316 aa, Brassica napus
MLFSLTSPRLFSAVSRKPTASLSSPSPRTQWAQLSPGRSISLRKRFFLLPAKATTEQSGQGGGEDVDSNIMPYCSINKAEKKSIGEMEQEFLQALQSFYYDGKATMSNEEFDNLKEELMWEGSSVVMLSSDEQRFLEASMAYVSGNPILNDEEFDKLKLKLKIDGSEIVCEGPRCSLRSKKVYSDLAVDYFKMLLLNVPATVVALGLFFFLDDITGFEITYILELSEPYSFIFTWFAAVPLIVYLALTITKLIIKDFLILKGPCPNCGTENTSFFGTILSISSGGKTNTVKCTNCGTAMEYDSGSRLITLPEGSQA

SEQ ID NO: 9122 - protein, 320 aa, Brassica oleracea
MGSKMLFSLTSPRLFSAVSRKPTASLSSPSPRTQWAQLSPGRSISLRKKFFLLPAKATTEQSGHAGGEDVDSNIMPYCSINKAEKKSIGEMEQEFLQALQSFYYDGKATMSNEEFDNLKEELMWEGSSVVMLSSDEQRFLEASMAYVSGNPILNDEEFDKLKLKLKIDGSEIVCEGPRCSLRSKKVYSDLAVDYLKMLLLNVPATVVALGLFFFLDDITGFEITYILELSEPYSFIFTWFAAVPLIVYLALTITKLIIKDFLILKGPCPNCGTENTSFFGTILSISSGGKTNTVKCTNCGTAMEYDSGSRLITLPEGSQA

SEQ ID NO: 9123 - protein, 318 aa, Brassica juncea
MDSKMLFSLTSPRLFSAVSRKPTASLSSPSPRTQWAQLSPGRSISLRKRFFLLPAKATTEQSGQGGGEDVDSNIMSYCSINKAEKKSIGEMEQEFLQAMQSFYYDGKAIMSNEEFDNLKEELMWEGSSVVMLSSDEQRFLEASMAYVSGNPILNDQEFDQLKLKLKMDGSEIVCEGPRCSLRSKKVYSDLAVDYFKMLLLNVPASVVALGLFFFLDDITGFEITYILELSEPFSFIFTWFAAVPLIVYLASSITKLIIKDFLILKGPCPNCGTENVSFFGTILSISSGGKTNNVKCTNCGTAMEYDSGSRLITLPEAS

SEQ ID NO: 9124 - protein, 324 aa, Arabidopsis thaliana
MGSKMLFSLTSPRLFSAVSRKPSSSFSPSPPSPSSRTQWTQLSPGKSISLRRRVFLLPAKATTEQSGPVGGDNVDSNVLPYCSINKAEKKTIGEMEQEFLQALQSFYYDGKAIMSNEEFDNLKEELMWEGSSVVMLSSDEQRFLEASMAYVSGNPILNDEEYDKLKLKLKIDGSDIVSEGPRCSLRSKKVYSDLAVDYFKMLLLNVPATVVALGLFFFLDDITGFEITYIMELPEPYSFIFTWFAAVPVIVYLALSITKLIIKDFLILKGPCPNCGTENTSFFGTILSISSGGKTNTVKCTNCGTAMVYDSGSRLITLPEGSQA

SEQ ID NO: 9125 - protein, 325 aa, Raphanus sativus
MGSKMLFSLTSPRLFSAVSRKPTTTFLSSPSPSPPPSSSWTQLNPGRSISLRKRFFLLPAKATTEQSGQVGGEDVDSNIMPYCSINKAEKKSIGEMEQEFLQALQSFYYDGKAVMSNEEFDNLKEELMWEGSSVVMLSSDEQRFLEASMAYVSGNPILNDEEFDKLKLKLKIDGSDIVCEGPRCSLRSKKVYSDLAVDYFKMFLLNVPATVVALGLFFFLDDITGFEITYILELSEPYSFIFTWFAAVPLIVYLALTITKLIVKDFLILKGPCPNCGTENTSFFGTILSISSGGKTNSVKCTNCGTAMEYDSGTRLITLPEGSQA

SEQ ID NO: 9126 - protein, 319 aa, Brassica napus
MGSKMLFSLTSPRLFSAVSSKPTTCFSSPSSSRTQWAPLSPGRSVPLRKSFFLLPSKATTEQPGQAGGEDVDSNIMPYCSINKAEKKTIGEMEQEFLQAMQSFYYDGKAIMSNEEFDNLKEELMWEGSSVVMLSSDEQRFLEASMAYVSGNPILNDQEFDQLKLKLKMDGSEIVCEGPRCSLRSKKVYSDLAVDYFKMLLLNVPASVVALGLFFFLDDITGFEITYILELSEPFSFIFTWFAAVPLIVYLASSITKLIIKDFLILKGPCPNCGTENVSFFGTILSISSGGKTNNVKCTNCGTAMEYDSGSRLITLPEAS

SEQ ID NO: 9127 - protein, 320 aa, Arabidopsis lyrata
MGSKMLFSLTSPRLFSAVSLKPTSSFSPSSSRTQWAQLTPAKSISLRRRVFLLPAKATTEQSGTGGGDNVDSNVLPYCSINKAEKKTIGEMEQEFLQAMQSFYYDGKAIMSNEEFDNLKDELMWEGSSVVMLSSDEQRFLEASMAYVSGKPILNDEEYDKLKLKLKIDGSEIVCEGPRCSLRSKKVYSDLAVDYFKMLLLNVPATVVALGLFFFLDDITGFEITYIMELSEPYSFIFTWFAAVPVIVYLALSITKLIIKDFLILKGPCPNCGTENTSFFGTILSISSGGKTNAVKCSNCGTAMVYDSGSRLITLPEGSQA

SEQ ID NO: 9128 - protein, 544 aa, Brassica napus
METNSSGEDLVVKTRKPYTITKQRERWTEEEHNRFLDALRLYGRAWQKIEEHVATKTAVQIRSHAQKFFSKVEKEAEAKGVPVAQTLDIAIPPPRPKRKPNNPYPRKTGTGSLPISKPGLNDGKESLGSGKVSLPETTNEDLQEDNCSDCLTHQHLSAASNASTFLEFLPSREQGNNKESNSANYSEPQTYPRHIPLLVPLGSSITTSLSHAPPSDPDESSHHLHTVSGHHQSFPDHIMSSLLQTPALYTAASFASTFGGGGPQGNLAAMAAATVAAASAWWAANGMLPLCAPFTSGHPPATYEVNAVTKTVDQEHSEASKARSSLDSEEAKNGSKPDCHHHPCAATETDAKGSDGARDRKQVDRSSCGSNTPSSSDDVEADALVERQENGGTTNEEVKEVDGDTTNNPQTSESNARRSRISTSNLADPWKSVSDEGRIAFRALFAREVLPQSFTYKREEGQQQRYPMELDLNSAADDQEENRNIAFLGASKQQLLSRGRTGFKPYKRCSMEAKESRVISNTNPIISVEQKDPKRIRLETQTST

SEQ ID NO: 9129 - protein, 529 aa, Brassica napus
METNSSGEDLVVKTRKPYTITKQRERWTEEEHNRFLDALRLYGRAWQKIEEHVATKTAVQIRSHAQKFFSKVEKEAEAKGVPVAQALDIAIPPPRPKRKPNNPYPRKTGTGSLPISKTGLNDGKESLGSAKVSLPETTNEDNCSDCLTHQHLSAASNASTFREFLPSREQGNNKESNYSDLNIEAGGPHTYPTPIPLLVSLGTRSLSHAPTSQPDENSHQSFPEHIMLTLLQTPALYTAASFASTFGGGPQGNLAAMAAATVAAASAWWAANGMLPLCAPPFSSGNPPTTYEVNALTKTMDQEHSEASKARSSLESEETRNGSKPDCHHHTCAATETDAKGSDGARDRKQVDRSSCGSNTPSSSDDVEADVERQENGGTTNEEVKEVDGDTTNNPQTSESNARRSRISSSILADPWKAVSDEGRIAFRALFAREVLPQSFTYQREEGQQQRYPMELDLNSTADDQEENRNIAFLGASKQQLSRGRTGFKPYKRCSMEAKEGRVINNTNPIISVEQKDPKRIRLETQTST

SEQ ID NO: 9130 - protein, 232 aa, Brassica napus
MDQEHSEASKARSSLGSEETKNGSQPDCHHHTCAATETDAKGSDGARDRKQVDRSSCGSNTPSSSDDVEADALVERQENGGTTNEEVKEVDGDTTNNPQTSESNARRSRISSSILADPWKSVSDEGRIAFRALFAREVLPQSFTYQREEGQQQSYPMELDLNSTADDQEENRNIAFLGASKQQLSRGRTGFKPYKRCSMEAKESRVINNTNPIISVEQKDPKRIRLETQTST

SEQ ID NO: 9131 - protein, 450 aa, Brassica napus
MISQFFVLSQRGDNIVFRDYRAEVPKGSTETFFRKVKFWKEDGNAEAPPIFNVDGVNYFHVKVVGLYFVATTRVNVSPSLVLELLQRIARVIKDYLGVLNEDSFRKNFVLVYELLDEVIDFGYVQTTSTEVLKSYVFNEPILIAPARLQPIDPAAIFTQGSKRMPGTAVTKSVVANDPGGRKREEIFVDIIEKISVTFSSSGYILTSEIDGTIQMKSYLSGNPEIRLALNEDLNIGRGGASVYDYRSSSGSGVILDDCNFHESVRLDSFDSDRTLSLVPPDGEFPVMNYRMTQEFKPPFHVNTLIEEAGRLKAEVIIKIRAEFPSDVVANTITIQMPLPNYTSRASFELELGAAGQKTDFKETSKMLEWSFKKIVGGAEHTLRAKLTFSQEFHGNITKEAGPVSMTFTIPMYNVSKLQVKYLQIAKNSSSQNPYRWVRYVTQANSYVARI

SEQ ID NO: 9132 - protein, 450 aa, Brassica napus
MISQFFVLSQRGDNIVFRDYRAEVPKGSTETFFRKVKFWKEDGNAEAPPIFNVDGVNYFHVKVVGLYFVATTRVNVSPSLVLELLQRIARVIKDYLGVLNEDSFRKNFVLVYELLDEVIDFGYVQTTSTEVLKSYVFNEPILIAPARLQPIDPAAIFTQGSKRMPGTAVTKSVVANDPSGRRREEIFVDIIEKISVTFSSSGYILTSEIDGTIQMKSYLFGNPEIRLALNEDLNIGRGGASVYDYRSSSGSGVILDDCNFHESVRLDSFDSDRTLSLVPPDGEFPVMNYRMTQEFKPPFHVNTLIEEAGRLKAEVIIKIRAEFPSDVVANTITIQMPLPNYTSRASFELELGAAGQKTDFKETSKMLEWSFKKIVGGAEHTLRAKLTFSQEFHGNITKEAGPVSMTFTIPMYNVSKLQVKYLQIAKNSTSQNPYRWVRYVTQANSYVARI

SEQ ID NO: 9133 - protein, 362 aa, Theobroma cacao
MISQFFVLSQRGDNIVFRDYRGEVAKGSAEIFFRKVKFWKEDGQEEAPPVFVGIILLKNNVDGVNYFHVKVVGLLFVATTRVNVSPSLVLELLQRIARVIKDYLGVLSEDSLRKNFVLVYELLDEVIDFGYVQTTSTEVLKSYVFNEPIVVDAARLQPLGPAAIFMQGSKRMPGTAVTKSVVANEPGGRKREEIFVDIIEKISVTFSSSGYILTSEIDGTIQMKSYLTGNPEIRLALNEDLSIGRGGGSVYDYRSSSGAGPVILDDCNFHESVRLDSFDMDRTLALVPPDGEFPVMNYRMTQEFKPPFHINCLIEEAGHLKAEVILKVRAEFPSNITANTVVVQMPLPKYTTRHFPFPIFYT

SEQ ID NO: 9134 - protein, 204 aa, Vinca minor
MISQFFVLSQRGDNIVFRDCRGDVQKGSAEIFFRKVKFWKEDDEEEAPPVFNVDGVNYFHVKVAGLLFVATTRTNTSPSLVLELLQRIARVTKDYLGVLNEDSLRKNFVLVYELLDEVIDFGYVQTTSTEVLKSYVFNEPIVVDASRLPPLGPASLLCKEPKECQGQPSQNLLWQTNQGAEKGRRSLWTLLRKSVSLLALVDIY

SEQ ID NO: 9135 - protein, 450 aa, Euonymus alatus
MISQFFVLSQRGDNIVFRDYRGEVQKGSTEIFFRNVKFWKDGEEDAPPVFNVDGVNYFHVKVAGLLFVATTRINVSPSLVLELLQRIARVIKDYLGILNEDSFRKNFVLVYELLDEVIDFGYVQTTSTEVLKSYVFNEPIVIDAARLPSLGPAGIFMQGSKRMPGTAVTKSVIANEPRGRKREEIFVDVIEKISVTFSSSGYILTSEIDGTIQMKSYLTGNPEIRVALNDDLSIGRNGSSIYGYSASSGSGAVILDDCNFHESVHLDSFDIDRTLSLVPPDGEFPVMNYRMTQEFKPPFRINALVEEARPLKAEVILKVHADFASSVTANTILIQMPVPVYTTRVSFELEPGAVGNSTDFKESSKKLEWGLKKIVGGSEHTLRAKLTFSQEMHGNITKEVGPVSMTFTIPMYNASRLQVKYLQIAKKSKTDNPYRWVRYVTQANSYVARL

SEQ ID NO: 9136 - protein, 100 aa, Glycine max
MISQFFVLSQRGDNIVFRDYRGEVQKGSAEIFFRKVKFWEDGGLQEAPPVFNVDGVNYFHVKVVGLLFVATTRVNTSPSFVLELLQRIARVIKGLPWDSQ

SEQ ID NO: 9137 - protein, 451 aa, Cajanus cajan
MISQFFVLSQRGDNIVFRDYRGEVQKGSAEIFFRKVKFWEDGDLQEAPPVFNVDGVNYFHVKVVGLLFVATTRVNISPSFVLELLQRIARVIKDYLGILNEDSLRKNFVLVYELLDEVIDFGYVQTTSTELLKSYVFNEPLVIDAARLSPLGPSAVFAQGTKRMPGIAVTKSVIATEPGGRKREEIFVDIIEKISITFSSSGYILTSEIDGTIQMKSYLSGNPEIRLALNDDLSIGGSQGSVYGYRSSSGSGTVLLDDCNFHESVRLDSFDMDRTLSLVPPDGEFPVMNYRMTQEFRPPFRINALIEEAGPLKAEVILKVSAEFASSVTANTIKMQMPLPKCTSRVSFELEPGAVGQTTDFKEANKRLEWSLKKIVGGSEHTLRAKLTFSQESHVNITKESGPVSMTFTIPMYNASRLQVKYLQIAKKSATHEPYRWVRYVTQANSYVARL

SEQ ID NO: 9138 - protein, 445 aa, Tripterygium wilfordii
FVLSQRGDNIVFRDYRGEVQKGSTEIFFRNVKFWKDGEEDAPPVFNVDGVNYFHVKVAGLLFVATTRVNVSPSLVLELLQRIARVIKDYLGILNEDSFRKNFVLVYELLDEVIDFGYVQTTSTEVLKSYVFNEPIVIDAARLPSLGPAGIFMQGSKRMPGTAVTKSVIANEPRGRKREEIFVDVIEKISVTFSSSGYILTSEIDGTIQMKSYLTGNPEIRVALNDDLSIGRNGSSIYGYGGSSGSGAVILDDCNFHESVHLDSFDIDRTLSLVPPDGEFPVMNYRMTQEFKPPFRINALVEEAGSLKAEVILKVHADFSSSVTANTILVQMPLPVYTTRVSFELEPGAVGNTTDFKESSKKLEWGLKKIVGGTEHTLRAKLTFSQEMHGNITKEVGPVSMTFTIPMYNASRLQVKYLHIAKKSKTDNPYRWVRYVTQANSYVARL

SEQ ID NO: 9139 - protein, 451 aa, Glycine max
MISQFFVLSQRGDNIVFRDYRGEVQKGSAEIFFRKVKFWEDGGLQEAPPVFNVDGVNYFHVKVVGLLFVATTRVNTSPSFVLELLQRIARVIKDYLGILNEDSLRKNFVLVYELLDEVIDFGYVQTTSTELLKSYVFNEPLVIDAAHLSPLGPAAIFTQGTKRMPGIAVTKSVVATEPGGRKREEIFVDIIEKISITFSSSGYILTSEIDGTIQMKSYLSGNPEIRLALNDDLSIGRSQGPAYGYRSSSDSGTVILDDCNFHESVRLDSFDIDRTLSLVPPDGEFPVMNYRLTQEFRPPFRINALIEEAGSLKAEVILKVSAEFASSVTANTIKVQMPLPKCTSRVSFELEPGAVGQTTDFKEANKRLEWSLRKIVGGSEHTLRAKLTFSQESPVNVTKESGPVSMTFTIPMHNVSRLQVKYLQIAKKSATHEPYRWVRYVTQANSYVARI

SEQ ID NO: 9140 - protein, 451 aa, Panicum virgatum
MISQFFVLSQRGDHIVFRDYRGEVPKGSAEIFFRKVKFWNDDEAEEAPPVFNVDGVNYIHVKVAGLFFVVTTMVNVSPSLLLELLQRIARVTKDYLGVLNEDSLRKNFILVYELLDEVIDFGYPQTTSTEVLKSYIFNEPIMVDAGRLPPLGPAAMFMQGTKRMPGTAVTKSVVANEPGGKKREEIFVDIIERISVTFSSSGYILTSEIDGTIQMKSYLTGNPEIRLALNEDLSIGRTGSSSYDYRSSSSGGAVILDDCNFHESVYLDSFDIDRTLTLIPPDGEFAVMNYRMTQEFKPPFRVTALIEEAGPSRAEVLLKIRADFSANVTANTITIQMPVPSYTMRASFELEAGAVGQTTDFKEGSRRLEWNLKKIVGGSEHTLRAKLTFSQESHGNITKEAGPVNMNFTIPMYNASKLQVRYLQIAKKSKTYNPYRWVRYVTQANSYVARL

SEQ ID NO: 9141 - protein, 450 aa, Setaria italica
MISQFFVLSQRGDHIVFRDYRGEVPKGSAEIFFRKVKFWNDDEAEEAPPVFNVDGVNYIHVKVAGLFFVVTTMVNVSPSLLLELLQRIARVTKDYLGVLNEDSLRKNFILVYELLDEVIDFGYPQTTSTEVLKSYIFNEPIMVDAGRLPPLGPAAMFMQGTKRMPGTAVTKSVVANEPGGKKREEIFVDIIERISVTFSSSGYILTSEIDGTIQMKSYLTGNPEIRLALNEDLSIGRTGSSSYDYRSSSGGAVILDDCNFHESVHLDSFDIDRTLTLIPPDGEFAVMNYRMTQEFKPPFRVTALIEEAGPSRAEVLLKIRADFSANVTANTITVQMPVPSYTMRASFELEAGAVGQTTDFKEGSRRLEWNLKKIVGGSEHTLRAKLTFSQESHGNITKEAGPVNMNFTIPMYNASKLQVRYLQIAKKSKTYNPYRWVRYVTQANSYVARL

SEQ ID NO: 9142 - protein, 451 aa, Brachypodium distachyon
MISQFFVLSQRGDHIVFRDYRGEVPKGSAEIFFRKVKFWNEDEAEEAPPVFNIDGVNYIHVKVAGLYFVVTTMVNISPSLLLELLQRIARVTKDYLGVLNEDSLRKNFILVYELLDEVIDFGYPQTTSTEALKSYIFNEPIMVDAGRMPPLGPAAMFMQGSKRMPGTAVTKSVVANEPGGKKREEIFVDIIEKISVTFSSSGYILTSEIDGTIQMKSYLSGNPEIRLALNEDLGIGRSGSSTHDYRSSSGGGSVVLDDCNFHESVQLDSFDIDRTLHLIPPDGEFPVMNYRMTQEFKPPFRVTALIEEAGPSRAEVLLKIRADFSANVTANTITVQMPVPSYTMRASFELEAGAVGQTTDFKEGSRRLEWNLKKIVGGSEHTLRAKLTFSQESHGNLTKEAGPVNMNFTIPMYNASKLQVRYLQISKKSKTYNPYRWVRYVTQANSYVARL

SEQ ID NO: 9143 - protein, 451 aa, Pennisetum glaucum
MISQFFVLSQRGDHIVFRDYRGEVPKGSAEIFFRKVKFWNDDEAEEAPPVFNVDGVNYIHVKVAGLFFVVTTMVNVSPSLLLELLQRIARVTKDYLGVLNEDSLRKNFILVYELLDEVIDFGYPQTTSTEVLKSYIFNEPIMVDAGRLPPLGPAAMFMQGTKRMPGTAVTKSVVANEPGGKKREEIFVDIIERISVTFSSSGYILTSEIDGTIQMKSYLTGNPEIRLALNEDLSIGRTGSSSYDYRSSSGGGAVVLDDCNFHESVHLDSFDIDRTLTLIPPDGEFAVMNYRMTQEFKPPFRVTALIEEAGPSRAEVLLKIRADFSANVTANTIAVQMPVPSYTMRASFELEAGAVGQTTDFKEGSRRLEWNLKKIVGGSEHTLRAKLTFSQESHGNITKEAGPVNMNFTIPMYNASKLQVRYLQIAKKSKTYNPYRWVRYVTQANSYVARL

SEQ ID NO: 9144 - protein, 691 aa, Flaveria ramosissima
MALCGFAFPANMNHRAIGSHAPVVQHCFFGKDLQHPQSSHKPFNQLSKRVGVVQATMADRGEYHSQRPPTPLLDTINYPIHMKNLSIKELKQLADELRSDVIFNVSKTGGHLGSSLGVVELTVALHYVFNTPQDKILWDVGHQSYPHKILTGRRDRMHTIRQTNGLAGFTKRSESEHDCFGTGHSSTTISAGLGMAVGRDLKGGTNDVVAIIGDGAMTAGQAYEAMNNAGYLDSDMIVILNDNKQVSLPTATLDGPIPPVGALSSALSRLQSNRPLRELREVAKEVTKQIGGPMHELAAKVDEYARGMISGSGSTLFEELGLYYIGPVDGHSIDDLVAILKEVKSTKTTGPVLIHVITEKGRGYPYAEKAADKYHGVAKFDPATGKQFKSSAATQSYTTYFAEALIAEAEVDKKIVGIHAAMGGGTGMNLFHRRFPNRCFDVGIAEQHAVTFAAGLACEGLKPFCAIYSSFLQRGYDQVVHDVDLQKLPVRFAMDRAGLVGADGPTHSGSFDVTYMACLPNMVVMAPSDEAELFHMVATAAAIDDRPSCFRYPRGNGIGAPLPPGNKGVPLEVGKGRILIEGERVALLGYGTAVQSCLVAARLVQERGLNITVADARFCKPLDHNLIRALAKSHEVLITVEEGSIGGFGSHVAHFMALDGLLDGKLKWRPLVLPDRYIDHGAPDDQLAEAG

SEQ ID NO: 9145 - protein, 207 aa, Flaveria ramosissima
MALCGFAFPAYMNHRAIGSHAPVVQHCFFGRDLHHLQSSHKPFNQLSKRVGVVQATMSERGEYHSQRPPTPLLDTINYPIHMKNLSIKELKQLADELRSDVIFNVSKTGGHLGSSLGVVELTVALHYVFNSPQDKILWDVGHQSYPHKILTGRRDRMHTIRQTNGLAGFTKRSESEHDCFGTGHSSTTISAGLGMAVGRDLKGGTTT

SEQ ID NO: 9146 - protein, 357 aa, Fraxinus spp
MAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSGGDAGGAADRVLNQLLTEMDGMNAKKTVFIIGATNRPDIIDPALLRPGRLDQLIYIPLPDEESRLQIFKSCLRKSPLSKDVDLTALAKYTQGFSGADITEICQRAVKYAIRENIEKDIEREKRRSENPEAMEEDVEEEVAEIKPAHFEESMKFARRSVSDADIRKYQAFAQTLQQSRGFGTEFRFAETNAGATGSDPFAASAGAADEDDLYS

SEQ ID NO: 9147 - protein, 432 aa, Brassica rapa
MAESSKVIHVRNVGHEISENDLLQLFQPFGVITKLVMLRAKNQALLQMQDVSSAITALQFFTNVQPTIRGRNVYIQFSSHQELTTAEQNIHGREDEPNRILLVTVHHMLYPITVDVLHQVFSPYGFVEKIVTFQKSAGFQALIQYQAQPCAASARTSLQGRNIYDGCCQLDIQFSNLEELQVNYNNDRSRDYTNPNLPSEQKGRLPHPGYGDAGVAYPQMANTSAIAAAFGGGLPPGITGTNDRCTILVSNLNTDSVDEDKLFNLFSLYGNIVRIKLLRNKPDHALVQMGDGFQAELAVHFLKGAMLFGKRLEVNYSKHPNITPGTDSHDYVNSNLNRFNRNAAKNYRYCCSPTKMIHLSTLPQDVTEEEVVNHVQEHGAILNTKVFEMNGKKQALVQFENEEEAAEALVCKHATSLGGSIIRISFSQLQTI

SEQ ID NO: 9148 - protein, 432 aa, Raphanus sativus
MAESSKVIHVRNVGHEISENDLLQLFQPFGVITKLVMLRAKNQALLQMQDVSSAITALQFFTTVQPTIRGRNVYIQFSSHQELTTAEQNIHGREDEPNRILLVTVHHMLYPITVDVLHQVFSPYGFVEKIVTFQKSAGFQALIQYQAQQCAASARTSLQGRNIYDGCCQLDIQFSNLEELQVNYNNDRSRDYTNPNLPSEQKGRLPHPGYGDAGVAYPQMANTSAIAAAFGGGLPPGITGTNDRCTILVSNLNTDSVDEDKLFNLFSLYGNIVRIKLLRNKPDHALVQMGDGFQAELAVHFLKGAMLFGKRLEVNYSKHPNITPGTDSHDYVNSNLNRFNRNAAKNYRYCCSPTKMIHLSTLPQDVTEEEVVNHVQEHGAILNTKVFEMNGKKQALVQFENEEEAAEALVCKHATSLGGSIIRISFFQLQTI

SEQ ID NO: 9149 - protein, 432 aa, Brassica napus
MAESSKVIHVRNVGHEISENDLLQLFQPFGVITKLVMLRAKNQALLQMQDVSSAITALQFFTNVQPTIRGRNVYIQFSSHQELTTAEQNIHGREDEPNRILLVTVHHMLYPITVDVLHQVFSPYGFVEKIVTFQKSAGFQALIQYQAQPCAASARTSLQGRNIYDGCCQLDIQFSNLEELQVNYNNDRSRDYTNPNLPSEQKGRLPHPGYGDAGVAYPQMANTSAIAAAFGCGLPPGITGTNDRCTILVSNLNTDSVDEDKLFNLFSLYGNIVRIKLLRNKPDHALVQMGDGFQAELAVHFLKGAMLFGKRLEVNYSKHPNITPGTDSHDYVNSNLNRFNRNAAKNYRYCCSPTKMIHLSTLPQDVTEEEVVNHVQEHGAILNTKVFEMNGKKQALVQFENEEEAAEALVCKHATSLGGSIIRISFSQLQTI

SEQ ID NO: 9150 - protein, 432 aa, Eutrema parvulum
MAESSKVIHVRNVGHEISENDLLQLFQPFGVITKLVMLRAKNQALLQMQDVSSAISALQFFTNVQPTIRGRNVYIQFSSHQELTTVEQNIHGREDEPNRILLVTVHHMLYPITVDVLHQVFSPYGFVEKLVTFQKSAGFQALIQYQAQQCAASARTALQGRNIYDGCCQLDIQFSNLEELQVNYNNDRSRDYTNPNLPSEQKGRPSHPGYGDAGVAYPQMANTAAIAAAFGGGLPPGITGTNDRCTILVSNLNADSVDEDKLFNLFSLYGNIVRIKLLRNKPDHALVQMGDGFQAELAVHFLKGAMLFGKRLEVNFSKHPNITPGTDSHDYVNSNLNRFNRNAAKNYRYCCSPTKMIHLSTLPQDVTEEEVVNHVQEHGVIVNTKVFEMNGKKQALVQFENEEEAAEALVCKHATSLGGSVIRISFSQLQTI

SEQ ID NO: 9151 - protein, 432 aa, Eutrema halophilum
MAESSKVIHVRNVGHEISENDLLQLFQPFGVITKLVMLRAKNQALLQMQDVSSAVSALQFFTNVQPTIRGRNVYIQFSSHQELTTIEQNIHGREDEPNRILLVTIHHMLYPITVDVLHQVFSPYGFVEKLVTFQKSAGFQALIQYQAQQCAASARTALQGRNIYDGCCQLDIQFSNLEELQVNYNNDRSRDYTNPNLPSEQKGRSSHPGYGDVGVAYPQMANTAAIAAAFGGGLPPGITGTNDRCTVLVSNLNAESMDEDKLFNLFSLYGNIVRIKILRNKPDHALVQMGDGFPAELAVHFLKGAMLFGKRLEVNFSKHPNITPGTDSHDYVNSNLNRFNRNAAKNYRYCCSPTKMIHLSTLPQDVTEEEVVNHVQEHGVIVNTKVFEMNGKKQALVQFENEEEAAEALVCKHATPLGGSVIRISFSQLQTI

SEQ ID NO: 9152 - protein, 432 aa, Arabidopsis thaliana
MAESSKVVHVRNVGHEISENDLLQLFQPFGVITKLVMLRAKNQALLQMQDVSSAVSALQFFTNVQPTIRGRNVYVQFSSHQELTTIEQNIHGREDEPNRILLVTIHHMLYPITVDVLHQVFSPYGFVEKLVTFQKSAGFQALIQYQVQQCAASARTALQGRNIYDGCCQLDIQFSNLEELQVNYNNDRSRDYTNPNLPAEQKGRSSHPCYGDTGVAYPQMANTSAIAAAFGGGLPPGITGTNDRCTVLVSNLNADSIDEDKLFNLFSLYGNIVRIKLLRNKPDHALVQMGDGFQAELAVHFLKGAMLFGKRLEVNFSKHPNITPGTDSHDYVNSNLNRFNRNAAKNYRYCCSPTKMIHLSTLPQDVTEEEVMNHVQEHGAVVNTKVFEMNGKKQALVQFENEEEAAEALVCKHATSLGGSIIRISFSQLQTI

SEQ ID NO: 9153 - protein, 237 aa, Arabidopsis lyrata
MAESSKVIHVRNVGHEISENDLLQLFQPFGVITKLVMLRAKNQALLQMQDVSSAISALQFFTNVQPTIRGRNVYVQFSSHQELTTIEQNIHGREDEPNRILLVTIHHMLYPITVDVLHQVFSPYGFVEKLVTFQKSAGFQALIQYQVQQCAASARTALQGRNIYDGCCQLDIQFSNLEELQVNYNNDRSRDYTNPNLPAEQKGRSSHPGYGDVGDGKHICDCSGLWRRLASGYNRHK

SEQ ID NO: 9154 - protein, 438 aa, Gossypium hirsutum
MAEASKVIHVRNVGHEISENDLLQLFQPFGVITKLVMLRAKNQALLQMQDIPSAINAMQFYTNVQPTIRGRNVYVQFSSHQELTTMDQNAQGRGDEPNRILLVTIHHMLYPITVEVLHQVFSPHGFVEKIVTFQKSAGFQALIQYQGRQNAISARTSLQGRNIYDGCCQLDIQFSNLDELQVHYNNERSRDFTNPNLPTEQKGRSSQHPGYGDAGVGFPQMANAAAIAAAFGGGLPPGISGTNDRCTVLVSNLNPDRIDEDKLFNLFSLYGNIVRIKLLRNKPDHALVQMGDGFQAELAVHFLKGAMLFGKRLEVNFSKHPNITQGTDTHEYVNSNLNRFNRNAAKNYRYCCSPTKMVHLSTLPQDVTEEEIVNHLAEHGTIVNTKLFEMNGKKQALVMFENEEQATEALVSKHATSLGGSIIRISFSQLQTIRENSQ

SEQ ID NO: 9155 - protein, 101 aa, Ricinus communis
MAEPSKVIHVRNVGHEISENDLLQLFQPFGVITKLVMLRAKNQALLQMQDIPSAINALQFYGNVQPTIRGRNVYVQFSSHQELTTMDQNSQGRADEPNRIF

SEQ ID NO: 9156 - protein, 438 aa, Theobroma cacao
MAEPSKVIHVRNVGHEISENDLLQLFQPFGVITKLVMLRAKNQALLQMQDIPSAINALQFYTNVQPTIRGRNVYVQFSSHQELTTMDQTAQGRGDEPNRILLVTIHHMLYPITVEVLHQVFSPHGFVEKIVTFQKSAGFQALIQYQLRQSAVSARTSLQGRNIYDGCCQLDIQFSNLDELQVHYNNDRSRDFTNPNLPTEQKGRSSQPTGYGDVGVGFPQMANAAAIAAAFGGGLPPGISGTNDRCTVLVSNLNPDRIDEDKLFNLFSLYGNIVRIKLLRNKPDHALVQMGDGFQAELAVHFLKGAMLFGKRLEVNFSKHPNITQGADTHEYVNSNLNRFNRNAAKNYRYCCSPTKMIHLSTLPQDVSEEEIVNHLAEHGTIVNTKLFEMNGKKQALVMFETEEQATEALVSKHASSLGGSIIRISFSQLQTIRENSQ

SEQ ID NO: 9157 - protein, 436 aa, Manihot esculenta
MAELSKVIHVRNVGHEISENDLLQLFQPFGIITKLVMLRAKNQALLQMQDVASAMNALQFYSNVQPTIRGRNVYVQFSSHQELTTMDQNSQGRGDEPNRILLVTIHHMLYPITVEVLHQVFSPHGFVEKIVTFQKSAGFQALIQYQLRQSAVAARTSLQGRNIYDGCCQLDIQFSNLDELQVNYNNDRSRDFTNPHLPSEQKGRSSQAGYGDVGVAYPQMANAAAIAAAFGGGLPPGISGTNDRCTVLVSNLNPDRIDEDKLFNLFSLYGNIVRIKLLHNKPDHALVQMGDGFQAELAVHFLKGAMLFGKRLEVNFSKHPNITQGADTHEYSNSNLNRFNRNAAKNYKYCCSPTKMIHLSTLPQDITEEEIVSHLEDHGAIVNTKLFEMNGKKQALVLFETEEQATEALVCKHASSLAGSIIRISFSQLQSIRETS

SEQ ID NO: 9158 - protein, 437 aa, Populus trichocarpa
MTEPSKVIHVRNVGHEISENDLLQLFQPFGVITKLVMLRAKNQALLQMQDVPSAINALQLYTNIQPTIRGRNVYVQFSSHQELTTMDQNTQGRGDEPNRILLVTIHHMLYPITVEVLHQVFSPHGFVEKIVTFQKSAGFQALIQYQSRQCAVQARTSLQGRNIYDGCCQLDIQFSNLDELQVNYNNDRSRDFTNPNLPSEQKGRSSQQPAYGDVVGYPPQMPNAAAIAAAFGGGLPPGISGTNDRCTVLASNLNPDSIDEDKLFNLFSLYGNIVRIKLLRNKPDHALVQMGDGFQAELAVHFLKGAMLFGKRLEVNFSKHPNITQGADTHEYMNSNLNRFNRNAAKNYRYCCSPTKMIHLSTLPQDITEEEIGNLVEEHGTIVNTKLFEMNGKKQALVLFETEEEATEALVCKHATSLAGSIVRISFSQLQSIRENQ

SEQ ID NO: 9159 - protein, 70 aa, Catharanthus roseus
MTEPSKVIHVRNVGHEISENDLLQLFQPFGVITKLVMLRDKKPGSPSNARCSICCKCIAILYNCSTEYKG

SEQ ID NO: 9160 - protein, 444 aa, Eucalyptus grandis
MTEPSKVIHVRNVGHEISENDLLQLFQPFGVITKLVMLRAKNQALLQMQDIPSAINALQFYANVQPSIRGRNVYVQFSSHQELTTVDQNAQARGDEPNRILLVTIHHMLYPITVEVLQQVFSPYGFVEKIVTFQKSAGFQALIQYQSRQCAIAARTSLQGRNIYDGCCQLDIQFSNLDELQVNYNNERSRDFTNPNLPSEQKGRSSQPGYGDAGSIYALQAGGARAVPFPQMANAAAIAAAFGGGLPPGISGTNDRCTVLVSNLNPDKIDEDKLFNLFSLYGNIVRIKLLRNKPDHALVEMGDGFQAELAVHFLKGAALFGKRLEVNFSKHPSITQGADTHDYMNSNLNRFNRNAAKNYRYCCSPTKMIHLSSLPQEVTEEEIVKHLEEHGPIVNTKVFEMNGKKQALVLFENEEQATEALVCKHASSLAGSIIRISFSQLQEI

SEQ ID NO: 9161 - protein, 438 aa, Euphorbia peplus
MAEPSKVIHVRNVGHEISENDLLQLFQPFGVITKLVMLRAKNQALLQMQDVPSAINALQFYTNVQPTIRGRNVYVQFSSHQELTTMDQNTQGRGDEPNRILLVTIHHMLYPITVEVLHQVFSPHGFVEKIVTFQKSAGFQALIQYELLQSAVAARTSLQGRNIYDGCCQLDIQFSNLDELQVNFNNDRSRDFTNPHLPAEQKGGRSSQQSGYSDVGVAYPQVANAAAIAAAFGGGLPPGISGTNDRCTVLVSNLNPDSVDEDKLFNLFSLYGNIMRIKLLRNKPDHALVQMGDGFQAELAVHFLKGAMLFGKRIEVNFSKHANITQGADTREFVSSSLNRFNRNAAKNYRYCCSPTKMIHLSTLPQDITDEEIVMHLEEHGPIVNTKLFEMNGKKQALVLFETEEQATEALVCKHATSLGGSVIRISFSQLQSIRENS

SEQ ID NO: 9162 - protein, 430 aa, Arachis hypogaea
MAEPSKVIHVRNVGHEISENDLLQLFQPFGVITKLVMLRAKNQALVQMQDVASAVNSLQFYANVQPSIRGRNVYVQFSSHQELTSMDQNQGRGDEPNRILLVTIHHMMYPITVDVLYQVFSPHGSVEKIVTFQKSAGFQALIQYQSRQHAVVARSTLQGRNIYDGCCQLDIQFSNLDELQVNYNNDRSRDFTNPNLPTEQKGRPSQPGYGDTVGYPQMANAAAIAAAFGGGLPPGVTGTNDRCTILVSNLNPDRIDEDKLFNLFSIYGNIVRIKLLRNKPDHALIQMGDGFQAELAVHFLKGATLFGKRLEVNFSKHPNITPGADTHEYANSNLNRFNRNAAKNYRYCCSPTKIIHLSTLPQDVTEDEILNLLEEHGTIVNSKVFEMNGKKQALVQFETEELATDALVCKHASSLSGSVIRISFSQLQNI

SEQ ID NO: 9163 - protein, 436 aa, Populus trichocarpa
MTEPSKVIHVRNVGHEISENDLLQLFQPFGVITKLVMLRAKNQALLQMQDVPSAINALQYYTDVQPTIRGRNVYIQFSSHQELTTMDQNTQGRGEEPNRILLITIHHMQYPITVDVLHQVFSPHGFVEKMVTFQKSAGFQALIQYQSRQSAVQARTSLQGRNIYDGCCQLDIQFSNLDELQVNYNNDSSRDFTNPNLPSEQKARSSQQPSYGDVVGYPQMPNAAAIAAAFGGGLPPGISGTNDRCTILVSNLNPDRIDEDKLFNLFSLYGNIVRIKLLRNKPDHALVQMGDGFQAELAVHFLKGAMLFGKRMEVNFSKHPNITQGADTHEYMHSNLNRFNRNAAKNYRYCCSPTKMIHLSTLPQVITEDEIVSLVEEHGTVVNTKLFEMNGKKQALVLFETEEEATEALVCKHATSLAGSIVRISFSQLQSIRENQ

SEQ ID NO: 9164 - protein, 446 aa, Unknown
  Sequence found in Organisms: Citrus sinensis, Citrus sinensis
MTEPSKVIHVRNVGHEISENDLLQLFQPFGVITKLVMLRAKNQALLQMQDVPSAINALQFYTNVQPTIRGRNVYVQFSSHQELTTMEQNAQGRGDEPNRILLVTIHHMLYPITVEVLHQVFSPHGFVEKIVTFQKSAGFQALIQYQLRPSAVVARSSLQGRNIYDGCCQLDIQFSNLDELQVNYNNERSRDFTNPNLPAEQKGRPSQSGYSEAGGMYAPGARAVAFPQMANAAAIAAAFGGGLPPGITGTNDRCTVLVSNLNSDRIDEDKLFNLFSLYGNIIRIKLLRNKPDHALVQMGDGFQAELAVHFLKGALLFGKRLEVNFSKHPNITQGADTHEYMNSNLNRFNRNAAKNYRYCCSPTKMIHLSTLPQDVTEEEIVSHLEEHGSIVNTKLFEMNGKKQALVLFETEEQATEALVCKHASSLGGSIIRISFSQLQSIRENSQ

SEQ ID NO: 9165 - protein, 446 aa, Citrus clementina
MTEPSKVIHVRNVGHEISENDLLQLFQPFGVITKLVMLRAKNQALLQMQDVPSAINALQFYTNVQPTIRGRNVYVQFSSHQELTTMEQNAQGRGDEPNRILLVTIHHMLYPITVEVLHQVFSPHGFVEKIVTFQKSAGFQALIQYQLRPSAVVARSSLQGRNIYDGCCQLDIQFSNLDELQVNYNNERSRDFTNPNLPAEQKGRPSQSGYSEAGGMYAPGARAVAFPQMANAAAIAAAFGGGLPPGITGTNDRCTVLVSNLNSDRIDEDKLFNLFSLYGNIIRIKLLRNKPDHALVQMGDGFQAELAVHFLKGALLFGKRLEVNFSKHPNITQGADTHEYMNSNLNRFNRNAAKNYRYCCSPTKMIHLSTLPQDVTEEEIVSHLEEHGTIVNTKLFEMNGKKQALVLFETEEQATEALVCKHASSLGGSIIRISFSQLQSIRENSQ

SEQ ID NO: 9166 - protein, 444 aa, Arachis hypogaea
MAEPSKVIHVRNVGHEISENDLLQLFQPFGVITKLVMLRAKNQALLQMQDVPSAISALQFYANVQPSIRGRNVYVQFSSHQELTTMDQNQGREDEPNRILLVTIHHMLYPITVDVLHQVFSPHGYVEKIVTFQKSAGFQALIQYQSRQSAVTARSTLQGRNIYDGCCQLDIQFSNLDELQVNYNNDRSRDFTNPNLPTEQKGRSSQPGYGDAGSMYGVQGSGGRGAGGYSQMANAAAIAAAFGGGLPPGITGTNDRCTILVANLNPDRIDEDKLFNLFSIYGNIVRIKLLRNKPDHALIQMGDGFQAELAVHFLKGAMLFGKRLEVNFSKHPNITQGAETHEYVNSNLNRFNRNAAKNYRYCCSPTKMIHLSTLPQDITEEDIVSLVEEHGTIVNSKVFEMNGKKQALVQFETEEQATEALVCKHASPLSGSVIRISFSQLQNI

SEQ ID NO: 9167 - protein, 439 aa, Cajanus cajan
MAEPSKVIHVRNVGHEISENDLLQLFQPFGVITKLVMLRAKNQALLQMQDIPSAVNALQFYANVQPSIRGRNVYVQFSSHQELTTMDQNQAREDEPNRILLVTVHHMLYPITADVLHQVFSPHGYVEKIVTFQKSAGFQALIQYQSRQSAVTARSTLQGRNIYDGCCQLDIQFSNLDELQVNYNNDRSRDFTNPNLPTEQKGRSSQPGYGDAGPMYSGARAGGFSQMANAAAIAAAFGGGLPPGITGTNERCTILVANLNPDRIDEDKLFNLFSIYGNIVRIKLLRNKPDHALIQMGDGFQAELAVHFLKGAMLFGKRLEVNYSKHANITQGADTHEYANSNLNRFNRNAAKNYRYCCSPTKMIHLSTLPQDITEEEIVSLLEEHGTIVNSKVFEMNGKKQALVQFETEEQATEALVCKHASPLSGSVVRISFSQLQNI

SEQ ID NO: 9168 - protein, 439 aa, Glycine max
MAEPSKVIHVRNVGHEISENDLLQLFQPFGVITKLVMLRAKNQALLQMQDIPSAVNALQFYANVQPSIRGRNVYVQFSSHQELTTMDQNQAREDEPNRILLVTVHHMLYPITADVLHQVFSPHGFVEKIVTFQKSAGFQALIQYQSRQSAVTARSTLQGRNIYDGCCQLDIQFSNLDELQVNYNNDRSRDFTNPNLPTEQKGRSSQPGYGDAAGMYSGARAGGFSQMANAAAIAAAFGGGLPPGITGTNERCTVLVANLNPDRIDEDKLFNLFSIYGNIVRIKLLRNKPDHALIQMGDGFQAELAVHFLKGAMLFGKRLEVNYSKHANITQGADTHEYVNSNLNRFNRNAAKNYRYCCSPTKMVHLSTLPQDITEEEVVSLLEEHGTIVNSKVFEMNGKKQALVQFETEEQATEALVCKHASPLSGSVVRISFSQLQNI

SEQ ID NO: 9169 - protein, 446 aa, Euonymus alatus
MTEPSKVIHVRNVGHEISENDLLQLFQPFGVISKLVMLRAKNQALLQMQDIPSAISALQFYANVQPTIRGRNVYVQFSSHQELTTMEQNSQGRGDEPNRILLVTVHHMLYPITVEVLHQVFSPYGFVEKVVTFQKSAGFQALIQYEVRQSAVSARTSLQGRNIYDGCCQLDIQFSNLDELQVNYNNDRSRDFTNPNLPSEQKGRSSHPGYSDAGGMYPANGATAAAFSQMANAAAIATAFGGGLPPGISGTNDRCTLLVSNLNSDRIDEDQLFNLFSLYGNIVRIKILRNKPDHALVQLGDGFQAELAVHFLKGAMLFGKHLEVNFSKHPNITQGADTHEYMNSNLNRFNRNAAKNYKYCCSPTRMIHLSTLPQDITEEDIVSHLEEHGTITNAKVFEMNGKKQALVQFETEEQATEALVCKHASSLGGSIIRISFSQLQEIKENS

SEQ ID NO: 9170 - protein, 444 aa, Prunus persica
MTEPSKVIHVRNVGHEISENDLLQLFQPFGVITKLVMLRAKNQALIQMQDTPAAVSALQFYGNVQPAIRGRNVYVQFSSHQELTTMYQNAQGRGDEPNRILLVTIHHMLYPITVEVLHQVFFPHGFVEKIVTFQKSAGFQALIQYQSRQSAVAARTALQGRNIYDGCCQLDIQFSNLDELQVNYNNERSRDFTNPNLPSEQKGRSPQPGYGDAGGVYGLQGTGARAVGFPQMANAAAIAAAFGGGLPPGISGTNDRCTVLVSNLNPDKIDEDKLFNLFSIYGNIVRIKLLRNKPDHALVQMGDGFQSELAVHFLKGAILFGKRLEVNFSKHPNITQGADTHEYMNSNLNRFNRNAAKNYRYCCSPTKMIHLSSLPQEVTEEEIVNHLEEIGTIVNTKLFEMNGKKQALVLFETEEQATEALVCKHATSLGGSIIRISFSQLQGI

SEQ ID NO: 9171 - protein, 424 aa, Manihot esculenta
MTEPSKVIHVRNVGHEISENDLLQLFQPFGVITKLVMLRSKNQALLQMQDIPSAINALQFYSNVQPTIRGRNVYVQFSSHQELTTMDQNSQGLGDEPNRILLVTIHHMLYPITVEVLHQVFSPHGFVEKIVTFQKSAGFQALIQYQLCQSAVAARTALQGRNIYDGCCQLDIQFSNLDELQVNYNNDRSRDFTNPHLPSEQKGRTSQMANATAIAAAFGGGLPPGISGTNDRCTVLVSNLNLDRVDEDKLFNLFSLYGNIVRIKFLRNKPDHALVQMGDGFQAELAVHFLKGAMLFGKRLEVNFSKHPNITQGADTHEYSNSNLNRFNRNAAKNYRYCCSPTKMIHLSTLPQDISEEEIVSHLEEHGTIVNTKLFEMNGKKQALVLFETEEQATEAVVCKHASSLAGSIIRISFSQLQSIRETS

SEQ ID NO: 9172 - protein, 439 aa, Glycine max
MAEPSKVIHVRNVGHEISENDLLQLFQPFGVITKLVMLRAKNQALLQMQDIPSAVNALQFYANVQPSIRGRNVYVQFSSHQELTTMDQNQAREDEPNRILLVTVHHMLYPITADVLHQVFSPHGFVEKIVTFQKSAGFQALIQYQSRQSAVTARSTLQGRNIYDGCCQLDIQFSNLDELQVNYNNDRSRDFTNPNLPTEQKGRSSQPGYGDAGGMHSGARAGGFSQMANAAAIAAAFGGGLPPGITGTNERCTVLVANLNPDRIDEDKMFNLFSIYGNIVRIKLLRNKPDHALIQMGDGFQAELAVHFLKGAMLFGKRLEVNYSKHANITQGADTHEYANSNLNRFNRNAAKNYRYCCSPTKMIHLSTLPQDITEEEIVSLLEEHGTIVNSKVFEMNGKKQALVQFETEEQATEALVCKHASPLSGSVVRISFSQLQNI

SEQ ID NO: 9173 - protein, 447 aa, Euonymus alatus
MAEPSKVIHVRNVGHEISENDLLQLFQPFGVISKLVMLRAKNQALLQMQDIPSTISALQFYANVQPTIRGRNVYVQFSSHQELTTMEQNSQGRGDEPNRILLVTVHHMLYPITVEVLHQVFSPHGFVEKIVTFQKSAGFQALIQYQVRQSAVSARTSLQGRNIYDGCCQLDIQFSNLDELQVNFNNDRSRDFTNPNLPSEQRGRSSHQSGYSDAGSMYPANGATSAAFSQMANAAAIAAAFGGGLPPGISGTNDRCTVLVSNLNCDRIHEDKPFNLFSLYGNILRIKLLRNKPDHALVQLGDGFQAELAVHFLKGAMLFGKRLEVNFSKHPNITQGADTHEYMNSNLNRFNRNAAKNYKYCCSPTRMIHLSTLPQDITEEEIVSNLEEHGTITNTKLFEMNGKKQALVQFETEEQATEALVCKHASSLGGSIIRISFSQLQEIRENS

SEQ ID NO: 9174 - protein, 437 aa, Ricinus communis
MAEPSKVIHVRNVGHEISENDLLQLFQPFGVITKLVMLRAKNQALLQMQDIPSAINALQFYGNVQPTIRGRNVYVQFSSHQELTTMDQNSQGRADEPFVLAVRFKSNFDGINIIVEVLHQVFSPHGFVEKIVTFQKSAGFQALIQYQLRQSAVAARTALQGRNIYDGCCQLDIQFSNLDELQVNYNNDRSRDFTNPHLPAEQKGRSSQAGYGDAGVAYPQMANAAAIAAAFGGGLPPGISGTNDRCTVLVSNLNPDKIDEDKLFNLFSLYGNIVRIKLLRNKPDHALVQMGDGFQAELAVHFLKGAVLFGKRLEVNFSKHPNITQGADTHEYVNSNLNRFNRNAAKNYRYCCSPTKMIHLSTLPQDITEEEIVSHLEEHGTIVNTKLFEMNGKKQALVLFETEEQATEALVCKHAISVAGSIIRISFSQLQSIRESS

SEQ ID NO: 9175 - protein, 248 aa, Medicago truncatula
MAEPSKVIHVRNVGHEISENDLLQLFQPFGVITKLVMLRAKNQALIQMQDVPSAVSALHFYGNTQPSIRGRNVYVQFSSHQELTTIDQSQGRGDEPNRILLVTIHHVLYPITVDVLYQVFSPHGSVEKIVTFQKSAGFQALIQYQSQQSSITARTALQGRNIYDGCCQLDIQFSNLDELQVNYNNDRSRDFTNPNLPTEQKGRPPQLGYGDAGNMYGVQGSGPRTDAQCCGHCSCFWGRFASWNNWDK

SEQ ID NO: 9176 - protein, 443 aa, Glycine max
MTEPSKVIHVRNVGHEISENDLLQLFQPFGVITKLVMLRAKNQALIQMQDVPSAVNALQFYANVQPSIRGRNVYVQFSSHQELTTMEQSQGRGDEPNRILLVTVHHMLYPMTVDVLYQVFSPHGSVEKIVTFQKSAGFQALIQYQSRQSAVAARSTLQGRNIYDGCCQLDIQFSNLDELQVNYNNDRSRDFTNPNLPTEQKGRPSQPGYGDAGNMYAAQGSGARAVGFPQMANAAAIAAAFGGGLPPGITGTNDRCTVLVSNLNPDRIDEDKLFNLFSIYGNIVRIKLLRNKPDHALIQMGDGFQAELAVHFLKGAMLFEKRLEVNFSKHPNITQGADTHEYINSNLNRFNRNAAKNYRYCCSPTKMIHLSTLPQDITEEEIVSLVEEHGTIVNSKVFEMNGKKQALVQFGNEEQATEALVCKHASTLSGSVIRISFSQLQNI

SEQ ID NO: 9177 - protein, 445 aa, Fragaria vesca
MTEPSKVIHVRNVGHEISENDLLQLFQPFGVITKLVMLRAKNQALIQMQDTAAAVSALQFYANVQPAVRGRNVYVQFSSHQELTTMYQNAQGRGDEPNRILLVTVHHMLYPITVEVLHQVFFPHGFVEKIVTFQKSAGFQALIQYQSRQSAVAARTALQGRNIYDGCCQLDIQFSNLDELQVNYNNERSRDFTNPNLPSEQKGRSPQPGYGDAGGGMYGVQATGARTVGFPQMANAAAIAAAFGGGLPPGISGTNDRCTVLVSNLNPDRIDEDMLFNLFSIYGNIVRIKLLRNKPDHALVQMGDGFQAELAVHFLKGAILFGKRLEVNFSKHPNITQGADTHEYMNSNLNRFNRNAAKNYRYCCSPTKMIHLSSLPQEVAEDEIVTHLEEIGTIVNTKLFEMNGKKQALVLFETEEQATEALVCKHATSLGGSIIRISFSQLQAI

SEQ ID NO: 9178 - protein, 443 aa, Quercus alba
MTEPSKVIHVRNVGPEISENDLLQLFQPFGVITKLVMLRAKNQALIQMQDIPSAVNALQFYANVQPSIRGRNVYVQFSSHQELTTMDQNTQGRGDEPNRILLVTIHHMLYPITVDVLHQVFSPHGFVEKIVTFQKSAGFQALIQYQSRQSAVVARTALQGRNIYDGCCQLDIQYSNLDELQVNYNNERSRDFTNPNLPTEQKGRSSQPGYGDAGGMYALQATGRAVPFPQMANTAAIAAAFGGGLPPGISGTNDRCTVLVSNLNPDRIDEDKLFNLFSLYGNIVRIKLLRNKPDHALIQMGDGLQAELAVNFLKGAMLFEKPMEVNFSKHPNITQGADTHEYINSNLNRFNRNAQKNYRYCCSPTKMIHLSTLPQDLTEEEIVSHLEEHGTIVNTKLFEMNGKKQALVLFETEEQATEALVCKHATSVSGSIIRISFSQLQAI

SEQ ID NO: 9179 - protein, 443 aa, Cajanus cajan
MTEPSKVIHVRNVGHEISENDLLQLFQPFGVITKLVMLRAKNQALVQMQDVPSAVNALQFYANIQPSIRGRNVYVQFSSHQELTTMDQSQGRGEEPNRILLVTIHHMLYPITVDVLYQVFSPHGSVEKIVTFQKSAGFQALIQYQSHQSAVMARSTLQGRNIYDGCCQLDIQFSNLDELQVNYNNDRSRDFTNPNLPTEQKGRPSQPGYGDGGNMYAAQGSGARTAGFPQMGNSAAIAAAFGGGLPPGITGTNDRCTILVSNLNPDRIDEEKLFNLFSIYGNIVRIKLLRNKPDHALIQMGDGFQAELAVHFLKGAMLFEKRLEVNFSKHPNITQGADTHEYVNSNLNRFNRNAAKNYRYCCSPTKMIHLSTLPQDITEEEIVSLVEEHGTITNSKVFEMNGKKQALVQFENEEQATEALVCKHASTLSGSVIRISFSQLQNI

SEQ ID NO: 9180 - protein, 444 aa, Trigonella foenum-graecum
MTEPSKVIHVRNVGHEISENDLLQLFQPFGVVTKLVMLRAKNQALIQMQDVPSAISALQFYGNSQPSIRGRNVYVQFSSHQELTTMDQSQGRGDEPNRILLVTIHQVLYPITVDVLYQVFSPHGSVEKIVTFQKSAGFQALIQYQSQQSSITARTALQGRNIYDGCCQLDIQFSNLDELQVNYNNDRSRDFTNSNLPTEQKGRPPQLGYGDAGNMYGVQGSGPRAVGYPQMPNAAAAIAAAFGGGLPPGITGTNDRCTLLVSNLNPDRIDEDKLFNLFSLYGNIVRIKLLRNKPDHALIQMGDGFQAELAVHFLKGAMLFDKRLEVNFSKHPNITQGADTHDYSNSNLNRFNRNAAKNYRYCCSPTKMIHLSTLPQDITEEEIVTLLEEHGTIVNSKVFEMNGKKQGLVQFETEDQATEALVCKHATSLSGSIIRISYSQLQNI

SEQ ID NO: 9181 - protein, 445 aa, Eucalyptus grandis
MAEASKVIHIRNVGHEISENDLLQLFQPFGVITKLVMLRAKNQALLQMQDVPSAINAMQVYSNVQPTIRGRNVYVQFSSHQELTTVDQNTQGRGDEPNRIVLVTIHHMLYPITVEVLHQVFSPYGFVEKIVTFQKSAGFQALIQYQSRQSAVSAITALQGRNIYDGCCQLDIQYSNLDELQVNFNNERSRDFTNPNLPAEQRGRSSQQAGYGDAGGMYPFPASGASTVAFPQVPNAAAIAAAFAGGLPPGVSGTNDRCTVLVSNLNPDGIDEDKLFNLFSLYGNIVRIKLLRNKPDHALVQMGDGFQAELAVHFLKGAMLFGKRLEVNFSKHPNITPGAETHEYSNSNLNRFNRNAAKNYRYCCSPTKMIHLSTLPQEITEEEIVTLLEEHGAIVSTKVFEMNGKKQALVMFETEEQATEALVCKHASSVAGSIIRISFSQLQAI

SEQ ID NO: 9182 - protein, 443 aa, Glycine max
MTEPSKVIHVRNVGHEISENDLLQLFQPFGVITKLVMLRAKNQALIQMQDVPSAVNALQFYANVQPSIRGRNVYVQFSSHQELTTMDQSQGRGDEPNRILLVTVHHMLYPMTVDVLYQVFSPHGSVEKIVTFQKSAGFQALIQYQSRQSAVAARSTLQGRNIYDGCCQLDIQFSNLDELQVNYNNDRSRDFTNPNLPTEQKGRPSQPGYGDAGNMYAAQGSGARAVGFPQMANAAAIAAAFGGGLPPGITGTNDRCTVLVSNLNPDRIDEDKLFNLFSIYGNIMRIKLLRNKPDHALIQMGDGFQAKLAVHFLRGAMLFEKRLEVNFSKHPKITPGADTHEYISSNLNRFNRNAAKNYRYCCPPTKMIHLSTLPLDITEEEIVSLVEEHGIIVNSKVFEMNGKKQALVQFENEEQATEALVCKHASTLSGSVIRISFSQLQNI

SEQ ID NO: 9183 - protein, 453 aa, Cannabis sativa
MAEPPKVIHVRNVGHEISENDLLQLFQPFGVITKLVMLRAKNQALIQMQDVASAVNALQYYANVQPAIRGRNVYVQFSSHPELTTMDQNAQGRGDEPNRILLVTIHHMLYPITVEVLHQVFFPHGFVEKIVTFQKSAGFQALIQYQSRQSAVAARTTLQGRNIYDGCCQLDIQFSNLDELQVNYNNERSRDFTNPNLPSEQKGRPSQPGYGDAGGMYGMQPSGTRGVPFPQMANAAAIAAAFGGGLPPGISGTNDRCTVLVSNLNPDRIDEDKLFNLFSIYGNIVRIKLLRNKPDHALVQMGDGFQAELAVHFLKGAMLFGKRLEVNFSKHPNITQGADTHEYMNSNLNRFNRNAAKNYRYCCSPTKIIHLSSLPQDVTEEEIVNHLEEHSPIVNTKLFEMNGKKQALVMFESEELATEALVTKHASSLGGSIIRISFSQLQTYKRKLVALEK

SEQ ID NO: 9184 - protein, 442 aa, Lotus japonicus
MTEPSKVIHVRNVGHEISENDLLQLFQPFGVITKLVMLRAKNQALLQMDDVSSAVTAIQFYANMQPSIRGRNVYVQFSSHQELTTVDQSQGRGDEPNRILLVTIHHMLYPMTVDVLYQVFSPHGSVEKIVTFQKSAGFQALIQYQSRQSAVTARSALQGRNIYDGCCQLDIQFSNLDELQVNYNNDRSRDFTNPNLPTEQKGRPSQPGYGDGGNMYPAQGSGARGGGIKYLNCFTIAAAFGGGLPPGITGTNDRCTILVSNLNPDRVDEDKLFNLFSIYGNIVRIKLLRNKPDHALIQMGDGFQAELAVHFLKGAILFGKPLEVNFSKHATITQGADTHEYSNSNLNRFNRNAAKNYRYCCSPTRMIHLSTLPQDVTEEEIASLVEEHGTIVNCKVFEMNQKKQALVQFETEEQATEALVCKHATSLSGSVIRISFSQLQNI

SEQ ID NO: 9185 - protein, 441 aa, Solanum lycopersicum
MSDPSKVVHVRNVGHEISENDLLQLFQPFGVITKLVMLRAKNQALLQMQDVPSAVKALQFYLNVQPSIRGRNVYVQFSSHQELTTMDQNVQGRGDEPNRILLVTIHHMLYPITVDVLHQVFSPHGFVEKIVTFQKSAGFQALIQYQVQQSSVSARNSLQGRNIYDGCCQLDIQFSNLDELQVNYNNERSRDFTNPNLPSEQKGKSSQQGYGDMYSFQGSGVHPGGFPQMGNAEAIAAAFAGGLPPGISGTNDRCTILVSNLNSDRINEDKLFNLCSLYGNIVSIKILRNKPDHALVQLGDGFQAELAVHFLKGAVLFEKRLEVNFSKYPNITTGPDTHDYSNSNLNRFNRNAAKNYRYCCSPTKMIHLSSLPQDVTEAEIIAHLEEHGPIVNSKLFEMNGKQQALVLFEKEEQATEALVCKNATSLGSSTIRISFSQLQSI

SEQ ID NO: 9186 - protein, 441 aa, Solanum phureja
MSDPSKVVHVRNVGHEISENDLLQLFQPFGVITKLVMLRAKNQALLQMQDVPSAVKALQFYSNVQPSIRGRNVYVQFSSHQELTTMDQNAQGRGDEPNRILLVTIHHMLYPITVDVLHQVFSPHGFVEKIVTFQKSAGFQALIQYQVQQSSVSARNSLQGRNIYDGCCQLDIQFSNLDELQVNYNNERSRDYTNPNLPSEQKGKSSQQGYGDMYSFQGSGAHPGGFPQMGNAEAIAAAFAGGLPPGISGINDRCTILVSNLNSDRINEDKLFNLCSLYGNIVSIKILRNKPDHALVQLGDGFQAELAVHFLKGAMLFEKRLEVNFSKYPNITTGPDTHDYSNSNLNRFNRNAAKNYRYCCSPTKMIHLSSLPQDVTEAEIIAHLEEHGPIINSKLFEMNGKQQALVLFDKEEQATEALVCKNATSLGSSTIRISFSQLQSI

SEQ ID NO: 9187 - protein, 110 aa, Brassica napus
MEAIRNLKIKTSTCKRIVKELHSYEKEVEREAAKTADMKDKGADPYDLKQQENVLGESRMMIPDCHKRLDSALADLKSTLAGLEETTGPEVEDAKKTVADVEKQFPTEDA

SEQ ID NO: 9188 - protein, 110 aa, Brassica napus
MEAIRNLKIKTSTCKRIVKELHSYEKEVEREAAKTADMKDKGADPYDLKQQENVLGESRMMIPDCHKRLESALADLKSTLAGLEETTGPEVEDAKKTVADVEMQFPTEDA

SEQ ID NO: 9189 - protein, 110 aa, Brassica juncea
MEAIRNLKIKTSTCKRIVKELHSYEKEVEREAAKTAAMKDNGADPYDLKQQENVLGESRMMIPDCHKRLEAALADLKSTLAELEETTGPEVEDAKKTVADVEKQFPTEDA

SEQ ID NO: 9190 - protein, 110 aa, Raphanus sativus
MEAIRNLKIKTSTCKRIVKELRSYEKEVEREAAKTAAMKDNGADPYDLKQQENVLGESRMMVPDCHKRLEAALADLKSTLAELEETTGPEVEDAKKTVADVEKQFPTEDA

SEQ ID NO: 9191 - protein, 110 aa, Raphanus sativus
MEAKRNLKIKTSTCKRIVKELHSYEKEVEREAAKTAAMKDSGADPYDLKQQENVLGESRMMVPDCHKRLEAALADLKSTLAELEETTGPEVEDAKKTVADVEKQFPTEDA

SEQ ID NO: 9192 - protein, 110 aa, Raphanus sativus
MEAKRNLKIKTSTCKRIVKELHSYEKEVEREAAKTAAMKDNGADPYDLKQQENVLGESRMMVPDCHKRLEAALADLKSTLAELEEATGPEVEDAKKTVADVEKQFPTEDA

SEQ ID NO: 9193 - protein, 113 aa, Arabidopsis thaliana
MATIRNLKIKTSTCKRIVKELHSYEKEVEREAAKTADMKDKGADPYDLKQQENVLGESRMMIPDCHKRLESALADLKSTLAELEETDEKEGPEIEDAKKTVADVEKQFPTEDA

SEQ ID NO: 9194 - protein, 110 aa, Raphanus sativus
  misc_feature (107)..(107): Xaa can be any naturally occurring amino acid
MEAKRNLKIKTSTCKRIVKELRSYEKEVEREAAKTAAMKDNGADPYDLKQQENVLGESRMMVPDCHKRLEAALADLKSTLAELEETTGPEVEDAKKTVADVEKQFPXEDA

SEQ ID NO: 9195 - protein, 113 aa, Eutrema halophilum
MATIRNLKIKTSTCKRIVKELQSYEKEVEREAAKTADMKEKGADPYDLKQQENVLGESRMMIPDCHKRLESALAELKSTLAELEETDEKEGPEVEDAKKTIADMEKQFPTEDA

SEQ ID NO: 9196 - protein, 113 aa, Thellungiella halophila
  misc_feature (2)..(3): Xaa can be any naturally occurring amino acid
MXXIRNLKIKTSTCKRIVKELQSYEKEVEREAAKTADMKEKGADPYDLKQQENVLGESRMMIPDCHKRLESALAELKSTLAELEETDEKEGPEVEDAKKTIADMEKQFPTEDA

SEQ ID NO: 9197 - protein, 113 aa, Arabidopsis lyrata
MATIRNLKIKTSTCKRIEKELHSYEKEVEREAAKTAAMKDKGADPYDLKQQENVLGESRMMIPDCHKRLEAALAELKSTLAELEETDEKEGPEIEDAKKTVAGLEKQFHTEDA

SEQ ID NO: 9198 - protein, 113 aa, Cleome spinosa
MATIRNLKIKTSTCKRIVKELHSYEKEVEREAAKTADMKEKGADPYDLKQQENVLAESRMMIPDCHRRLEAALADLKATLAELEEANEKECPEIEDAKNTVADVEKLFHTEDA

SEQ ID NO: 9199 - protein, 91 aa, Brassica juncea
ELHSYEKEVEREAAKTADMKDKGADPYDLKQQENVLGESRMMIPDCHKRLESALADLKSTLAGLEETTGPEVEDAKKTVADVEKQFPTEDA

SEQ ID NO: 9200 - protein, 113 aa, Cleome spinosa
MATIRSLKIKSSTCKRIVKELHSYEKEAEREAAKTADMKERGADPYDLKQQENVLAESRMMIPDCHKRLEAALADLKATLAELEEANEKEGPEIVDAKNTVADVEKLFHTEDA

SEQ ID NO: 9201 - protein, 391 aa, Brassica napus
MVRPDGEEGILLLEFHGNGDRSWQLNFDDFQVSPEHKEKKSPSKLHNCLGCLGPEDNVADYYQQQVEMLEGFTEMDELAERGFVPGMSKEEQDNLAKSETLAIRISNIANMVLFAAKVYASVTSGSLAIVASTLDSLLDLLSGFILWFTAFSMQTPNPYQYPIGKKRMQPLGILVFASVMATLGLQIILESLRTMLSSHKEFSLTKEQESWVVGIMLSVTLVKLLLVLYCRSFSNEIVKAYAQDHFFDVITNIIGLIAVILANYFDNWMDPVGAIILALYTIRTWSMTVLENVNSLVGKTATPEYLQKLTYLCWNHHKAIRHIDTVRAYTFGSHYFVEVDIVLPADMPLQVAHDIGESLQEKLELLQEIERAFVHLDYEYTHKPEHARSHC

SEQ ID NO: 9202 - protein, 394 aa, Arabidopsis thaliana
MVEPASPDSDEGISLLEFHGNGDRSWQLNFDDFQVSPEHKEKKSPSKLHNCLGCLGPEDNVADYYQQQVEMLEGFTEMDELAERGFVPGMSKEEQDNLAKSETLAIRISNIANMLLFAAKVYASVTSGSLAIIASTLDSLLDLLSGFILWFTAFSMQTPNPYQYPIGKKRMQPLGILVFASVMATLGLQIILESLRTMLSSHKEFNLTKEQESWVVGIMLSVTLVKLLLVLYCRSFTNEIVKAYAQDHFFDVITNIIGLIAVILANYIDYWIDPVGAIILALYTIRTWSMTVLENVNSLVGKSARPEYLQKLTYLCWNHHKAIRHIDTVRAYTFGSHYFVEVDIVLPADMPLQVAHDIGESLQEKLELLEEIERAFVHLDYEYTHKPEHARSHC

SEQ ID NO: 9203 - protein, 394 aa, Arabidopsis lyrata
MVEPASQDSDEGISLLEFHGNGDRSWQLNFDDFQVSPEHKEKKTPSKLHNCLGCLGPEDNVADYYQQQVEMLEGFTEMDELAERGFVPGMSKEEQDNLAKSETLAIRISNIANMVLFAAKVYASVTSGSLAIIASTLDSLLDLLSGFILWFTAFSMQTPNPYQYPIGKKRMQPLGILVFASVMATLGLQIILESLRTMLSSHKEFSLTKEQESWVVGIMLSVTLVKLLLVLYCRSFTNEIVKAYAQDHFFDVITNIIGLIAVILANYIDDWIDPVGAIILALYTIRTWSMTVLENVNSLVGKSARPEYLQKLTYLCWNHHKAIRHIDTVRAYTFGSHYFVEVDIVLPADMPLQAAHDIGESLQEKLELLEEIERAFVHLDYEYTHKPEHARSHR

SEQ ID NO: 9204 - protein, 394 aa, Arabidopsis lyrata
MVEPASQDSDEGISLLEFHGNGDRSWQLNFDDFQVSQEHKEKKTPSKLHNCLGCLGPEDNVADYYQQQVEMLEGFTEMDELAERGFVPGMSKEEQDNLAKSETLAIRISNIANMLLFAAKVYASVTSGSLAIIASTLDSLLDLLSGFILWFTAFSMQTPNPYQYPIGKKRMQPLGILVFASVMATLGLQIILESLRTMLSSHKEFNLTKEQESWVVGIMLSVTLVKLLLVLYCRSFTNEIVKAYAQDHFFDVITNIIGLIAVILANYIDDWIDPVGAIILALYTIRTWSMTVLENVNSLVGKSARPEYLQKLTYLCWNHHKAIRHIDTVRAYTFGSHYFVEVDIVLPADMPLQAAHDIGESLQEKLELLEEIERAFVHLDYEYTHKPEHARSHR

SEQ ID NO: 9205 - protein, 394 aa, Ricinus communis
MVHPVAFQNDEELSLLSINNNGDQSWRLNFDGYQLSTEHKEKKQPSSLHDCLGVLRPEDDVAEYYQQQVEMLEGFNEMDALAERGFIPGMSKEEQENLARSETFAIRISNIANMVLFAAKVYASVRSGSLAIIASTLDSLLDLLSGFILWFTAFTMQTPNPYQYPIGKKRMQPLGILVFASVMATLGLQIILESLRALLSDESEFELTKEQERWVVGIMLSVTLVKLLLMVYCRSFTNEIVKAYAQDHFFDVITNIIGLIAALLANYMEDWMDPVGAIILALYTIRTWSMTVLENVNSLVGKSATPDYLKKLTYLCWNHHKAVRHIDTVRAYTFGSHYFVEVDIVLPASMPLQEAHDIGESLQEKLELLPEIERAFVHLDYEYTHKPEHAQSHP

SEQ ID NO: 9206 - protein, 393 aa, Carica papaya
MVEPVRNEKDEELSLLGERCNGDRSWRLNFDGYQLSTEHKEKPPRGLHDCLGVLGPEDNVAVYYQQQVEMLEGFNEMDALAERGFIPGMSKEERERLAKSETLAIRISNAANMVLFAAKVYASVRSGSLAIIASTLDSLLDLLSGFILWFTAFSMKTPNPYQYPIGKKRMQPLGILVFASVMATLGLQIILESFRTMISDEDEFDLTKEQETWVVGIMLSVTLVKFILVIYCRSFTNEIVKAYAQDHFFDVITNIIGLVAVLLANYIDDWMDPVGAIILALYTIRTWSITVLENVNSLVGKSAAPDYLQKLTYLCWNHHKAIRHIDTVRAYTFGSHYFVEVDIVLPANMALQDAHDIGESLQEKLELLPEIERAFVHLDYEYTHKPEHGRAHY

SEQ ID NO: 9207 - protein, 394 aa, Prunus persica
MVEPVTPDCDEERSLLQESSNVEGSWRLNFDGFQVSSEHKEKRPPRGLHDCLGVLGPEDNVAEYYQQQVEMLEGFTEMDALAERGFIPGMSKEEQEKLANSETFAIRISNVANMVLFAAKVYASLRSGSLAIIASTLDSLLDLLSGFILWFTAFSMQTPNPYQYPIGKKRMQPLGILVFASVMATLGLQIILESIRTLASDEDGFSLTKDQERWVVGIMLSVTLVKLLLMLYCRTFKNEIVKAYAQDHFFDVITNIIGLVAVLLAKYFDDWMDPVGAVILALYTIRTWSLTVLENVNSLVGKSAAPEYLQKLTYLCWNHHKAVRHIDTVRAYTFGSHYFVEVDIVLPADMPLQVAHDIGETLQEKLELLPEIERAFVHLDYEFSHKPEHAQSHS

SEQ ID NO: 9208 - protein, 397 aa, Tropaeolum majus
MVEPIGNRNGSEEELSLLGEQDIVDRSWRLNFDGFQLSTERKDRESRRDQHHDCLGVLAPEDNVAEYYQQQVEMLEGFTEMDALAERGFVPGMSKEERENLAKSETLAIRISNVANMVLFAAKVYASIRSGSLAIIASTLDSLLDLLSGFILWFTAFSMQTPNPYQYPIGKKRMQPLGILVFASVMATLGLQIILESARTMLSDETEFQLTTEQEYWVVGIMLSVTLVKLFLVIYCRSFTNEIVKAYAQDHFFDVITNIIGLIAVLLANYFDDWMDPVGAIILAIYTIRTWSMTVLENVNSLVGKAAAPEFLRKLTYLCWNHHKAIRHIDTVRAYTFGSHYFVEVDIVLPADMPLQEAHDIGESLQEKLELLPDIERAFVHLDYEYSHKPEHQQAHL

SEQ ID NO: 9209 - protein, 394 aa, Humulus lupulus
MAELLNPNHEEELYLLRQPTNGDLSWRLNFEAFQLSSEHKEKKPPRGLHDCYGVLSPEDNVAEYYQQQVEMLEGFNEMDALAERGFLPGMSKEERDKLAKSETFAIRISNFANMILFAAKVYASIRSGSLAIIASTLDSLLDLLSGFILWFTAFSMQTPNPYQYPIGKRRMQPLGILVFASVMATLGLQIILESVRTLSSDEAEFSLTKDQERWVVGIMLMVTLVKFVLMIYCRSFTNEIVKAYAQDHFFDVITNIIGLFAALLANYFDDWMDPVGAIILALYTIRTWSMTVLENVNSLVGRSAAPEYLQKLTYLCWNHHKAIRHIDTVRAYTFGSHYFVEVDIVLPADMPLQEAHDIGESLQEKLELLPEIERAFVHLDYEFSHKPEHAQSHS

SEQ ID NO: 9210 - protein, 394 aa, Manihot esculenta
MVEPGTHANEEELSLLSLNNNGDGSWRLNFDGYQLSAGHKEKKPPRGLHDCLGVLGPEDDVAEYYQQQVEMLEGFNEMDALAERGFIPGMSKEEQESLARSETFAIRISNLANMVLFAAKVYASIRSGSLAIIASTLDSLLDLLSGFILWFTAFTMQTPNPYQYPIGKKRMQPLGILVFASVMATLGLQIILESVRTLLSDENGFDLTKEQERWVVGIMLSVTLVKLLLMVYCRSFTNEIVKAYAQDHFFDVVTNIIGLIAALLANYMEEWMDPVGAIILALYTIRTWSMTVLENVNSLVGKSATPDYLKKLTYLCWNHHKAVRHIDTVRAYTFGSHYFVEVDIVLPASMPLQEAHDIGESLQEKLELLPEIERAFVHLDYEFTHKPEHAQSLP

SEQ ID NO: 9211 - protein, 396 aa, Glycine max
MVEPVELRGEEQLSLLSDSSNGDRSWRLNFDGFQLSSEHTEKQVKPPRGLHDCYGVLGQEDNIAEYYQQQVEVLEGFTEMDALAERGFIPGMSKEEQDKLARSETFAIRVSNAANMVLFVAKVYASVRSGSLAIIASTLDSLLDLLSGFILWFTAFSMQTPNPYQYPIGKKRMQPLGILVFASVMATLGLQIILESTRTLISSENAFNLTREQERWVVSIMLSVTLVKFLLMIYCRSFTNEIIKAYAQDHFFDVITNVIGLIAALLANYVDDWMDPVGAIILALYTIRTWSMTVLENVNSLVGRSAAPEYLQKLTYLCWNHHKAVRHIDTVRAYTFGSHYFVEVDIVLPSDMPLQEAHDIGESLQEKLELLPEIERAFVHLDYEYSHKPEHAQAHS

SEQ ID NO: 9212 - protein, 396 aa, Glycine max
MVEPVELRCEEQLSLLSDSSNGDRSWRLNFDGFQLSSEHAEKQVKPPRGLHDCYGVLGQEDNIAEYYQQQVEVLEGFTEMDALAERGFIPGMSKEERDKLARSETFAIRVSNAANMVLFVAKVYASIRSGSLAIIASTLDSLLDLLSGFILWFTAFSMQTPNPYQYPIGKKRMQPLGILVFASVMATLGLQIILESTRTLISSENAFNLTKEQERWVVGIMLSVTLVKFLLMIYCRSFTNEIIKAYAQDHFFDVITNIIGLIAALLANYVDDWMDPVGAIILALYTIRTWSMTVLENVNSLVGRSAAPEYLQKLTYLCWNHHKAVRHIDTVRAYTFGSHYFVEVDIVLPSDMPLQEAHDIGESLQEKLELLPEIERAFVHLDYEYSHKPEHAQAHS

SEQ ID NO: 9213 - protein, 396 aa, Cajanus cajan
MVEPVELRGEEQLSLLSDSSNGDRSWRLNFDGFQLSSKHTEKQVKPPRGLHDCYGVLGQEDNIAEYYQQQVEVLEGFTEMDALAERGFIPGMSKEERDKLARSETFAIRLSNFANMVLFVAKVYASIKSGSLAIIASTLDSLLDLLSGFILWFTAFSMQTPNPYQYPIGKKRMQPLGILVFASVMATLGLQIILESVRTLISSENAFNLTREQERWVVGIMLSVTLVKFLLMVYCRSFTNEIIKAYAQDHFFDVITNVIGLIAALLANYVDDWMDPVGAIILALYTIRTWSMTVLENVNSLVGRSAAPEYLQKLTYLCWNHHKAVRHIDTVRAYTFGSHYFVEVDIVLPADMPLQEAHDIGESLQEKLELLPEIERAFVHLDYEYSHKPEHAQAHT

SEQ ID NO: 9214 - protein, 401 aa, Eucalyptus grandis
MAEAVAVASEHDEERLLLPEAASGGGGGDRSWRLNFDRFKITPERAQKKQPGGLHDCCLGLLGPEDNVAEYYQQQVEMLEGFNEMDALTERGFIPGMSKEEQENLARNETFAIRISNVANMVLFAAKVYASIRSGSLAIIASTLDSLLDLLSGFILWFTAFSMQTPNPYQYPIGKKRMQPLGILVFASVMATLGLQIILESLQQLLSDEAEFSLTKEQEQWLVGIMLSVTLVKFLLVLYCRTFTNEIVKAFAQDHFFDVITNVIGLIAALLANYVVNWMDPVGAIILALYTIRTWSMTVLENVNSLVGKSAAPEYLQKLTYLCWNHHKAIRHIDTVRAYTFGSHYFVEVDIVLPADMPLQLAHDIGESLQEKLELLPEIERAFVHLDYEYSHKPEHAQAHS

SEQ ID NO: 9215 - protein, 394 aa, Populus trichocarpa
MLEPVNNENEEELSLLSPNRNGDGSWRLNFNCYQLSPEHKEKKPPRGIHDCYGVLGPEDDVAEFYQQQVEMLKGFNEMDALAERGFIPGMSEEEKEILARSETFAIRISNFANMVLFAAKVYASVRSGSLAIIASTLDSLLDLLSGFILWFTAFSMQTPNPYQYPIGKKRMQPLGILVFASVMATLGLQIILESVRALHSDENDFNLSKEQERWVVGIMLSVTLVKLVLMVYCRSFTNEIVKAYAQDHFFDVITNIIGLIAALMANYMEEWMDPVGAIILALYTIRTWSMTVLENVNSLVGKSATPDYLQKLTYLCWNHHRAIRHIDTVRAYTFGSHYFVEVDIVLPSSMPLQEAHDIGESLQEKLELLPEIERAFVHLDYEYTHKPEHAQSHS

SEQ ID NO: 9216 - protein, 396 aa, Vigna unguiculata
  misc_feature (52)..(52): Xaa can be any naturally occurring amino acid
MVETVELQGEEQRSLLSDSSNGDRSWRLNFEGFQISSEHTEKQVKPSRGLYXCYGVLGQEDNIAEYYQQQVEVLEGFTEMDALAERGFIPGMSKEERDKLARSETFAIRLSNVANMVLFIAKVYASIRSGSLAIIASTLDSLLDLLSGFILWFTAFSMQTPNPYQYPIGKKRMQPLGILVFASVMATLGLQIILESIRTLIYSDNAFNLTNEQERWVVGIMLSVTLVKFLLMIYCRTFTNEIIKAYAQDHFFDVITNVIGLIAALLANYVDDWMDPVGAIILALYTIRTWSMTVLENVNSLVGKSAAPEYLQKLTYLCWNHHKAVRHIDTVRAYTFGSHYFVEVDIVLPADMQLQEAHDIGESLQEKLELLPEIERAFVHLDYEYSHKPEHAQSHS

SEQ ID NO: 9217 - protein, 396 aa, Medicago truncatula
MVETVEQSNEEELSLLSVSDNGDRSWRLNFDSFQLNSQHTEKTPKPSSGIHDCYGVLGQEDNIAEYYQQQVEVLEGFTEMDALAERGFIPGMSKEERDKLARSETFAIRISNIANMVLFTAKVYASVRSGSLAIIASTLDSLLDLLSGFILWFTAFSMQTPNPYQYPIGKKRMQPLGILVFASVMATLGLQIILESARTLIYTDNTFSLTREQERWVVGIMLSVTLVKFMLMIYCRSFTNEIVKAYAQDHFFDVITNVIGLIAALLANYFDDWMDPVGAIILALYTIRTWSMTVLENVNSLVGRSAAPEYLQKLTYLCWNHHKAVRHIDTVRAYTFGSHYFVEVDIVLPADMPLQEAHDIGESLQEKLELLPEIERAFVHLDYEFSHKPEHAQAHS

SEQ ID NO: 9218 - protein, 394 aa, Populus trichocarpa
MVEPVNNENEEELSLLSPNNKGDGSWQLNFDGYQLSPERKEKKPPRGIHDCYGVLGPEDDIAEYYQQQVEMLEGFNEMDALAERGFIPGMSKEEKEILARSETFAIRISNFANMVLFVAKTYASIKSGSLAIIASTLDSLLDLLSGFILWFTAFSMQTPNPYQYPIGKKRMQPLGILVFASVMATLGLQIILESVRALLSDESDFDLTKEQERWIVGIMLSVTLVKLVLMIYCRSFTDEIVKAYAQDHFFDVITNTIGLVAALLANYLEDWMDPVGAIVLALYTIRTWSMTVLENVNSLVGKSATPDYLQKLTYLCWNHHKAIRHIDTVRAYTFGSHYFVEVDIVLPSSMPLQEAHDIGESLQEKLELLPEIERAFVHLDYEYTHKPEHARSRS

SEQ ID NO: 9219 - protein, 398 aa, Cannabis sativa
MAMELLNLNHEEEELSLLRQPTTNGDLSWRLNFESFKLSNTHKEKKPSPPGLHDCYGVLSPEDNVAEYYQQQVEMLEGFNEMDALAERGFLPGMSKEEQDKLAKSETFAIRISNFANMILFAAKVYASIRSGSLAIIASTLDSLLDLLSGFILWFTAFSMQTPNPYQYPIGKRRMQPLGILVFASVMATLGLQIILESVRTLLSDEVEFSLTKDQERWVVGIMLMVTLVKFVLMIYCRGFSNEIVKAYAQDHFFDVITNIIGLFAALLANYFYDWMDPVGAIILALYTIRTWSMTVLENVNSLVGRSAAPEYLQKLTYLCWNHHKAIRHIDTVRAYTFGSHYFVEVDIVLPADMPLQEAHDIGESLQEKLEQLPEIERAFVHLDYEFSHKPEHAQSQS

SEQ ID NO: 9220 - protein, 396 aa, Phaseolus coccineus
  misc_feature (352)..(352): Xaa can be any naturally occurring amino acid
MVETVELHGEEQRSLLSDSNNGDRSWRLNFEGFQISSEHTEKQVKPSRGLHDCYGVLGQGDNIAEYYQQQVEVLEGFTEMDALAERGFIPGMSKEERDKLARSETFAIRLSNVANMVLFVAKVYASIRSGSLAIIASTLDSLLDLLSGFILWFTAFSMQTPNPYQYPIGKKRMQPLGILVFASVMATLGLQIILESIRTLIYSDNSFNLTKEQEQWVVGIMLSVTLVKFLLMIYCRTFTNEIIKAYAQDHFFDVITNVIGLIAALLANYVDDWMDPVGAIILALYTIRTWSMTVLENVNSLVGRSAAPEYLQKLTYLCWNHHKAVRHIDTVRAYTFGSHYFVEVDIVLPADXQLQEAHDIGESLQEKLELLPEIERAFVHLDYEYSHKPEHAQANS

SEQ ID NO: 9221 - protein, 393 aa, Euphorbia esula
MVEPVTANNEELSLLPLNSNVDHSWRLNFDGYQLSTERKGKTSPPCGRLPDCLGVLGPDDVAEYYQQQVEMLEGFTEMDVLAERGFVPGLTKEERENLAKSETFAIRISNIANMVLFAAKVYASVRSHSLAIIASTLDSLLDLLSGFILWFTAFTMKTPNPYQYPIGKKRMQPLGILVFASVMATLGLQIILESMRTLISDDTEFKLTSEQEHWVIGIMVSVTVVKLLLTIYCRTFTNEIVKAYAQDHFFDVITNVIGLIAALLASYFKGWLDPVGAIILALYTIRTWSMTVLENVNSLVGKSATPDYLKKLTYLCWNHHKAIRHIDTVRAYTFGSHYFVEVDIVLPASMHLQEAHDIGESLQEKLELLPEIERAFVHLDYEYTHKPEHAQSH

SEQ ID NO: 9222 - protein, 401 aa, Solanum lycopersicum
MLELVPPDGDHGGECGGEEQLLLMETNNVDRSWRLNFDELRLSSENKEKPLPHGLHDCLGVLCQEDNIAVYYQQQVEMLEGFNEMDALADRGFVPGMSKEEREKLARSETTAIRISNIANMVLFAAKVYASVKSGSLAIIASTLDSLLDLLSGFILWFTAFSMQTPNPYQYPIGKKRMQPLGILVFASVMATLGLQIILESMRTLISDESNFSLTKEQERWVIGIMVFVTLVKLVLVLYCRSFTNEIVKAYAQDHFFDVITNVIGLVAALLANYFSGWIDPVGAMILALYTIRTWSMTVLENVNSLVGKAAAPEYLQKLTYLCWNHHKAIKHIDTVRAYTFGSHYFVEVDIVLPADMPLQEAHDIGESLQEKLELLPEIERAFVHLDYEYSHKPEHAQAYL

SEQ ID NO: 9223 - protein, 468 aa, Euphorbia peplus
MEGRRVSANPRPCSGRRILARKRPRTFGFVNTVKKLQRREISSRRDRAFSMSNAQERFRNMRLREEYDTHDPKGHCQVVLPFLMKRTKVIEIVAARDIVFALAHSGVCAAFSRETNQRICFLNVCPDEVIRSLFYNKNNDSLITVSVYASDNFSSLKCRSTRIEYIRRGKPDAGFALFESESLKWPGFVEFDDVNGKVLTYSAQDSVYKVFDLKNYTMLYSISDKHVQEIKISPGIMLLIFNRLTSHVPLKILSIEDGTVLKAFNHLLHRNKKVDFIEQFNEKLLVKQENENLQILDVRNAELMEVSRTEFMTPSAFIFLYENQLFLTFRNRTVAVWNFRGELVTSFEDHLLWHPDCNTNNIYITSDQDLIISYCKAESEDQWIEGNAGSINISNILTGKCLAKINASNGGPKGEGGSSSSGGSRQSYSSMRSTVTEALEDITALFYDEERNEIYTGNRHGLVHVWSN

SEQ ID NO: 9224 - protein, 470 aa, Ricinus communis
MEGRRISANPRPCSGRRVLAKKRQRSNGLMNTVKKLQRREISSKPDRAFTMSNAQERFRNMRLKEEYDTHDPKGHCSVVLPFLMKRTKVIEIVAARDIVFALAHSGVCAAFSRETNQRICFLNVSPDEVIRSLFYNKNNDSLITVSVYASDNFSSLKCRSTRIEYIKRGKPDAGFALFESESLKWPGFVEFDDVNGKVLTYSAQDSVYKVFDLKNYTMLYSISDKHVQEIKISPGIMLLIFNRASSHVPLKILSIEDGTVLKAFNHLLHRNKKVDFIEQFNEKLLVKQENENLQILDVRNAELMEVSRTEFMTPSAFIFLYENQLFLTFRNRTVAVWNFRGELVTSFEDHLLWHPDCNTNNIYITSDQDLIISYCKAETEEQWMEGSAGSINISNILTGKCLAKINAGNGGPKGGECSSSSSIGCSKQSCSSMRSTVAEALEDITALFYDEERNEIYTGNRHGLVHVWSN

SEQ ID NO: 9225 - protein, 472 aa, Prunus persica
MEVGRRISASPRPCSGRRILAKKKRARSDGIVNSVKKLQRREISSKRDRVFGLSNAQERFRNMHLKEEYDTHDPKGHSSPILSFLMKRTRVIEIVAARDIVFALAHSGVCAAFSREKNERICFLNVSPDEVIRSLFYNKNNDSLITVSVYASDNFSSLKCRSTRIEYIRRGQPDAGFALFESESLKWPGFVEFDDVNGKVLTYSAQDSIYKVFDLKNYTMLYSISDKHVQEIKISPGIMLLIFNRASSHVPLKILSIEDGTVLKAFNHLLHRNKKVDFIEQFNEKLLVKQENENLQILDVRNAELMEVSRTEFMTPSAFIFLYENQLFLTFRNRNVAVWNFRGELVTSFEDHLLWHPDCNTNNIYITSDQDLIISYCKADSDDHWMEANAGSIHVSNILTGKCLAKINAGNGGPKVDECDSSAGSSSKRSNLSLVRSTVAGALEDITALFYDEERNEIYTGNRHGLVHVWSN

SEQ ID NO: 9226 - protein, 472 aa, Fragaria vesca
MEVGRRISASPRPCSGRRVLAKKKRAAGDGFVNSVKKLQRREISSKRDRAFGMSNAQERFRNMHLMEEYDTHDPKGHSTPKLPFLLKRTKVIEIVAARDIVFALAHSGVCAAFSRDTNQRICFLNVSPDEVIRSLFYNKNNDSLITVSVYASDNFSSLKCRSTRIEYIRRGQPDAGFALFESESLKWPGFVEFDDVNGKVLTYSAQDSIYKVFDLKNYTMLYSISDKNVQEIKISPGIMLLIYNRASSHVPLKILSIEDGTVLKDFNHLLHRNKKVDFIEQFNEKLLVKQENENLQILDVRNAEQMEVNRAEFMTPSAFIFLYENQLFLTFRNRTVAVWNFRGELVTSFEDHLLWHPDCNTNNIYITSDQDLIISYCKADSDDHWSEPNAGSIHVSNILTGKCLAKINASNAGPKVDECSSSSSTSRKQINSSVVRSTVAEALEDITALFYDEERNEIYTGNRHGLVHVWSN

SEQ ID NO: 9227 - protein, 472 aa, Malus domestica
MEVGRRISASPRPCSGRRVVAKKRRGGSDGFVNSVKKLQRREISSKRDRAFGMSNSQERFRNMHLVEQYDTHDPKGHSSAILPFLMKRTKVIEIVSARDIVFALAHSGVCAAFSREKNERICFMNVSPDEVIRSLFYNKNNDSLITVSVYASDNFSSLKCRSTRIEYIRRGQPEAGFSLFESESLKWPGFVEFDDVNGKVLTYSAQDSIYKVFDLKNYTMLYSISDKHVQEIKISPGIMLLIYNRASSHVPLKILSIEDGTVLKDFNHLLHRNKKVDFIEQFNEKLLVKQENENLQILDVRNAELMEVSRTDFITPSAFIFLYENQLFLTFRNRLVSVWNFRGELVTAFEDHLLWHPDCNTNNIYITSDQDLIISYCKADTDDHWSEGNAGSIHVSNILTGKCLAKINPSNGDPKVDDTEGNTGSSRKLSNSSLVRSTVAEALEDVTALFYDEDRNEIYTGNRHGLVHVWSN

SEQ ID NO: 9228 - protein, 471 aa, Malus domestica
MEVGRRISASPRPCSVRRVVAKKRGSSDGFVNSVKKLQRREISSKRDRAFGMSNSQERFRNMHLVEEYDTHDPKGHSSAILPFLMKRTKVIEIVAARDIVFALAHSGVCAAFSREKNERICFMNVSPDEVIRSLFYNKNNDSLITVSVYASDNFSSLKCRSTRIEYIRRGQPEAGFSLFESESLKWPGFVEFDDVNGKVLTYSAQDSIYKVFDLKNYTMLYSISDKHVQEIKISPGIMLLIYNRASSHVPLKILSIEDGTVLKDFNHLLHRNKKVDFIEQFNEKLLVKQENENLQILDVRNAELMEVSRTDFITPSAFIFLYENQLFLTFRNRLVSVWNFRGELVTAFEDHLLWHPDCNTNNIYITSDQDLIISYCKADSDDHWSEGNAGSIHVSNILTGKCLAKINPSNGDPKVDDTEGNTGSSRKLSNSSLVRSTVAEALEDVTALFYDEDRNEIYTGNRHGLVHVWSN

SEQ ID NO: 9229 - protein, 471 aa, Malus domestica
MEVGRRISASPRPCSVRRVVAKKRGSSDGFVNSVKKLQRREISSKRDRAFGMSNSQERFRNMHLVEEYDTHDPKGHSSAILPFLMKRTKVIEIVAARDIVFALAHSGVCAAFSREKNERICFMNVSPDEVIRSLFYNKNNDSLITVSVYASDNFSSLKCRSTRIEYIRRGQPEAGFALFESESLKWPGFVEFDDVNGKVLTYSAQDSIYKVFDLKNYTMLYSISDKHVQEIKISPGIMLLIYNRATSHVPLKILSIEDGTVLKDFNHLLHRNKKVDFIEQFNEKLLVKQENENLQILDVRNAEMMEVNRTDFITPSAFIFLYENQLFLTFRNRLVSVWNFRGELVTAFEDHLLWHPDCNTNNIYITSDQDLIISYCKADSDDHWSEANAGSIHISNILTGKCLAKINPSNGGPKVDNCEGNAGSSRKQSNSSVVSSTVVDALKDVTALFYDEDRNEIYTGNRHGFVHVWSN

SEQ ID NO: 9230 - protein, 471 aa, Euonymus alatus
MEGRRISASPRPCSGRRVVAKKRARSDVILNSVKKLQRREISSMRDRAFTVSNAQERFRNMRLTVEYDTHDPKGHCSMVLPFLAKRTKVIEIVAARDIVFALAHSGVCAAFSRETNERICFLNVSPDEVIRSLFYNKNNDSLITVSVYASDNFSSLKCRSTRIEYIRRGKPDAGFALFESESLKWPGFVEFDDVNGKVLTYSAQDSIYKVFDLKNYTMLYSISDKNVQEIKISPGIMLLIFNRASSHVPLKILSIEDGTVLKSFNHLLHRNKKVDFIEQFNEKLLVKQENENLQIRDVRTSELMEVSRNEFMTPSAFIFLYENQLFLTFRNRTVAVWNFRGELVTSFEDHLLWHPDCNTNNIYITSDQDLIISYCRAESDYQWGEGNAGSINISNILTGKCLAKINATNASPTVEECCCSSTGNSKKRIVAAPMSSTVSEALEDITALFYDEERNEIYTGNRHGLVHVWSN

SEQ ID NO: 9231 - protein, 481 aa, Vitis vinifera
MEGKRISVSPRPGSGRRVVAKKRPRNDGFVNSVKKLQRREICSKRDRSFSMSDAQERFRNIRLQEEYDTHDPKGHCTLVLPFLRKRSKIIEIVAARDIVFALAQSGVCAAFSRETNQRICFLNVSPDEVIRSLFYNKNNDSLITVSVYASDNFSSLKCRTTRIEYIRRGKPDAGFALFESESLKWPGFVEFDDVNGKVLTYSAQDSIYKVFDLKNYTMLYSISDKHVQEIKISPGIMLLIFTKASSHVPLKILSIEDGTVLKSFNHLLHRNKKVDFIEQFNEKLLVKQENENLQILDVRNSELKEVSRTEFMTPSAFIFLYENQLFLTFRNRTVAVWNFRGELVTSFEDHLLWHPDCNTNNIYITSDQDLIISYCKADSDDPLSEGNAGSINISNILTGKCLAKIKASNNFPMENECSCSSNFSSSSSSIGGSRKRAHASASRIRSTVAEALEDITALFYDEERNEIYTGNRHGLVHVWSN

SEQ ID NO: 9232 - protein, 478 aa, Malus domestica
MEGGRRISASPRPCNGRRVVAKKRPRIGGVDGFVNSVKKLQRREISSKRDRAFTMSDAQERFRNIRLQDEYDTHDPKGHCAMVLPFLRKRSKIIEIVAARDIVFALAQSGVCAAFSRETNQRICFLNVSPDEVIRSLFYNKNNDSLITVSVYASDNFSSLKCRSTRIEYIRRGKPDAGFALFESESLKWPGFVEFDDVNGKVLTYSAQDSIYKVFDLKNYTMLYSISDKHVQEIKISPGIMLLIFTKASSHVPLKILSIEDGTVLKSFNHLLHRNKKVDFIEQFNEKLLVKQENENLQILDVRNFEMTEVSRTQFMTPSAFIFLYENQLFLTFRNRTVAVWNFRGELVTSFEDHLLWHPDCNTNNIYITSDQDLIISYCKADSDDPLSEGNAGSINISNILTGKCLAKIRATNNAEKECICSGEACGSSCNSKKRSLSSRIRSTVAEALEDITALFYDEERNEIYTGNRLGLVHVWSN

SEQ ID NO: 9233 - protein, 479 aa, Fragaria vesca
MEGGRRISASPRPCSGRRVVAARKRPRIGGVDGFVNSVKKLQRREISSKRDRAFTMSDAQERFRNIRLQEEYDTHDPKGHCAMVLPFLRKRSKIIEIVAARDIVFALAQSGVCAAFSRETNQRICFLNVSPDEVIRSLFYNKNNDSLITVSVYASDNFSSLKCRSTRIEYIRRGKPDAGFALFESESLKWPGFVEFDDVNGKVLTYSAQDSIYKVFDLKNYTMLYSISDKHVQEIKISPGIMLLIFNKASSHVPLKILSIEDGSVLKSFNHLLHRNKKVDFIEQFNEKLLVKQENENLQILDVRNFEMTEVSKNEFMTPSAFIFLYENQLFLTFRNRTVAVWNFRGELVTSFEDHLLWHPDCNTNNIYITSDQDLIISYCKADSDDPLAEGNAGSINISNILTGKCLAKIKASKTVENECSCSGDCCGKSCSSKKRSQASRIRSTVAEALEDITALFYDEERNEIYTGNRLGLVHVWSN

SEQ ID NO: 9234 - protein, 480 aa, Glycine max
MEGGGRRITVSPRPCCGRRVVAKKRPRLVDGFVNSVKKLQRREISSNRDRAFSMTDAQERFRNIRLQEEYDTHDPKGPSSAVLQFLRKRSKIIEIVAARDIVFALAQSGVCAAFSRETNERICFLNVSPDEVIRSLFYNKNNDSLITVSVYASDNYSSLKCRSTRIEYIRRVKPDAGFALFESESLKWPGFVEFDDVNGKVLTYSAQDSIYKVFDLKNYSMLYSISDKNVQEIKISPGIMLLIFTKSSSHVPLKILSIEDGTVLKSFNHLLHRNKKVDFIEQFNEKLLVKQENENLQILDVRTSELTEVSRSEFMTPSAFIFLYENQLFLTFRNRTVAVWNFRGELVTSFEDHLLWHPDCNTNNIYITSDQDLIISYCKADSDDSLSEGNAGSINVSNILTGKCLAKIRASNGLPMVKECSCSDDNCSSSACNSGKRKRSSRIRSTVAEALEDITALFYDEERNEIYTGNRLGLVHVWSN

SEQ ID NO: 9235 - protein, 480 aa, Vigna unguiculata
MEGGGRRITVSPRPCCGRRVLAKKRPRLVDGFVNSVKKLQRREISSNRYRAFSMTDAQERFRNIRLQEEYDTHDPKGPSTAVLPFLKKRSKIIEIVAARDIVFALAQSGVCAAFSRETNERICFLNVSPDEVIRSLFYNKNNDSLITVSVYASDSYSSLKCRSTRIEYIRRVKPDAGFALFESESLKWPGFVEFDDVNGKVLTYSAQDSIYKVFDLKNYTMLYSISDKNVQEIKISPGIMLLIFAKSSSHVPLKILSIEDGTVLKSFNHLLHRNKKVDFIEQFNEKLLVKQENENLQILDVRTSELTEVSRSKFMTPSAFIFLYENQLFLTFRNRTVAVWNFRGELVTSFEDHLLWHPDCNTNNIYITSDQDLIISYCKADSDDSLSEVNAGSINVSNILTGKCLAKIRASNGFPVMKECSCVDENCSCSGCNLGKRKLSSRIRSTVAEALEDITALFYDEERNEIYTGNRHGLVHVWSN

SEQ ID NO: 9236 - protein, 479 aa, Glycine max
MEGGGRRITVSPRPCCGRRVVAKKRPRLVDGFVNSVKKLQRREISSNRDRAFSMTDAQERFRNIRLQEEYDTHDPKGPSSVVLSFLRKRSKIIEIVAARDIVFALAQSGVCAAFSRETNERICFLNVSPDEVIRSLFYNKNNDSLITVSVYASDSYSSLKCRSTRIEYIRRVKPDAGFALFESESLKWPGFVEFDDVNGKVLTYSAQDSIYKVFDLKNYSMLYSISDKNVQEIKISPGIMLLIFAKSSSHVPLKILSIEDGTVLKSFNHLLHRNKKVDFIEQFNEKLLVKQENENLQILDVRTFELTEVSRSEFMTPSAFIFLYENQLFLTFRNQTVAVWNFRGELVTSFEDHLLWHPDCNTNNIYITSDQDLIISYCKADSDDSLSEGNGSINVSNILTGKCLAKIRASNGFPMVKECSCSDDNCSSSACNSGKQKHSSRIRSTVAEALEDITALFYDEERNEIYTGNRHGLVHVWSN

SEQ ID NO: 9237 - protein, 485 aa, Unknown
  Sequence found in Organisms: Citrus clementina, Citrus sinensis
MEGGGGGGRRISASPRPCSGRRVLAKKRRRNWAGFDGFVNSVKKLQRREISSKRDRAFTMTDAQERFRNIRLQEEYDTHDPKGHCSMVLPFLRKRSKIIEIVAARDIVFALAQSGVCAAFCRETNQRICFLNVTADEVIRSLFYNKNNDSLITVSVYASDNFSSLRCRSTRIEYIRRGKPDAGFALFESESLKWPGFVEFDDVNGKVLTYSAQDSIYKVFDLKNYTMLYSISDKNVQEIKISPGIMLLIFTKASGHVPLKILSIEDGTVLKSFNHLLHRNKKVDFIEQFNEKLLVKQENENLQILDVRNFELTEVSRTEFMTPSAFIFLYENQLFLTFRNRTVAVWNFRGELVTSFEDHLLWHPDCNTNNIYITSDQDLIISYCKADSDDPLAEGNAGSINISNILTGKCLAKIRASNGLPAENECSCSGDYSSGSCNVKKHSHASRIRSTVAEALEDITALFYDEDRNEIYTGNRHGLVHVWSN

SEQ ID NO: 9238 - protein, 480 aa, Glycine max
MEGGRRITVSPRPCCGRRIVAAKKRPRANDGFVNSVKKLQRREISSKRDRAFTMSDAQERFRNIRLQEEYDTHDPKGPSSMVLQFLRKRSKIIEIVAARDIVFALAQSGVCAAFSRENNQRICFLNVSADEVIRSLFYNKNNDSLITVSVYASDSYSSLKCRSTRIEYIRRGTPDAGFALFESESLKWPGFVEFDDVNGKVLTYSAQDSIYKVFDLKNYTMLYSISDKNVQEIKISPGIMLLIYAKASSHVPLKILSIEDGTVLKSFSHLLYRNKKVDFIEQFNEKLLVKQENENLQILDVRTFEHTEVCRSEFMTPSAFIFLYENQLFLTFRNRTVAVWNFRGELVTSFEDHLLWHPDCNTNNIYITSDQDLIISYCKADSDDSLSEGNAGSINVSNILTGKCLAKIRASNSFPVDNNCSCSDKPSRSYCCNSKKRKHGSKMRSTVAEALEDITALFYDEERNEIYTGNRLGLVHVWSN

SEQ ID NO: 9239 - protein, 478 aa, Ricinus communis
MDGSRKISVSPRPCSGRRVLAKKRGIGGIDNKFVNSVNKLHRREICSKRHRAFTVTDAQDRFRNIRLQEEYDTHDPKGHCSMVLPFLRKRSKIIEIVAARDIVFALAQSGVCAAFNRETNQRICFLNVTPDEVIRSLFYNKNNDSLITVSAYASDNFSSLKCRSTRIEYIRRGKPDAGFALFESESLKWPGFVEFDDVNGKVLTYSAQDSIYKVFDLKNYTMLYSISDKNVQEIKISPGIMLLIFTKASSHVPLKILSIEDGTVLKSFNHLLHRNKKVDFIEQFNEKLLVKQENENLQILDVRNFELTEVSRTEFMTPSAFIFLYENQLFLTFRNRTVAVWNFRGELVTSFEDHLLWHPDCNTNNIYITSDQDLIISYCKADSDDHLSEGIAGSINISNILTGKCLAKIKASNSFSSECSCSGNFSGCCNKSNKHMHNSRIRSTAAEALEDITALFYDEERNEIYTGNRHGLVHVWSN

SEQ ID NO: 9240 - protein, 476 aa, Artemisia annua
MDGRRITASPRPCNGRRIVAKKRRRSDGLVNSVKKLYKREISSKRDRGFRMCDSLERFRNIRLQEEYDTHDPKGHCTMVLPFLKKRSKIIEIVAARDIVFALAQSGVCAAFSRETNQRICFLNVSPDEVIRSLFYNKNNDSLITVSVYASDSFSSLKCRTTRIEYIRRAQPDAGFALFESESLKWPGFVEFDDVNGKVLTFSAQDSVYKVFDLKNYTLLYSISDKNVQEIKISPGIMLLIYNKAVSYVPLKILSIEDGTVLKSFNHLLHRNKKVDFIEQFNEKLLVKQENENLQILDVRNFDVTEVSRTEFMTPSAFIFLYENQLFLTFRNRTVAVWNFRGELVTSFEDHLLWHPDCNTNNIYITSDQDLIISYCKTESDDPLTEGHEGSINISNILTGKCLAKIKAKNGVPLDEYNCGECSGRSCKCTSRKRVRASRITSSVTEALEDITALFYDEERNEIYTGNRFGLVHVWCN

SEQ ID NO: 9241 - protein, 94 aa, Unknown
  Sequence found in Organisms: Brassica napus, Brassica rapa
MVKATWVSILALAAFLLVVLVPAAEAVTCSPMQLSPCAAAITSSSPPSALCCAKLKEQKPCICGYMRNPSLRRYISSPNARKVSNTCKFPMPRC

SEQ ID NO: 9242 - protein, 96 aa, Brassica napus
MVIVKATWVSILALAAFLLVVLVPAAEAVTCSPMQLSPCAAAITSSSPPSALCCAKLKEQKPCICGYMRNPSLRRYISSPNARKVSNTCKFPMPRC

SEQ ID NO: 9243 - protein, 94 aa, Unknown
  Sequence found in Organisms: Brassica napus, Brassica oleracea
MVKATWVSLLALAAFLLVVLVPAAEAVTCSPMQLSPCAAAITSSSPPSALCCAKLKEQKPCICGYMRNPSLRRYISSPNARKVSNTCKFPMPRC

SEQ ID NO: 9244 - protein, 860 aa, Eutrema parvulum
MASSNSLMDTLFQRSLEDLIKGLRLQLLGESSFISKSLEEIRREIKLTDLSTKSIALQKLSYLAALHGVDMTWAAFHAVEVVSSSRFAHKRIGYHAIAQSFNDQTPVLLLITNQLRKDLNSSNEYEVSLALECLSRIGTDDLARDLTSEVFTLLGSSKAFVRKKAIGVVLRVFDKYPDAVKVCFKRLVENLESSDPQFLSAVVGVFCELTTKDPRSYLPLAPEFYKLLVDSRNNWVLIKVLKIFSNMALIELRLAKKVADPICEHMRKNVGKSLAFECIRTVVSSLSDQETALKLAVAKIREFLVDDDPNLKYLGLHALSMVAPKHLWAVLENKEAVVKALSDEDPNVKLKALHLLMAMVNEDNVTEISRILMNYAIKSEPLFCNEIIGSILLACSRNSYEIIVDFDWYLSLLGEIARVPHCQRGKDIEHQLIDIGTRVKDARLELVRVSRALLIDPALLGNQFLHPILSAAAWASGEYVEFSKIPYEIAEALLQPRTCLLPPSIRAIYIHSAFKVLVFSLGAYFSTQEPTSSPLSQESTSSGFSPVNGFTYKSISSLVNMIELGLCSLSGTLDVEVQERAKNVLGFIGMIKHEIAEKATSQDSETEAPRAIAFMEDVFSEELVPVSSTAQEKIPLPDGLELKENLEDLQEICREVLEPIAESNSTFFSSSDKIIFSVANLRIRDQQEASSSLSPPPESASLLAELRKRHGLYYLSSQKSDDHNDSDGNINNTPSEYPPANEISVDSFKPKKKMNQSKPRPVVVKLDEGDEPKRKPDSSSNDEPLSRAIQTALMGKGKEKEREKDNHEITLESRITEQSSKREKKTKKKNGESSSKHRSRRRRDEEVSATKPVEIPDLLL

SEQ ID NO: 9245 - protein, 94 aa, Brassica juncea
MIKASWVSLFAIAAILLVILVPAAEAVTCSPMQLSPCAAAITSSSPPSALCCAKLKEQKPCLCGYMRNPSLRRFVSSPNARKVSNRCKLPIPRC

SEQ ID NO: 9246 - protein, 94 aa, Unknown
  Sequence found in Organisms: Brassica napus, Brassica rapa
MIKATWVSIFAIAAVLLVILAPAAEAVTCSPMQLSPCAQAITSSSPPSALCCAKLKEQKPCLCGYMRNPSLRRFVSSPNARKVSNRCKLPIPRC

SEQ ID NO: 9247 - protein, 94 aa, Brassica juncea
MIKATWVSIFAFAAILLVILVPAAEAVTCSPMQLSPCASAITSSSQPSALCCAKLKEQKPCLCGYMRNRSLRRFVSSPNARKVSNRCKLPIPRC

SEQ ID NO: 9248 - protein, 94 aa, Raphanus sativus
MIKATWVSIFALAAILLVILVPVAEAVTCSPMQLSPCASAITSSSQPSALCCKKLKEQKPCLCGYMRNPSLRRLVSSPNARKVSNRCKLPIPRC

SEQ ID NO: 9249 - protein, 94 aa, Raphanus sativus
MIKASWVSLFAIAAVLLVILVPAAEAVTCSPMQLSPCAQAITSSSPPSALCCAKLKEQKPCLCGYMRNPSLRRFVSSPNARKVSNRCKLPIPRC

SEQ ID NO: 9250 - protein, 94 aa, Brassica napus
MIKASWVSLFAIAAVLLVILAPAAEAVTCSPMQLSPCAQAITSSSPPSALCCAKLKEQKPCLCGYMRNPSLRRFVSSPNARKVSNRCKLPIPRC

SEQ ID NO: 9251 - protein, 862 aa, Eutrema halophilum
MSSTSNSLMDSLFQRSLEDLIKGLRLQILGESTFISKSLDEIRREIKQTDLSTKSIALQKLSYLAALHGVDMSWAAFHAVEVVSSSRFAHKRIGYHAIAQSFNDQTPVLLLITNQLRKDLNSSNEYEVSLALECLSRIGTDDLARDLTPEVFTLLGSGKAFVRKKAIGVVLRVFDKYPDAVKVCFKRLVENLESSDPQLLSAVVGVFCELTTKDPRSYLPLAPEFYKILVDSRNNWVLIKVLKIFSKLASIEPRLAKKVADPICEHMRRTVGKSLVFECVRTVVSSLSDQETALKLAVAKIREFLVEDDPNLKYLGLHALSIVAPKHLWAVLENKEAVVKALSDEDPNVKLEALHLLMAMVNEDNVSEISRILMNYALKSDPLFCNEIIGSILLACSRNSYEIIVDFDWYLSLLGEMARIPHCQKGKEIEHQLIDIGTRVKDARLELVRVSRALLIDPALLGNQFLHPILSAAAWALGEYVEFSKTPYEIAEALLQPRTCLLPPSIRAIYIHSAFKVLVFSLGAYFSAKEPTSSPLVPESTTSGFSSVNGFTYKSISSLLNMIELGLCSLSGTLDVEVQERAKNVLGFIGMIKHEIAEKVTSQDSETEASRAIAFMEDIFSEELGPVSSTAQEKIPLPEGLELKENLEDLQEICREVLEPIDDSKSTSFSPSDKISFSIAKLRIRDQQEASSSSSPEPKSAYLLAEHRKRHGLYYLSSQKSDDHNDSNGNNNNNNTLNEYPPANEISVDSFNPKKKMNQSKPRPVVVKLDEGDESKTKPDASSNDEPLSRAIQTALMGKGKEKEREKDNHERDLDSGVNEQSLRRDKKKKKNGEKRSKHRSRRRRDEEVSATKPVEIPDFLL

SEQ ID NO: 9252 - protein, 94 aa, Arabidopsis lyrata
MIKTTWVSLFALATVLLMILAPAAEAVTCSPMQLSPCAAAITSSSPPSALCCAKLKEQKPCLCGYMRNPSLRRFVSSPNARKVSNRCRLPIPRC

SEQ ID NO: 9253 - protein, 94 aa, Brassica napus
MIKASWVSIFAFAAILLVIIVPAAEAVTCSPMQLSPCASAITSSSQPSALCCAKLKEQKPCLCGYMRNRSLRRFVSSPNARKVSNRCKLPIPRC

SEQ ID NO: 9254 - protein, 82 aa, Brassica juncea
ATWVSILALAAFLLVVLVPAAEAVTCSPMQLSPCASAITSSSQPSALCCAKLKEQKPCLCGYMRNPSLRRFVSSPNARKVSN

SEQ ID NO: 9255 - protein, 385 aa, Triticum aestivum
MVTIVGTREQFVQPQTFLRATMQLKSPTRPKLSFCFTPQGDCDQYCALIPGLPEDLAKICLALVPRTHFPVMGGVSKRWMSFLESKELIAVRKEVQKLDECVYVLTADAQAKGSHWEVLGCQGQKNTPLPPMPGPTKAGFGVVVLDGKLIVIAGYAADHGKECVSDEVYQYDCFLNRWTALSKMNVARCDFACAEVNGVIYVAGGFGPSGDSLSSVEVYDPEQNKWTLIEGLRRPRWGCFGCSFEGKMYVMGGRSSFTIGNSRYIDVYDTNSNAWGEFRNGCVMVTAHAVLGEKLFCIEWKNQRSLAIFEPADNSWKKVPVPLTGSSSTRFSLGIHDGKLLLFSLEEEPGYQTLMYDPAAPTGSEWCTSNLRPSGRCLCTVTIKA

SEQ ID NO: 9256 - protein, 384 aa, Triticum aestivum
MVTIVGTREQFVQPQSFLRATMLLKSPTRQLSFCFAPQGDCDQYCALIPGLPEDLAKICLALVPRTHFPVMGGVSKRWMSFLESKELIAVRKEVRKLDECVYVLTADSRAKTSHWEILGCQGQKNTPLPPMPGPTKAGFGVVVLDGKLIVIAGYAADHGKECVSDEVYQYDCFLNRWTALSKMNVARCDFACAEVNGVIYVTGGFGPSGDSLSSVEVYDPEQNKWTLIGGLRRPRWGCFGCSFEGKMYVMGGRSSFTIGNSRFIDVYDTNSHAWGEFRNGCVMVTAHAVLGEKLFCIEWKNQRSLAIFDPADNSWQKVPVPLTGSSSTRFSLGTHDGKLLLFSLEEEPGYQTLMYDPAAPKGSEWCTSKLRPSGLCLCTVTIKA

SEQ ID NO: 9257 - protein, 385 aa, Brachypodium distachyon
MLTLVGTREQFVQPQTCLRAKMLLKAPTRPKLSSCFMPQEECDQYCALIPGLPEDLAKICLALVPRCHFPIMGGVSKRWMSFLESKELIAVRREVGKLEECVYVLTADAEAKGSHWEVLGCPGQKHTPLPPMPGPTKAGFGVVVLAGKLFVIAGYAADHGKECVSDEVYQYDSCLNRWTALSKMNVARCDFACAEVNGMIYVAGGFGPGGDSLSSVEVYDPEQNKWTFIENLRRPRWGCFGCSFDGNMYVMGGRSSFTIGNSRFIDIYNTNNHTWGEVKKGCVMVMAHAVLGDKLFCIEWKNQRSLAIFNPEDNSWQKVSVPLTGSSSTRFNLGIHDGKLLLFSLEEEPGYETLMYDPAAPRGAEWGTSKLKPSGLCLCSVTIKA

SEQ ID NO: 9258 - protein, 385 aa, Cenchrus ciliaris
MLAIVGSQEHFSQSQTCLRARMQLKPPTRPKLYSGLMPHEDHDSYCDLIPGLPEDLAKICLALVPRSHFPVMGAVSKRWMSFLESKELIAVRKEVGKLEEWVYVLTPEAGTKGSHWEILECSGQTQSPLPRMPGLTKAGFGVVVIGGKLFVIAGYAADHGKEYVSDEVYQFDTCLNRWTLLAKMNVARCDFACAEVNGVIYVAGGFGPNGDSLSSVEVYDPEQNRWTLIESLRRPRWGCFGCSFEGKLYVMGGRSSFTIGNSRFVDVYNPINHAWGEFKNGCVMVTAHAVLGEKLFCIEWKNQRSLAIFNPADNSWQKVPVPLTGSSSTRFSLGIHDDKLLLFPLDEEPGYQTLMYDPAAPTGSEWCTSKLKPSGSCLCSVTVKA

SEQ ID NO: 9259 - protein, 385 aa, Setaria italica
MLAFVGSQEQFSQSQTCLRARMLLKPPTRPKLYSGLMPQEERDSYCDLIPGLPEDLAKICLALVPRSHFPVMGAVSKRWMSFLESKELIAVRKEVGKLEEWVYVLTPEAGTKGSHWEILECSGQTQSPLPRMPGLTKAGFGVVVIGGKLFVIAGYAADHGKEYVSDEVYQYDSCLNRWTLLAKMNVARCDFACAEVNGVIYVAGGFGPNGDNLSSVEVYDPEQNRWTLIESLRRPRWGCFGCSFEGKLFVMGGRSSFTIGNSRFVDVYNPINHAWGEVKNGCVMVTAHAVLGEKLFCIEWKNQRSLAIFNPADNSWQKIPVPLTGSSRTRFSLGIHDDKLLLFPLEEEPGYQTLMYDPAAPTGSEWCTSKLKPSGSCLCSVTIKA

SEQ ID NO: 9260 - protein, 364 aa, Oryza sativa
MQLKAPTRAKYSQGFMPIGESDAYCALIPGLPEDLAKICLALVPRSQFPVMGSVSKRWMSFLESKEFIAVRKEVGKLEEWVYVLTADAGSKGSHWEVLGCSGQKHSPLPPMPGPTKAGFGVVVLDGKLFVIAGYAADHGKECVSDEVYRYDSCLNRWVELSKMNVARCDFACAEVNGMIYVAGGFGPNGDSLSSVEVYDAEQNKWTLIESLRRPRWGCFACSFEGKLYVMGGRSRFTIGNTRFVDVYNPNDNSWGEVKNGCVMVTAHAVLDKKLFCIEWKNQRSLAVFNPADNSWQKVPVPLTGSSSTRFCFGIHDGKLLLFSLDEEPCYKTLMYDPAAPTGSEWFTSELKPPGLCLCSVTIRA

SEQ ID NO: 9261 - protein, 385 aa, Panicum virgatum
MLAFVGSQEQFAQRPTCLHARMLLKPPTRPKLYSGLMPEEEHDSYSDLIPGLPEDLAKICLALVPRSHFPVMGAVSKRWMSFLESKELIAVRKEVGKLEEWVYVLTPEAGTKGSHWQILECSGQTQSPLPRMPGLTKAGFGVVVIGGKLFVIAGYAADHGKEYVSDEVYQYDSCLNRWTLLAKMNVARCDFACAEVNGVIYVAGGFGPNGDNLSSVEVYDPEQNRWTLIESLRRPRWGCFGCSFEGKLYVMGGRSSFTIGNSRFVDVYNPINHAWGEFKNGCVMVTAHAVLGEKLFCIEWKNQRSLAIFNPADNSWQKIPVPLTGSSSTRFSLGVHDDKLLLFPLEEEPGYQTLMYDPAAPPGSEWCTSKLKPSGSCLCSVTIKA

SEQ ID NO: 9262 - protein, 385 aa, Pennisetum glaucum
MLAFVGSQEQFAQSQTCLRARMHLKPPTKPKLYSGLMPHEEHDSYCDLIPGLPEDLAKICLALVPRCHFPVMGAVSKRWMSFLESKELIAVRKEVGKLEEWVYVLTPEAGTKGSHWEILEGSGQTQSPLPRMPGLTKAGFGVVVIGGKLFVIAGYAADHGKEYVSDEVYQYDTCLNRWTLLAKMNVARCDFACAEVNGVIYVAGGFGLNGDSLSSVEVYDPEQNRWTLVESLRRPRWGCFGCSFEGKLYVMGGRSSFTIGNSRFVDVYNPTNHAWGEVKNGCVMVTAHAVLGEKLFCIEWKNQRSLAIFNPADNSWQKIPVPLTGSSSTRFSLGVHDDKLLLFPLAEEPGYQTLMYDPAAPVGSEWCTSKLKPSGSCLCSVTIKA

SEQ ID NO: 9263 - protein, 383 aa, Sorghum bicolor
MLAVSQEHLAHSQTCFRARMQLKPPTRPKLYSGLMPQEEFDSYCDLIPGLPEDLAKICLALVPRTHFPVMGAVSKRWMSFLESKELIAVRKEVGKLEEWVYVLTPDAGAKGSHWEILECSGQKQSPLPRMPGLTKAGFGVVVIGGKLFIIAGYSADHGKDCVSDEVYQYDSCLNRWTVLAKMNVARCDFACAEVNGVIYVAGGFGPNGESLSSVEVYDLEQNKWTLIEGLRRPRWGCFGCSFEGKLYVMGGRSSFTIGNSRFVDVYNPNNHAWDQVKNGCVMVTAHAVLGEKLFCIEWKNQRSLAIFNPADNSWQKVPVPLTGSSSTRFSFGVHEDKLLLFPLEEEPGYQTLMYDPAAPMGSEWCTSKLKPSGSCLCSVTIKA

SEQ ID NO: 9264 - protein, 364 aa, Sorghum bicolor
MQLKPPTRPKLYSGLMPQEEFDSYCDLIPGLPEDLAKICLALVPRTHFPVMGAVSKRWMSFLESKELIAVRKEVGKLEEWVYVLTPDAGAKGSHWEILECSGQKQSPLPRMPGLTKAGFGVVVIGGKLFIIAGYSADHGKDCVSDEVYQYDSCLNRWTVLAKMNVARCDFACAEVNGVIYVAGGFGPNGESLSSVEVYDLEQNKWTLIEGLRRPRWGCFGCSFEGKLYVMGGRSSFTIGNSRFVDVYNPNNHAWDQVKNGCVMVTAHAVLGEKLFCIEWKNQRSLAIFNPADNSWQKVPVPLTGSSSTRFSFGVHEDKLLLFPLEEEPGYQTLMYDPAAPMGSEWCTSKLKPSGSCLCSVTIKA

SEQ ID NO: 9265 - protein, 1706 aa, Avena sativa
MAPKAGRGKGRGGGKGDRKKKEEKVVPSVLDVTVTTPYESQVTLKGISTDRVLDVRKLLGSNVETCHLTNYSLSHVVRGHRLDDGVEIVALKPCALTIAEEEYATEEAAVAHVRRLLDIVACTTAFAKQKHKTSAKHARPATPPSPPTASSPAANGGKGAGDAPAISEAHDMAAIGPPPKLGEFYDFFSFAHLTPPLHFIRRKERNGATQEGDFFEIEVKVCNGKLLHIVASVKGFYLVGKPHTVSRSLVDLLQQLSTGFANAYEALMKAFVDHNKFGNLPFGFRANTWLVPPVYVDAATKSPALPVEDENWGGHGGGCGRDGKYDRRRWAKEFSILARMPCKTEEERVIRDRKAFLLHNLFVDTAIFRAASTIRRLVDTSPQTGSDGSLVFEERVGDMHMTVKKDEADASLKLGDKVDGAAVYQTDSMDISQRNLLKGLTSDESVVVKDSSTLGVVIVKHCGYTATVRVSGRTKIIGDSKQASDISDHLDGMLSIDVDDQPDGGSNALNVNSLRIPLPKIMNPEVAASNQHLTSKSHVDNYARKLARTVLKASLMKLENLPNKNPRHIRWELGSSWLQHLQKKDSSVSEDSEKSAKKVEKDSSVKGLGKHFEQLRKIKKNAEDAKSEKEESDSNCSLTNGMEESDNLALNETSEAEIRKLIPEDAFCRLESLGAGFHQKTLDELTKMAHKFYDDTALPKLVADFASLELSPVDGRTMTDFMHTRGLNMCSLGRVVELAEKLPHIQSICIHEMVIRSFKHVIRAVIAAVDDMQNMSAVIAETLNILLGSPRLDNNLDTDAHNEHNLKLKWIESFLSKRYCWKLKDEFEHLRKSIILRGLCGKVGLELVARDYDMNSPNPFDKSDIVNLVPICKHVVYSSIDSRNLLESSKMALDKGKLDDAVNYGAKALSKVIAVCGPYHRLTANAYSLLAVVLYHTGDFNQATIYQQKALDINERELGLDHPETMKSYGDLSVFYYRLQHIEMALKYVNRALYLLQFSCGLSHPNSAATYINVAMMEEGMGNVHVALRYLHEALKCNKRLLGADHIQTAASYHAIAIALSMMDAYSLSVQHEQTTLQILQDKLGEDDLRTQDAAAWLEYFDSKALEQQEAARRGIPKPDSSIASKGHLSVSDLLDYISPDQERKERDMQRKCRRAKNNTRAQQGESVDEKENFQHDSVFLLEADKNDIQEAKLEVQAPVVAAVTEAIYAVHDELKQVDALSPEEYSDEGWQAATLRGRSANVRKKSIRRRPALTKLVVDHIEDGRTASATRTGVQQQTKEHKEEAIYSPSQLSFGNFLKSDKLNGDPSITEDKSSNAMSKPERSIKPAGINRPTSIASKLVSYKDVAASPPGTVWKPILEQKEAKEKDIEQDTDVTPSSEEEDRKLTDEVEKSSEEGSKEIVSSQPEGGSHSEKASDSNSDGSTSPHKKTSGSKLSASAPPFNPGSLLSVSHPYSTVAIYDASVVLQPIPSQAMEILPHAVDTRVPRGPRSTLYYRTGHSFQRKQGYTQSQSTILRGSTSPPAMNPHAAEFVPGKTAQQTDSANGEHVTDSAEQQLAPQTSEEVKVDIHAAEKAGQLEKTTSGKGKENRGRDTMRDSYKAELARQILLSFIVKSVHDSLGSTRAQPDRKPSVLDEASIEQSSNVTKSTSGGRKEFDKQPKAAEVPKSDKDTEGFTVVSKRRRSKQHFVNPINGLYSQQSICTSVS

SEQ ID NO: 9266 - protein, 618 aa, Avena sativa
MAPKAGRGKGRGGGKGDRKKKEEKVVPSVLDVTVTTPYESQVTLKGISTDRVLDVRKLLGSNVETCHLTNYSLSHVVRGHRLDDGVEIVALKPCALTIAEEEYATEEAAVAHVRRLLDIVACTTAFAKQKHKTSAKHARPATPPSPPTASSPAANGGKGAGDAPAISEAHDMAAIGPPPKLGEFYDFFSFAHLTPPLHFIRRKERNGATQEGDFFEIEVKVCNGKLLHIVASVKGFYLVGKPHTVSRSLVDLLQQLSTGFANAYEALMKAFVDHNKFGNLPFGFRANTWLVPPVYVDAATKSPALPVEDENWGGHGGGCGRDGKYDRRRWAKEFSILARMPCKTEEERVIRDRKAFLLHNLFVDTAIFRAASTIRRLVDTSPQTGSDGSLVFEERVGDMHMTVKKDEADASLKLGDKVDGAAVYQTDSMDISQRNLLKGLTSDESVVVKDSSTLGVVIVKHCGYTATVRVSGRTKIIGDSKQASDISDHLDGMLSIDVDDQPDGGSNALNVNSLRIPLPKIMNPEVAASNQHLTSKSHVDNYARKLARTVLKASLMKLENLPNKNPRHIRWELGSSWLQHLQKKDSSVSEDSEKSAKKVRKRFICQRSWQALRTVKEN

SEQ ID NO: 9267 - protein, 1551 aa, Triticum aestivum
GVGAGEAPAISEAHDMQAIGPPPKLGEFYDFFSFAHLTPPLHFIRRKERNGAAQDGDYFEIEVKVCNGKLLHIISSVKGFYLVGKPHTVSRSLVDLLQQLSSGFANAYEALMKAFVDHNKFGNLPFGFRANTWLVPPVYVDSATKSPALPAEDENWGGNGGGCGRDGKHDRRRWAREFSILARMPSKTEEERVIRDRKAFLLHNLFVDTAIFRAASTIRRLVDTSPQTGPDGSLVLEERVGDLHITVKKDEADASLKLEDKVDRVAIYQTDAMDISQRNLLKGLTSDESVVAKDSSTLGVVIVKHCGYTATVKVSGRTKNSSDGKQTSDISDHLDEIPNIDVDDHPDGGSNALNPHSLRIPLPKIINPEIVASNQHLASKPHVDNYARKLACTVLETSLRKLENTPNKNPRRIRWELGSSWLQHFQKKDASISEDSEKNAKKSEKDSSVKGLGKHFEQLRKINKKESTIEDAKTVKEESDSNCLLTNGTEKSENVVFTEIRNLITEDAFCRLKSLEAGLHQKSLEELTKMAHKFYDDTALPKLVADFASLELSPVDGRTMTDFMHTRGLNMCSLGRLVELGEKLPHIQSICIHEMVIRAFKHVIRAVIAAVDDMQNMSAVIAETLNILLGSPRLENDLDTDANEHNLRLKWVESFLSKRYCWTLKDEFAHLRKPIILRGLCSKVGLELVARDYDMNSPNPFDKSDIVNIVPICKHVVYSSIDSRNLLESSKMALDKGKLDDAVNYGAKALSKVIAVCGPYHRLTANAYSLLAVVLYHTGDFNQATIYQQKALDINERELGLDHPETMKSYGDLSVFYYRLQHIEMALKYVNRALYLLQFSCGLSHPNSAATYINVAMMEEGMGNVHVALRYLHEALKCNKRLLGADHIQTAASYHAIAIALSMMDAYSLSVQHEQTTLQILQEKLGDDDLRTQDAAAWLEYFDSKALEQQEAARRGIPKPDSSIASKGHLSVSDLLDYISPDQERKERDMQKKCRRAKNNTRAHQGEPVEEKENFQHDSGSLLEADKKDFQEAKLEANPRVVAAVAEETYAVHDELKQVDTLSPEEYSDEGWQAATLKGRSANVRKKSIRRRSSLTKLVVDRTEDGRTASAHRSGVQPQAKEHKEEAVNSPSQLSFGNFIRSDKLNGDPVITEEKSSKGTSKSEWKVKPTGIKRPTSIASKLVSYKDVAVSPPGTVWKPILEQKETKEKDNEQDTDVAPSSEEGDRKLIDEEKEKSSDESSKENVSTQPEGSSPPEPEKASDSNSDGSSSPGKKTSGSKLSASAPPFKPGSLLSVSHPYSTVAIYDASVVLQPIPSQAMEILPHAVDTRVPRGPRSTLYYRTGHSFQRKQGYTQSQSTILRGSTSPPTMNPHAAEFVPGKTVQQTDLAAGEQTNSVSDPADQQLASHASDGVKVDVREADKAGQVEKTTPGKVKERAKEATRDSYKAELARQILLSFIVKSVHDSLGSTRPQPDRKPSGSDEASNEQSSNVTKTAVSPKEFDKQPKAAEVPKSEKDTEGFTVVSKRRKSKQHFVNPINGLYSQQSICTSVS

SEQ ID NO: 9268 - protein, 1750 aa, Brachypodium distachyon
MAPKAGRGKGKGGKGDRKKKEEKAVPNAIDVTVTTPYESQVTLKGISTDRVLDVRRLLGSNVETCHLTNYSLSHVVMLLDRPLLFPFVLTLNGPGARASAGGRRGNRGAEALRSHDRGSPKRTINSAMVLTGPNNCFYADEYATEEAAVAHIRRLLDIVACTTAFAKPRDGAKHKQSKHGPPATPPSPPAANGDSGAAVAAAASAISEAHDMAAIGPPPKLGGFYDFFSFAHLTPPLHFIRRKEMNASAQEGDYFDIEVKVCNGKLLHVVSSVKGFYLAGKPHTVSRSLVDLLQQLSSGFANAYEALMKAFVDHNKFGNLPYGFRANTWLVPPIYVDSATKSPALPVEDENWGGHGGGCGRDGKYDRRRWAKEFTILARMPCKTEEERVIRDRKAFLLHNLFVDTAIIRAASTIRRLIGTSPQTSPDGLLVLDERIGDLHITVNKDEADASLKLEDKVDGVAVYQTGDMDISQRNLLKGLTSDESVVAKDSSTLGVVIVKHCGYTATVKVSGRTKNCSDDKQTSDISDHLDGFLNIDVDDHPDGGSNALNVNSLRIPLPKIVNADIAASNQHLASKSHADNYARKLARTVLESSLMKLENTPNKNPRLIRWELGSSWLQHLQKKDSSVSENGEKNAKKAEKDPSVKGLGKHFEQLRKIKKKECIVEGAKSDKEESDSNYSLANGMEESDNVAFSKTNKEADMRKLIPEDAFCRLKSLGAGFHQKSLEELTKMAHKFYDDTALPKLVADFASLELSPVDGRTMTDFMHTRGLNMCSLGRVVELAEKLPHIQSICIHEMVIRSFKHVIRAVIAAVDDMQNMSAAIAETLNILLGSPRLENDLHSDAHNEHKLRLKWVESFLSKRYCWKLKDEFAHLRKSIILRGLCSKAGLELVARDYDMNSPNPFDKSDIVNIVPVCKHVVYSSIDSRNLLESSKMALDKGKLDDAVNYGAKALSKVIAVCGPYHRLTANAYSLLAVVLYHTGDFNQATIYQQKALDINERELGLDHPETMKSYGDLSVFYYRLQHIEMALKYVNRALYLLQFSCGLSHPNSAATYINVAMMEEGMGNVHVALRYLHEALKCNKRLLGADHIQTAASYHAIAIALSMMDAYTLSVQHEQTTLQILQEKLGEDDLRTQDAAAWLEYFDSKALEQQEAARRGIPKPDSSIASKGHLSVSDLLDYISPDQERKERDMQRKCRRAKNNTRAHQGESVEEKENSQHDSGSLQADKKDFQETKLEVHTPVVAEQIQIHAVHDELKQADTLSPEEYSDEGWQAATLRGRSANVRKKSIRRKPSLSKLVVDRVEDGHTASAYRTGVQPQTKGDKEEAINSPSQLSFGNFFKSDKLSGDTATIEDMLCKAKSKPERSIKPPGINRPTNIASKLVSYKDVAVSPPGTVWKPILEKKEAKEKDNGQCTDVVLPSEKEDKKLTDEEKEKLGSESSKEVVSSQTEGVGHAEKAPDSNSDESPSPQKKANGSKLSASAPPFNPGSLLSVSHPYSTVAIYDASVLLQPIPSQAMEILPHAVDTRVPRGPRSTLYYRTGHSFQRKQGYTQSQSTIQRGSTSPPAMNPHAAEFVPGKSLPQTDVANGEHTSTTDSADQHLASQASDEVKVDIPAADKAGETENTTPGKGKENRGRDAMRDSYKAELARQILLSFIVKSVHDSLGSTRAQPDRKPIGSEEGSKEQISNITKTVSGRKEVDKQPKAAEAPKSEKDTEGFTVVSKRRRSKQHFVTPINGLYSQQSIATSVS

SEQ ID NO: 9269 - protein, 319 aa, Brassica napus
SSSSSSSPSSLLLPNINFHSTTTRSVSIPGIFLPRNRLRYSHNLPLRIRASRDDNVAVEDRGNAVINGNGSVRLNGNGATRKSINNGDLNGNGRLNGNGSLVKYVNGSVTEEVSKKREEEKRQKRVEDIGQEDAWFKKTQQKQQVEVSVAPGGRWSRFKTYSTIQRSLEIWGFVITFIFRTWLSGQKFSYKGGMTEEKKVLRRKVLAKWLKENILRLGPTFIKIGQQFSTRVDILPQEYVDQLSELQDQVPPFSSATALSIVEEELGASVDDIFDRFDYEPIAAASLGQVHRARLKGQEVVIKVQRPGLKDLFDIDLKN

SEQ ID NO: 9270 - protein, 761 aa, Eutrema halophilum
MATSSSSSSSSSLLLPNINFHSRQSTITRSISIPGIFLPRNRLRYNHNLPLRIRASKDDNVAVEDRENAVIRQVNGNGSVRLNGNGAARKPVNGDYNGSARVNGSGNGSLVKYVNGSVTVETEEVSKKRKEEVRQKRVEDIGQEDAWFKNTQQKQQVEVSVAPGGRWSRFKTYSTIQRTLEIWGFVLTFIFRTWLSNQKFSYKGGMTEEKKVLRRKILAKWLKENILRLGPTFIKIGQQFSTRVDILPQEYVDQLSELQDQVPPFSSATALSIVEEELGGSVDDIFDRFDYEPIAAASLGQVHRARLKGQEIVIKVQRPGLKDLFDIDLKNLRVIAEYLQKVDPKSDGAKRDWVAIYDECASVLYQEIDYTKEAANSELFANNFKNLEYVKVPSIYWEYTTPQVLTMEYVPGIKINKIQALDQLGVDRKRLGRYAVESYLEQILSHGFFHADPHPGNIAVDDVNGGRLIFYDFGMMGSISPNIREGLLEAFYGVYEKDPDKVIQAMVQMGVLVPTGDLTSVRRTALFFLNSFEERLAAQRKEKEEIAAAEELGFKKPLSKEEKQEKKKQRLAAIGEDLLAIAADQPFRFPATFTFVVRAFSVLDGIGKGLDPRFDITEIAKPYALELLRFREAGVEVVVKDLRKRWDRQSQAFYNLFRQADRVEKLAVIIQRLEQGDLKLRVRALESERAFQRVAAVQKTVGSAVAAGSLVNLATILYLNSLKTPATIAYTVCAFFSLQVLIGVIKVKKFDQREKLITGTA

SEQ ID NO: 9271 - protein, 761 aa, Eutrema parvulum
MAASSSSSSSSSLLLPNINFHSRQSSTITRSVSIPGIFLPRNRLSYNHNLTLRIRASKDDNVAVEDRENAVIKQVNGNGSVRLNGNGAARKPINGDYNGSARLNGNGNGSLVKYVNGSVTVETEEVTKKRKEEVRQKRVEDIGQEDAWFKKSQRKQVEVSVAPGGRWSRFKTYSTIQRTLEIWGFVLKFIFRTWLSNQKFSYKGGMAEEKKVIRRKILAKWLKENILRLGPTFIKIGQQFSTRVDILPQEYVDQLSELQDQVPPFSSATALSIVEEELGASVDDIFDRFDYEPIAAASLGQVHRARLKGQEVVLKVQRPGLKDLFDIDLKNLRVIAEYLQKVDPKSDGAKRDWVAIYDECASVLYQEIDYTKEAANSELFANNFKNLEYVKVPSIYWEYTTPQVLTMEYVPGIKINKIQALDQLGVDRKRLGRYAVESYLEQILSHGFFHADPHPGNIAVDDVNGGRLIFYDFGMMGSISPNIREGLLEAFYGVYEKDPDKVIQAMVQMGVLVPTGDLTSVRRTALFFLNSFEERLAAQRKEKEEIAAAEQLGFKKPLSKEEKQEKKKQRLAAIGEDLLAIAADQPFRFPATFTFVVRAFSVLDGIGKGLDPRFDITEIAKPYALELLRFREAGVEVVVKDLRKRWDRQSQAFYNLFRQADRVEKLAAIIQRLEQGDLKLRVRALESERAFQRVATVQKTVGSAVAAGSLVNLATILYLNSLKTPATIAYTVCAFFSLQVLIGVIKVKKFDQREKLITGTA

SEQ ID NO: 9272 - protein, 373 aa, Brassica napus
MAASSSSSSSPSSLLLPNINFHSTTTRSVSIPGIFLPRNRLRYSHNLPLRIRASRDDNVAVEDRGNAVINGNGSVRLNGNGATRKSINGDLNGNGRLNGNGSLVKYVNGSVTEEVSKKREEEKRQKRVEDIGQEDAWFKKTQQKQQVEVSVAPGGRWSRFKTYSTIQRTLEIWGFVITFIFRTWLSGQKFSYKGGMTEEKKVLRRKVLAKWLKENILRLGPTFIKIGQQFSTRVDILPQEYVDQLSELQDQVPPFSSATALSIVEEELGASVDDIFDRFDYEPIAAASLGQVHRARLKGQEVVIKVQRPGLKDLFDIDLKNLRVIAEYLQKVDPKSDGAKRDWVAIYDECASVLYQEIDYTKEAANSELLLIT

SEQ ID NO: 9273 - protein, 755 aa, Arabidopsis lyrata
MATSSSSSSLLLPNINFNSRQSTTVAGIFLPRNRLSYNHNLQLRTRIIRASKDDNVAVEDRGNAVINGDYNNGSARLNGNGSARKSVNGDYNGSARLNGNGNGSLVKYVNGSVTVETEEVTKKRKEEVRKKRVEDIGQEDAWFKNTQQKQVEVSVAPGGRWNRFKTYSTIQRTLEIWGFVVQFIFRTWLSNQKFSYKGGMTEEKKVLRRKILAKWLKENILRLGPTFIKIGQQFSTRVDILPQEYVDQLSELQDQVPPFPSATALSIVEEELGGSVEDIFDRFDYEPIAAASLGQVHRARLKGQEVVLKVQRPGLKDLFDIDLKNLRVIAEYLQKVDPKSDGAKRDWVAIYDECASVLYQEIDYTKEAANSELFANNFKNLEYVKVPSIYWEYTTPQVLTMEYVPGIKINKIQALDQLGVDRKRLGRYAVESYLEQILSHGFFHADPHPGNIAVDDVNGGRLIFYDFGMMGSISPNIREGLLEAFYGVYEKDPDKVLQAMVQMGVLVPTGDLTAVRRTALFFLNSFEERLAAQRKEKEEIAAAEELGFKKPLSKEEKQEKKKQRLAAIGEDLLAIAADQPFRFPATFTFVVRAFSVLDGIGKGLDPRFDITEIAKPYALELLRFREAGVEVVVKDLRKRWDRQSQAFYNLFRQADRVEKLAVVIERLEQGDLKLRVRALESERAFQRVAAVQKTVGSAVAAGSLVNLATILYLNSLKTPATIAYTVCAFFSLQVLIGVIKVKKFDQREKLITGTA

SEQ ID NO: 9274 - protein, 169 aa, Brassica napus
MLLNLTWSRSCLMDSFMPTLTRGNIAVDDVNGGRLIFYDFGMMGSISPNIREGLLEAFYGVYEKDPDKVIQAMVQMGVLVPTGDLTSIRRTALFFLNSWILSQFRRAACCTKKRERRTSSSRRAWVKKPLTKEEKQEKKKQRLAAIGEDLLAISADQPFRFPATFTICC

SEQ ID NO: 9275 - protein, 761 aa, Arabidopsis thaliana
MATSSSSSSSLLLPNINFNSRQSPTITRSVSIAGIFLPRNRLSYNHNLRIRTRLIRASKDDNVAVEDRDNAVKINGDYNGSARLNGNGSARKSVNGDFNGSARLNGNGSLVKYVNGSVTVETEEVTKKRKEEVRKKRVEDIGQEDAWFKNNTQQKQVEVSVTPGGRWNRFKTYSTIQRTLEIWGFVVQFIFRTWLSNKKFSYKGGMTEEKKVLRRKVLAKWLKENILRLGPTFIKIGQQFSTRVDILPQEYVDQLSELQDQVPPFPSATALSIVEEELGGSVEDIFDRFDYEPIAAASLGQVHRARLKGQEVVLKVQRPGLKDLFDIDLKNLRVIAEYLQKVDPKSDGAKRDWVAIYDECASVLYQEIDYTKEAANSELFANNFKDLEYVKVPSIYWEYTTPQVLTMEYVPGIKINKIQALDQLGVDRKRLGRYAVESYLEQILSHGFFHADPHPGNIAVDDVNGGRLIFYDFGMMGSISPNIREGLLEAFYGVYEKDPDKVLQAMVQMGVLVPTGDLTAVRRTALFFLNSFEERLAAQRKEKEEIAAAEELGFKKPLSKEEKQEKKKQRLAAIGEDLLAIAADQPFRFPATFTFVVRAFSVLDGIGKGLDPRFDITEIAKPYALELLRFREAGVEVVVKDLRKRWDRQSQAFYNLFRQADRVEKLAVVIERLEQGDLKLRVRALESERAFQRVAAVQKTVGSAVAAGSLVNLATILYLNSIKTPATIAYTVCAFFSLQVLIGIIKVKKFDQREKLITGTA

SEQ ID NO: 9276 - protein, 556 aa, Brassica napus
MTEEKKVLRRKVLAKWLKENILRLGPTFIKIGQQFSTRVDILPQEYVDQLSELQDQVPPFSSATALSIVEEELGASVDDIFDRFDYEPIAAASLGQVHRARLKGQEVVIKVQRPGLKDLFDIDLKNLRVIAEYLQKVDPKSDGAKRDWVAIYDECASVLYQEIDYTKEAANSELFANNFKNLEYVKVPSIYWEYTTPQVLTMEYVPGIKINKIQALDQLGVDRKRLGRYAVESYLEQILSHGFFHADPHPGNIAVDDVNGGRLIFYDFGMMGSISPNIREGLLEAFYGVYEKDPDKVIQAMVQMGVLVPTGDLTSIRRTALFFLNSFEERLAAQRKEKEELAAAEELGFKKPLTKEEKQEKKKQRLAAIGEDLLAISADQPFRFPATFTFVVRAFSVLDGIGKGLDPRFDITEIAKPYALELLRFREAGVEVVVKDLRKRWDRQSQAFYNVFRQADRVEKLAVIIQRLEQGDLKLRVRALESERAFQRVAAVQKTVGSAVAAGSLVNLATILYLNSLKTPATIAYTVCAFFSLQVLIGVIKVKKFDQREKLITGTA

SEQ ID NO: 9277 - protein, 764 aa, Cleome spinosa
MAASSSSLLLPDINFLSRQSTIVRRRVSLSGILLSRNRLRCRNLPPLTRIRASKADSVAVEDRENAVIKQVNGSVGLNGNGAASSRSVNGDYRYESSIEKYTNNNLNGNGSSVKYVNGGVSTVPKVEPEEVLESRKEEVRKKRIEDIGKEDAWFKKSQQEQVEVSVAPGGRWSRFKTYSTIQRTVEIWGFVLTFIFRTWLSNQKFSYKGGMTEEKKVLRRKTLAKWLKENILRLGPTFIKIGQQFSTRVDILPQEYVDQLSELQDQVPPFPSETALSIVEEELGAPVGEIFDSFDYEPIAAASLGQVHRARLKGQEVVVKVQRPGLKDLFDIDLKNLRVIAEYLQKVDPKSDGAKRDWVAIYDECASVLYQEIDYTKEAANAEQFASNFKSLDYVKVPAIFWDYTTPQILTMEYVPGIKINKIQALDQLGVDRKRLGRYAVESYLEQILSHGFFHADPHPGNIAVDDVNGGRLIFYDFGMMGSISPNIREGLLETFYGVYEKDPDKVLEAMVQMGVLVPTGDMTAVRRTAQFFLNSFEERLVAQRKEREMATAELGFKKPLTKEEKIEKKKQRLAAIGEDLLSIAADQPFRFPATFTFVVRAFSVLDGIGKGLDPRFDITEIAKPYALELLRFREAGVEVVLKDLRKRWNRQSQAFYNLFRQADRVEKLAETIQRLEQGDLKLRVRTLEAERAFQRVGAVQKTVGSAVAAGSLINLATILYLNSVKVPATIAYTLCAFFSVQVLVGIIKVKKLDQREKLITGTA

SEQ ID NO: 9278 - protein, 221 aa, Brassica rapa
MVLWVFGYGSLIWNPGFDFDEKLIGYIKDYKRVFDLGCIDHRGTPEHPARTCTLEESTGAICWGAAYCVRGGPEKEKLAMEYLEGRECEYDSKTLVEFYTETDTTKQSKPILTGVIVFTSTPDKLSNKYYLGPAPLEEMAMQIATASGPCGNNREYLFKLEKAMHDIEHEDEYVIELANEVRKHLDLPKEVKALLKPVVSRVSIKSHSQAHASTLQRVFAS

SEQ ID NO: 9279 - protein, 221 aa, Brassica napus
MVLWVFGYGSLIWNPGFDFDEKLIGYIKDYKRVFDLGCIDHRGTPEHPARTCTLEESTGAICWGAAYCVRGGPEKEKLAMEYLEGRECEYDLKTLVEFYTETDTTKQSKPILTGVIVFTSTPDKLSNKYYLGPAPMEEMAMQMATASGPCGNNREYLFKLEKAMHGIEHEDEYVIELANEVRKHLDLPKEVKALLKPVVSRVSIKSHSQAHVSTLQRVFAS

SEQ ID NO: 9280 - protein, 218 aa, Eutrema parvulum
MVLWVFGYGSLIWNPGFDFDEKLIGYIKDYKRVFDLACIDHRGTPEHPARTCTLEQSTGAICWGAAYCVRGGPEKEKLAMEYLERRECEYDSKTLVEFYTETDTSKPILTEVIVFTSTPDKVSNKYYLGPAPLEEMAKQIATASGPCGNNREYLFKLEKAMHDIEHEEEYVIELANEVRKHLDLPNEVKALLKPVVSRVSIKSQSQAHVSPLQRVFAS

SEQ ID NO: 9281 - protein, 218 aa, Brassica juncea
MVLWVFGYGSLIWNPGFDFDEKLIGYIKDYKRVFDLGCIDHRGTPEHPARTCTLEDSAGAICWGAAYCVRGGPEKEKLAMEYLEGRECEYDSKTLVEFYTETDTTKPILTGVIVFTSTPDKRSNKYYLGPAPLKEMAVQIATASGPCGNNREYLFKLEKAMHAIEHEDEYVIELANEVRKQLDLPEEVKALLKPVVSPVSIKPRSQAHVSNLQRVFAS

SEQ ID NO: 9282 - protein, 218 aa, Raphanus sativus
MVLWVFGYGSLIWNPGFDFDEKLIGYIKDYKRVFDLACIDHRGTPEHPARTCTLEQSTGAKCWGAAYCVRGGPEKEKLAMEYLEGRECEYDSKTLVEFYSETDTTKPILTGVIVFTSTPDKVSNKYYLGPAPLEEMAMQIATASGPCGNNREYLFKLEKAMHDIEHEDEYVIELANEVRKHLDLTKEVKALLNPVVSPVSIKPQSQAHVSTLQRVFAS

SEQ ID NO: 9283 - protein, 216 aa, Arabidopsis thaliana
MVLWVFGYGSLIWNPGFDFDEKLIGYIKDYKRVFDLACIDHRGTPEHPARTCTLEQSTGAICWGAAYCVRGGPEKEKLAMEYLERRECEYDSKTLVEFYTENDTSTPIVTGVIVFTSTPDKVSNKYYLGPAPLEEMARQIATASGPCGNNREYLFKLEKAMFDIEHEEEYVIELANEVRKQLDLPEEVKALLKPIVSHVSVKSQAHVSTRQRVFAS

SEQ ID NO: 9284 - protein, 220 aa, Eutrema halophilum
MVLWVFGYGSLIWNPGFQFDEKLIGYIKDYKRVFDLACIDHRGTPEHPARTCTLEQSTGAICWGAAYCVRGGPEKEKLAMEYLERRECEYDSKTLVEFYTETETSKPILTGVIVFTSTPDKVSNKYYLGPAPLEEMAKQIATASGPCGNNREYLFKLEKAMHDIEHEEEYVIELANEVRKQLDLPKEVKSLLKPSVSHVPINSQAQAQAHVSTLPRVFAS

SEQ ID NO: 9285 - protein, 218 aa, Arabidopsis lyrata
MVLWVFGYGSLIWNPGFDFDEKIIGYIKDYKRVFDLACIDHRGTPEHPARTCTLEQSTGAICWGAAYCVRGGPEKEKLAMEYLDRRECEYDSKTLVEFYTENDSSTPTPIVTGVIVFTSTPDKVSNKYYLGPAPLEEMARQIATATGPCGNNREYLFKLEKAMYDIEHEEEYVIELANEVRKQLDLPEEVKALLKPVVSRVPVKSQAHVSTRQRVFAS

SEQ ID NO: 9286 - protein, 122 aa, Raphanus sativus
MVLWVFGYGSLIWNPGFDFEEKLIGYIKDYKRVFDLACIDHRGTPEHPARTCTLEQSPGAICWGAAYCVRGGPEKEKLAMEYLERRECEYDSKTLVEFYTETDTSEPVLTGVLVFTSTPVSR

SEQ ID NO: 9287 - protein, 1031 aa, Eutrema parvulum
MERVGEETVASNSIQLKGRGDDVPCKLDARHMVTESEAGNDSLRSDCPGSSAHRNVDMNKPPEESAGAKLSVEELTLGNYRMVQGSNNNSNNNNNNNIDSSRAGKFEHLYRLARGSPFRAGDGDLDSQPRDMDQMLSRIRQQLAGAPSERQNLKPLMNRRSDQNLEAFSERLRAAGENSLMNAPAWINEGVHLKTPLSSSSFSQMILKRAMKGKGVVGKNQETPPEFVSEQDIGCKEKKVDNSKSPIPHNVLTLKSSPKGNGIVSHGSTKSSFGISLREFIRSSYAKREKRHSLCLFRQLVELVDSAHSQGSFLLDLRPSLFTLVPSKKLRYIGTFGKNSLGSEVDEDSNRKRPVVQESYIVGRDLKKRKLDWHVHSPGNQLQATSTGRPFKRKSPVIDLNVVDARNPDSCELQQQNYIKNLGVASMTKKQSMSTWLEEQWYTCPDEINGEDSGEKSNIYALGVLLFELLCHCESSEMHAAMMADLHHRILPPTFLSKYPREAGFCLWLLHPEPSARPTARGILKSELICEDDSVMSTAADEEISELLLHFLSSLEEQKKKNASKLLQDIQTLEDDIKEAERRYSSKASLVRSHGAIESRVQSSPLDERCTTSSGALFVPTANTDRLMSNIRQLEDAYFFMRSHMKLSDSAASARSDKSLLKDRDRCSENQIENQDTKTKGKSSDQLEVFFEGLCKFARYSKFETCGTIRSGDLLNSASVVCSLSFDPDEEHIAAAGISKKIKIFDFNAFMNESVGVHYPLVEMVNKSKLSCVCWNSYIKNYLASTDYDGVVQIWDAGTGQGFSQYTEHQKRAWSVDFSPSDPTKFVSGSDDCSVKLWSVNEKRSLGTIWSPANVCCVQFSAYSNHLMAFGSADYKVYCYDLRYVKTPWCTLAGHEKAVSYVKFMDSDTIVSASTDNSLKLWNLNKTNSSGLSPGACSLTYKGHTNQKNFVGLSVLDGYIACGSETNEVYSYYRSLPMPMTSYKFGSVDPISGNEYFDDNGQFVSSVCWRKKSNMLVAANSTGNMKLLKLV

SEQ ID NO: 9288 - protein, 1001 aa, Eutrema halophilum
MPVMERVGEETVASNNIKLKGRVDDVPCKLDGRQMVTESETGNDSLRSDCPGSSAHRNVDINKPSEESAGAKISVEELTLGNYRVVQGINNNMDSSRAGKFEHLYRLARGSAFKAGEGELDSQPRDMDQMLSRIRQQLAGAPSERQNLKPFTNRRSDQNLEAFSERLRAAGENSIMNAPAWINESVHLKTPLTSSSFSQMILKRAMKGKGVVGKNQETPPEFVFVMGNGIVSHGDGNNTKSSFGISLREFLKSSYAKREKRHSLCLFRQLVELVDSVHSQGLFLLDLRPSRLTLAPSKKLRYIGTLGKNSLDSDIDEDLNRNRPVVQESSIVGRDLKKRKMDLRVHSPGNQLQATSTGRPFKRKSPVIDLNVVDARNPDSCELQQQNYIKNLGVASMTRKQSTSTWLEEQWYTCPEEINGEDIGEKSNIYALGVLLFELLCHCESSEMHAAMMADLRQRILPPTFLSRYPKEAGFCLWLLHPEPSSRPTAREILKSELISEDDSVISTAADEEISELLLHFLSSLEEQKQKKASKLLKDIQTLEDDIKEAERRYSSNASLVRSHGAIERRVQTSPLDVRCTTTSGALFVPTPNTERLMSNIRQLEDAYFFMRSQMKLSDSAASARSDKSLLKDRDRWSENQNENHNTRTKGKSSDQLEVFFEGLCKFARYSKFETCGTIRSGDLLNSASVVCSLSFDPDEEHIAAAGISKKIKIFDFNAFMNESAGLHYPLVEMVNKSKLSCVCWNSYIKNYLASTDYDGVVQIWDAGTGQGFSQYTEHQKRAWSVDFSPSDPTKFVSGSDDCSVKLWSVNEKRSLGTIWSPANVCCVQFSAYSNHLLAFGSADYKVYCYDLRYVKTPLCTLAGHEKAVSYVKFMDSETIVSASTDNSLKLWNLNKTNSSGLSPGACSLTYKGHTNQKNFVGLSVLDGYIACGSETNEVYSYYRSLPMPMTSYKFGSVDPISGNEYFDDNGQFVSSVCWRKKSNMLVAANSTGNMKLLKLV

SEQ ID NO: 9289 - protein, 1029 aa, Arabidopsis thaliana
MPVMERVAEETVATNNIQLKARVDDVPCNKLDARHNDMVIQSETANSDCPGSSAHRNVDLTKPPPPEEAAGAKLSVEELTLGNYRIVQGSNNTNVDSPRAGKFEHLYRLARGSAFRAGDGDLDSQPRDMDQMLSRIRQQLAGAPSERQNLKPFMSRRSDQNLEAFSERLRAAGENSIMNAPALISEGVQMKTPVSSSNFSQLLLKRAMKGKGVVGKNQETPPEFVSDQDLGSKEKKLDISKSPTPHDVLPLKSSPKGNGMVSHGDGNHSKSSIGISLREFLRSSYAKREKRHGLCLFRQLVELVDSAHSKRLFLLDLRPSLFTLVPSKKLRYIGNFGKNDLESDVDEDLNRRRPVVEESSSGGRDSKKRKMDLHLNSPGNQLQATSTGRPFKRKSPVIDLNMVDARNPDSCELQQQDYIKNLSVSSVSRKQSMSTWLEEQWYTCPEEINGEDIGEKSNIYALGVLLFELLCHCESGEMHAAMMADLRHRILPPTFLSKYPKEAGFCLWLLHPEPSSRPSARDILKSELICEDDSVKSTAAAEEISELLLHFLSSLEVQKKKKASKLLQDIQTLEDDIKEAERRYSSNVSLVRSHGAIEKRVQSSPLDEHCTTSSALFVPTANTDRLMSNIRQLEDAYFFMRSQINLSSSAATARSDKTLKDRDRCSENQNENQDMSTKGKSSDQLEVFFEGLCKFARYSKFETCGTIRSGDLLNSASVVCSLSFDPDEEHIAAAGISKKIKIFDFNAFMNESVGVHYPLVEMVNKSKLSCVCWNSYIKNYLASTDYDGVVQIWDAGTGQGFSQYTEHQKRAWSVDFSPSDPTKFVSGSDDCSVKLWSINEKRSLGTIWSPANVCCVQFSSYSNHLLAFGSADYKVYCYDLRYVKTPWCTLAGHEKAVSYVKFMDSETIVSASTDNSLKLWNLNKTNSSGLSPGACSLTYKGHTNQKNFVGLSVLDGYIACGSETNEVYSYYKSLPMPMTSYKFGSVDPISGNEYFDDNGQFVSSVCWRKKSNMLVAANSTGNMKLLKLV

SEQ ID NO: 9290 - protein, 1028 aa, Arabidopsis lyrata
MPVMERVAEETVASNNNIQLKGRVDDVPCKLDALHSNMVIQSETRNSDCPGSSAHRTLEMTKPPPPEDSAGAKLSVEELTLGNYRIVQGTNNTNMDSSRAGKFEHLYRLARGSSLRPGDGDLDSQPRDMDQMLSRIRQQLAGAPSERQNLKPFMTRRSDHNLEAFSERLRAAGENSIIKAPSLISSEGVQLNAPVNFSQLLLKRAMKGKGVVGKNQESPPEFFSDQDLGSKEKQLDSSKSPTPHHVLPLKSSPKGNGMVSHGDGNHTKSSFGISLREFLRSSYAKREKRHGLCLFRQLVELVDSAHSKGLFLLDLRPSLFTLVPSKKLRYIGTFGKNDLDSGVDEDLNRRRPVVQESSIGGRDSKKRKMDLHVHSPGSQLQATSTGRPFKRKSPVIDLNVVDARNPDSCELQQQDYIKNLSVSSMTKKQSMSTWLEEQWYTCPEEINGEDIGDKSNIYALGVLLFELLCHCESGEMHAAMMADLRHRILPPTFLSKYPKEAGFCLWLLHPEPSSRPTARDILKSELICEDDSVKSTAAAEEISELLLHFLSTLEVQKQKKASKLLQDIQTLEDDIKEAERRYSSNVSLVRSHGAIERRVQSSPLDEHCTTSGVLLVPSTNTDRLMSNIRQLEDAYFFMRSQINLSSSAASTRSEKIVLKDRDRCSENQNENQDMSTKGKSSDQLEVFFEGLCKFARYSKFETCGTIRSGDLLNSASVVCSLSFDPDEEHIAAAGISKKIKIFDFNAFMNESVGVHYPLVEMVNKSKLSCVCWNSYIKNYLASTDYDGVVQIWDAGTGQGFSQYTEHQKRAWSVDFSPSDPTKFVSGSDDCSVKLWSINEKRSLGTIWSPANVCCVQFSSYSNHLLAFGSADYKVYCYDLRYVKTPWCTLAGHEKAVSYVKFMDSETIVSASTDNSLKLWNLNKTNSSGLSPGACSLTYKGHTNQKNFVGLSVLDGYIACGSETNEVYSYYKSLPMPMTSYKFGSVDPISGNEYFDDNGQFVSSVCWRKKSNMLVAANSTGNMKLLKLV

SEQ ID NO: 9291 - protein, 546 aa, Brassica napus
MSSWPDSSVSNARKADPGPGSSEPARYDSTRSEKASELGKGPDIFHSTDESKEQGDFDEYGWANIGSFDDLDRMFSSDVPIFGDGTLSGADELWSSSKDVSKPLPSILDSQDLGLDIRTEFEQQENQQFPLTGETNGGPSSQSAPRVRVTPKAEQYHEHKRQSSVDDQPYQQNKMLKFSEMLGTHEAGASQDPYGQRTLSRRKFVNQLGPSRSSMMGVNLQSESQGSGTSHYPHMPNQYMATSGFGNPYSAVPVVSAFQRPDVNKNQLMHPSYNPTTAISANMVTDAASARPSTMTPQEKLEKLRRRQQMQAMLAIQRQQQQFRHQVPVADQSITQLVDKTSLQGLTAIPSFDPNSSLELDDSGNFAAAAVDNPSEFSVLYRLQDVVAKLDMETRTCIRDSLFRLADSAGQRHHTSDTPHSNKTSQDDQEVIPQEKSRYRYAGMLDTETVTNPTDRTVAHLLFHRPFDMSAAKHTEGLESPSSSKMGAEVKGSFPSTRESHMNKQKAKEEDVPAGSVALGYASNLGSSSTVGERVNEASQGNKRKL

SEQ ID NO: 9292 - protein, 243 aa, Brassica rapa
MAISRTFMSFNLFIFFLVIATTNGQAPAPTPSGPTNITAVLEKAGQYTMFIRLLKSTQAADQINTQLNSSSSQGLTVFAPTDNAFSSLKSGTLNSLSDQQKVQLVQFHVLPTLLTMPQFQTVSNPLRTQAGDGQSGKFPLNITSSGNQVNITTGVVSATVANSVYSDKQLAVYQVDQVLLPLAMFGSSSAAPAPAPEKGGSVTTGSASGSDGGGDSTDSSDAERIRYGIIATVAAIAASSLWI

SEQ ID NO: 9293 - protein, 244 aa, Raphanus sativus
MAILRKFISSNLFIFFLVIATTNGQAPAPTPSGPTNITAVLEKAGQFTMFIRLLKSTQAADQINTQLNSSSSQGLTVFAPTDNAFSSLKSGTLNSLSDQQKVQLVQFHVLPTLLTMPQFQTVSNPLRTQAGDGQNGEFPLNITSSGNQVNITTGVVSATVANSVYSDKQLAVYQVDQVLLPLAMFGSSSAAPAPAPEKGGSVTTGSASGSDGGGDTSTDSSDAERIRYGIIATVAAIAASSLWI

SEQ ID NO: 9294 - protein, 242 aa, Brassica juncea
MATSRTFMSSSLFIFFLVMATTNGQAPVPTPSGPTNITAVLEKAGQYTMFIRLLKSTQAADQINTQLNSSSSQGLTVFAPTDNAFSSLKSGTLNSLSDQQKVQLVQFHVLPTLLTMPQFQTVSNPLRTQAGDGQNGKFPLNITSSGNQVNITTGVVSATVANSVYSDKQLAVYQVDQVLLPLAMFGSSSAPAPAPEKGGSVTTGSPSGSDGGGDSTDSSDAERVRYGIIATVVAIAASSLWI

SEQ ID NO: 9295 - protein, 243 aa, Eutrema halophilum
MAASRTFISSNLFIFFLVMATTNGQAPAPAPSGPTNITAVLEKAGQFTMFIRLLKSTQAADQINTQINSSSSQGLTVFAPTDNAFSSLKSGTLNSLSDQQKVQLVQFHVLPTLLTMPQFQTVSNPLRTQAGDGQNGKFPLNITSSGNQVNITTGVVSATVANSVYSDKQLAVYQVDQVLLPLAMFGSSSAPAPAPEKGGSVTTGSASGSDGGGDSTDSSDAERFGFGLIATVAAIAASSSLWI

SEQ ID NO: 9296 - protein, 481 aa, Eutrema halophilum
MDLFRVWSGMDFLAWRGMAYTLLLLNFVFACQLLLLQPLVSALDGQSVDAAELFERASQSIKVKRFSDALDDLNAAIEVDPALSEAYFRRASVLRHFCRYEDSENSYQKYLELNPGDPNAEKELSQLHQAKSALETASTLYESKDIGKALEFVDKVVLVFSPACSKAKLLKVKLLMVSKDYSAAISETGYILKEDENNLEALLLRGRAYYYLADHDVAQRHYQKGLRLDPEHSELKKAYFGLKKLLKKTKSAEDNANKGKLRVSTEDYKAAIALDPEHTAHNVHLYLGLCKVSVRLGRGKDGLNSCNEALNIDPELIEAIHQRGEAKLLLEDWEGAVEDLKQAAQNSQDMEIHEALGRAEKALKMSKRKDWYKILGVSKTASISEIKRAYKKLALQWHPDKNVDNREEAENKFREIAAAYEVLGDDDKRARFDRGEDLEDMGRGGGHGGFDPFGGGGGGGYTFHFEGGFPGGGGGFGGFGF

SEQ ID NO: 9297 - protein, 243 aa, Brassica juncea
MAISRTFMSSNLFIFFLVMATTNGQAPAPTPSGPTNITAVLEKAGQYTMFIRLLKSTQAADQINTQLNSSSSQGLTVFAPTDNAFSSLKSGTLNSLSDQQKVQLVQFHVLPTLLTMPQFQTVSNPLRTQAGDGQNGKFPLNITSSGNQVNITTGVVSATVANSVYSDKQLAVYQVDQVLLPLAMFGSSSAPAPAPEKGGLVSKGSAPSGDDGGDSTDSSDTERIRYGLISTTMAAIAAYFLWI

SEQ ID NO: 9298 - protein, 243 aa, Brassica napus
MATSRIFMSSNLFIFFLVMATTNGQAPAPTPSGPTNITAVLEKAGQYTMFIRLLKSTQAADQINTQLNSSSSQGLTVFAPTDNAFSSLKSGTLNSLSDQQKVQLVQFHVLPTLLTMPQFQTVSNPLRTQAGDGQNGKFPLNITSSGNQVNITTGVVSATVANSVYSDKQLAVYQVDQVLLPLAMFGSSSAPAPAPEKGGLVSKGSAPSGDDGGDSTDSSDTERIRYGLISTTMAAIAAYFLWI

SEQ ID NO: 9299 - protein, 242 aa, Raphanus sativus
MATSRTFMSSTLFIFFLVMATTNGQAPAPTPSGPTNITAVLEKAGQFTMFIRLLKSTQAADQINTQLNSSSSQGLTVFAPTDNAFSSLKSGTLNSLSDQQKVQLVQFHVLPTLLTMPQFQTVSNPLRTQAGDGQNGKFPLNITSSGNQVNITTGVVSATVANSVYSDKQLAVYQVDQVLLPLAMFGSSSAPAPAPEKGGLVSKGSAPSGDDGGDSTDSSDTERIRYWFISTMAAIAASSMWI

SEQ ID NO: 9300 - protein, 482 aa, Eutrema parvulum
MDLFRVWSGMDFLAWRGTAYTLLLLNFVFACQLLLLQPLVSSVDGQSADAAELFERASQSIKVKRFSDALDDLNAAIEVDPALSEAYFRRASVLRLFCRYEDAENSYHKYLELSPGDSNAEKELSQLHQAKSALETAWTLYESKDIGKALEFVDKVVLVFSPACSEAKVLKVKLLMSFKDYSAAISESGYILKEDENNLEALLLRGRAYYYLADHDVAQRHYQKGLRLDPEHSELKKAYFGLKKLLKKTKSAEDNANKGKLRVSTEDYKAAIALDPEHTAHNVHLYLGLCKVSVRLGRGKDGLDSCNEALNIDPELTEAFHQRGEAKLLLEDWEGAVEDLKQAAQNSQDMEIHEALGRAEKALKMSKRKDWYKVLGISKTASISEIKRAYKKLALQWHPDKNVGNREEAENKFREIAAAYEVLGDDDKRARFDRGEDLEDMGGGGGRGGFDPFGGGGGGGYTFHFEGGFPGGGGGGFGGFGF

SEQ ID NO: 9301 - protein, 242 aa, Eutrema parvulum
MATSRTFISSGLFIFFLVMVTSNGQAPAPAPSGPTNITAILEKAGQFTMFIRLLKSTQAADQINTQLNSSSSQGLTMFAPTDNAFSSLKSGTLNSLSDQQKVQLVQFHVLPTLLTMPQFQTVSNPLRTQAGDGQNGKFPLNITSSGNQVNITTGVVSASVANSVYSDKQLAVYQVDQVLLPLAMFGSTAAPAPAPEKGGSVTTGSASGSDGGGDSTDSSDAERLGFGLISTVATIAASFLWM

SEQ ID NO: 9302 - protein, 246 aa, Arabidopsis lyrata
MATSRTFISSNLFIFFLIVATTNGQAPAPGPSGPTNITAILEKAGQFTLFIRLLKSTQASDQINTQLNSSSSNGLTVFAPTDNAFNSLKSGTLNSLSDQQKVQLVQFHVLPTLITMPQFQTVSNPLRTQAGDGQNGKFPLNITSSGNQVNITTGVVSATVANSVYSDKQLAVYQVDQVLLPLAMFGSSAAPAPAPEKGGSVSKGSASGGDDGGGSTDSSDAERTRFGFGVRIAIVAAIAAASSLSI

SEQ ID NO: 9303 - protein, 246 aa, Arabidopsis thaliana
MATSRTFIFSNLFIFFLVIATTYGQAPAPGPSGPTNITAILEKAGQFTLFIRLLKSTQASDQINTQLNSSSSNGLTVFAPTDNAFNSLKSGTLNSLSDQQKVQLVQFHVLPTLITMPQFQTVSNPLRTQAGDGQNGKFPLNITSSGNQVNITTGVVSATVANSVYSDKQLAVYQVDQVLLPLAMFGSSVAPAPAPEKGGSVSKGSASGGDDGGDSTDSSDAERTGFGFGIRITTVAAIAASSSLWI

SEQ ID NO: 9304 - protein, 238 aa, Brassica rapa
YSCPLIYSFSSLSWLPPNGQAPAPTPSGPTNITAVLEKAGQYTMFIRLLKSTQAADQINTQLNSSSSQGLTVFAPTDNAFSSLKSGTLNSLSDQQKVQLVQFHVLPTLLTMPQFQTVSNPLRTQAGDGQNGKFPLNITSSGNQVNITTGVVSATVANSVYSDKQLAVYQVDQVLLPLAMFGSSSAPAPAPEKGGLVSKGSAPSGDDGGDSTDSSDTERIRYGLISTTMAAIAAYFLWI

SEQ ID NO: 9305 - protein, 214 aa, Brassica juncea
PTPSGPTNITAVLEKAGQFTMFIRLLKSTQAADQINTQLNSSTSQGLTVFAPTDNAFSSLKSGTLNSLSDQQKVQLVQFHVLPTLLTMPQFQTVSNPLRTQAGDGQNGKFPLNITSSGNQVNITTGVVSATVANSVYSDKQLAVYQVDQVLLPLAMFGSSSAPAPAPEKGGLVSKGSAPSGDDGGDSTDSSDTEKIRYWLISTVASIAAASLWI

SEQ ID NO: 9306 - protein, 388 aa, Gossypium hirsutum
MVRGLKKRREEAIEEAKLALQEYEQLEGTNDAENSKPATASGRRVFGRANNEVPDSNKKTKTDNKMKMDNYYGNSDSEDDLEAKANVNIEGGKRNDVEKDVGPNYDRKEAADVSIFKNFDDNGDPGSKTTYEVAIFASDSWRKMKSENGVDKNAKKLQQVKEAIVHNKDMEEGEEDSDSESEQMVDGILSSAPKESYELPSQSELIRHAFAGDDVEEEFEKDKQEILNEENPEPDKPVLLPGWGQWTHVQQKKGLPWWMLKEHEDAKRKREESLKKRKDAQLKHVIISEKVDKKAEKLQTKSLPYPFTSKELFEQSMRMPIGSESNPETAIRSLNRPEVVKKPGVIIKPIKFVEMHHHEKSEDNKRSGQKQKKNKSKGASGKNKKQSN

SEQ ID NO: 9307 - protein, 447 aa, Gossypium hirsutum
MGSGGSKGCCRVGVGGRDTAPAASSSNSGWRRGRSKGKNRVFRSSCLGALSRSASPKPHFDHRKQPASESDLVKRESNRKVEGEAASNDEMQLPLPTPCISSGGSTSGAAVTAARRSPSRCLSGISFLPGNLSFRFSRANSMRSSAEMLNPDDDSETLEPQQPPRNSCSPIIFNDSDGSGETLESNARFSRALSVGRLRDRVLGRAPTFCPLQQDIQITQQQLATSPSTTASTHDSSVISHDEIETSRSREARYHDLLHHRSNFLERRRRIRSQVRALQRLGSRFENFSGHERSCILSGQHRSGRCTCRVNNRDSSSNDDTTGARSSVSRIVMLAEALFEVLDEIHQQSMVLSSRPSVSPIGSVPAPNEVVESLPVKVYKSPKLKNDEAVQCYICLVEYEEGDSIRRLPCNHEFHRTCIDKWLKEIHRVCPLCRGDICGPDLMPGEK

SEQ ID NO: 9308 - protein, 477 aa, Theobroma cacao
MSIEPFNSWKNRLVKLAARAFYDDVTTKGDNQPKTGRGDNRGIAVVVLDALTRRQWVREEDLAKELKLHSKQLRRTLRLFEEEKLVTRDHRRETAKGAKIYSAAVAATVDVQHGGKEGEEKIKLHTHSYCCLDYAQIYDVVRYRLHRMKKKLKDELEDKNTVQEYVCPNCGKRYNALDALRLVSLEDEYFHCERCNGELVAESDKLVAQDVGDGDDNARRRRREKLKDMLQKMEVQLKPLMEQLSRVKDLPVPEFGSLQAWEARASAAGRAINGDSGSNDLSRSSQGYGGTPMPFLGETKVEVAFSGLDGKEEDAKSESAGTSLKVLPPWMIKQGMNLTKEQRGEVKQESKTDGTSAQPDFSDDKKSTIGTDDKKNLQDEYLKAYYAALYKKQQELEEAAKKQEELSDIPLSSSHSDPSKRQVGMKVKRDDDEGDDDIDWEEAPLAGNTTESYKVNDLNVEAEASGDDEDDVDWEEG

SEQ ID NO: 9309 - protein, 474 aa, Citrus clementina
MSSIEPFNRLVKLVARAFYDDITTKGDNQPKSGRSDNRGIAVVVLDALTRRQWVREEDLAKDLKLHSKQLRRTLRFLEEEKLVARDHRKETAKGAKIYSAAVAATADGQPFAKEGEEKIKLHTHSYCSLDYAQIYDVVRYRIHRMRKKLKDELECKNTVQEYICPNCQRRYNALDALRLVSLEDDSFHCENCNGELVAESDKLAAQEGGDGDDNARRRRREKLKDLLQKLEVQLKPLMEQINRVKDLDVPEFGTLQAWEARASAAGRAANGDSSSNDPNKSSQGYGGTPMPFLGDTKVEVAFSGAEGKQVDVKSETDSTPQKVLPPWMIKQGMNLTKEQRGEVKQESKMDGSSATGGLSDDKKSTVEDDKASLQDEYIRAYYAALLKKQQELDEAAKNQQESSNTPISDGLSGASSNRQVGMKSKREEVEGDDDVDWEEAPVAGTTSESFKVHDLNVEAEASAEDEDDIDWEEG

SEQ ID NO: 9310 - protein, 475 aa, Citrus sinensis
FFFISVSENRLVKLVARAFYDDITTKGDNQPKSGRSDNRGIAVVVLDALTRRQWVREEDLAKDLKLHSKQLRRTLRFLEEEKLVARDHRKETAKGAKIYSAAVAATADGQPFAKEGEEKIKLHTHSYCSLDYAQIYDVVRYRIHRMRKKLKDELECKNTVQEYICPNCQRRYNALDALRLVSLEDDSFHCENCNGELVAESDKLAAQEGGDGDDNARRRRREKLKDLLQKLEVHLKPLMEQINRVKDLDVPEFGTLQAWEARASAAGRAANGDSSSNDPNKSSQGYGGTPMPFLGDTKVEVAFSGAEGKQVDVKSETDSTPQKVLPPWMIKQGMNLTKEQRGEVKQESKMDGSSATGGLSDDKKSTVEDDKASLQDEYIRAYYAALLKKQQELDEAAKNQQESSNTPISDGLSGASSNRQVGMKSKREEVEGDDDVDWEEAPVAGTTSESFKVHDLNVEAEASAEDEDDIDWEEG

SEQ ID NO: 9311 - protein, 200 aa, Quercus alba
MSVEPFNKLVKLAARAFYDDITTKGDNQPKTGRSDNRGIAVVVLDALTRRQWVREEDLAKDLKLHSKQLRRTLRFFEEEKLVTRDHRRETAKGAKIYSAAVAATADGHPLKEGEEKVKMHTHSYCCLDYAQIYDVVRYRLHRMKKKLKDELDNKNTVQEYICPNCGKRYTALDALRLISMEDEFFIVKVVMENLWLRVTS

SEQ ID NO: 9312 - protein, 368 aa, Setaria italica
MVAIENQSQVARAVAAAEVAPVAGPRIPKEARRLLHELAAAWADVADCRALQVVPLKGAMTNEVYQVRWLTGVPSAGGEAGEPRGEREVRKVLVRIYGDGVDLFFDREDEVRTFECMSRHGQGPRLLGRFPNGRVEEFIHARTLSAADLRDPEISALVASKLREFHNLDMPGPKSVLIWDRLRNWLKTAKNLCSTDEAKEFRLDSLESEITALQNEVSGDYHWIGFCHNDLQYGNIMIDEETNMLTIIDYEYASFNPVAYDIANHFCEMAADYHSEKPHILDYNKYPDIDEQKRFVKTYLSISGEEPDAEEVESLLQSIEKYTLASHLVWGLWGIISDHVNDIDFDYKEYARQRFEQYWQKKPANLQS

SEQ ID NO: 9313 - protein, 365 aa, Setaria italica
MVAIENQSQVARAVAAAEVAGPRIPKEARRLLHELAAAWADVADCRALQVVPLKGAMTNEVYQVRWLTGVPSVGGEAGEPRGEREVRKVLVRIYGDGVDLFFDREDEVRTFECMSRHGQGPRLLGRFPNGRVEEFIHARTLSAADLRDPEISALVASKLREFHNLDMPGPKSVLIWDRLRNWLKTAKNLCSTDEAKEFRLDSLESEITALQNEVSGDYHWIGFCHNDLQYGNIMIDEESNMLTIIDYEYASFNPVAYDIANHFCEMAADYHSEKPHILDYNKYPDIDEQKRFVKTYLSISGEEPDAEEVESLLQSIEKYTLASHLVWGLWGIISDHVNDIDFDYKEYARQRFEQYWQKKPANLQS

SEQ ID NO: 9314 - protein, 368 aa, Oryza sativa
MVAIENQSQGQRAAEAAAQPRIPREARRLLHEMAASWADVADCRALQVIPLKGAMTNEVYQVRWLNGAPATADGGEVEAEAAAREREVRKVLVRIYGDGVELFFDREDEVRTFECMSRHGQGPRLLGRFTNGRVEEFIHARTLSAADLRDPEISALVASKLREFHNLDMPGPKSVLIWDRLKNWLKTARNLCSSDESKKFRLGSLENEIAALEKEFSGDYHGIGFCHNDLQYGNIMIDEDTNMLTIIDYEYASFNPVAYDIANHFCEMAADYHSEKPHRLDYSKYPDTDEQKRFVKTYLSNSVSEEPDAEEVENLLQSIEKYTLASHLVWGLWGIISDHVNDIDFDYKEYARQRFEQYWQKKQALLTS

SEQ ID NO: 9315 - protein, 368 aa, Brachypodium distachyon
MVAIENQSQAVQAQVQRAAEAARIPKEARRLLHELAAAWPNVADCRALEVVPLKGAMTNEVYQVRWLTAPAAAAGGEKEKEALKEREIRKVLVRIYGDGVELFFDREDELRTFECMSRHGQGPRLLGRFPNGRVEEFIHARTLSAADLRDPEISALVATKLREFHNLDMPGPKHVLLWDRLKNWLKTAKNLCPTDQANELRLDCLEDEIATLEKEFSGDYHHWIGFCHNDLQYGNIMIDEETNMLTIIDYEYASFNPVAYDIANHFCEMAADYHSEKPHVLDYSKYPDIDEQRRFVKTYLSTSGEEPEAEEVQNLLQSIDKYTLASHLVWGLWGIISDHVNDIDFDYKEYARQRFEQYWQKKPVVLTS

SEQ ID NO: 9316 - protein, 153 aa, Avena sativa
MVAIENQSQAQRAAETAPARIPKEARRLLHDLAAAWPNVADCRALEVVPLKGAMTNEVYQVRWLTAAPGAGAGEALKEREVRKVLVRIYGDGVELFFDREDELRTFECMSRHGQGPRLLGRFPTAASRSSSTHGHCQLPTYAILRFQLWWLQN

SEQ ID NO: 9317 - protein, 361 aa, Avena sativa
MVAIENQSQAQRAAETAGRSIPKEARRLLHELAAEWADVADCRALEVVPLKGAMTNEVYQVRWLTAAPGAGGGEALKEREVRKVLVRIYGDGVELFFDREDELRTFECMSRHGQGPRLLGRFPNGRVEEFIHARTLSAPDLRDPEISALVATKLREFHSLDMPGPKHVLLWDRLKNWLKTAKNLCPADQANELRLDSLEDEINTLEKEFSGDYHHWIGFCHNDLQYGNIMIDEETNMLTIIDYEYASFNPVAYDIANHFCEMAADYHSEKPHILDYSKYPDVDERSRFVRNYLSTSDEDPQEEEVENLLQSVEKYTLASHLAWGLWGIISDHVNDIDFDYQEYARQRFEQYWLKKPAVLTS

SEQ ID NO: 9318 - protein, 358 aa, Triticum aestivum
MVAIENHSQVQRPAESARIPKEARRLLHDLAAAWPNVADCRALEVVPLKGAMTNEVYQVRWLTAPAGGEAGTLKEREVRKVLVRIYGDGVELFFDREDELRTFECMSRHGQGPRLLGRFPNGRVEEFIHARTLSAPDLRNPEISALVATKLREFHNLDMPGPKHVLLWDRLKNWLKTAKNLCPTDQADELRLDCLENEIASLEKEFSGDYHHWIGFCHNDLQYGNIMMDEETNMLTIIDYEYASFNPVAYDIANHFCEMAADYHSEKPHILDYSKYPDIDEQRRFVKTYLSTSREEPEAEEVENLLQSVEKYTLASHLVWGLWGIISDRVNDIDFDYQEYARQRFEQYWQKKPAVLTS

SEQ ID NO: 9319 - protein, 360 aa, Triticum aestivum
MVAIENQSQAQRPAESARIPKEARRLLHNLAAAWPNVADCRALEVVPLKGAMTNEVYQVRWLTAPAGGEAGAGALKEREVRKVLVRIYGDGVDLFFDRDDELRTFECMSRHGQGPRLLGRFPNGRVEEFIHARTLSAPDMRDPEISALVATKLREFHNLDMPGPKHVLLWDRLKNWLKTANNLCPTDQANELRLDCLEDEIASLEKEFSGDYHHWIGFCHNDLQYGNIMMDEETNMLTIIDYEYASFNPVAYDIANHFCEMAADYHSEKPHILDYSKYPDIDEQRRFVKTYLSTSREEPETEELENLLQSVEKYTLASHLVWGLWGIISDRVSDIDFDYQEYARQRFEQYWQKKPAVLTS

SEQ ID NO: 9320 - protein, 421 aa, Saccharum officinarum
MAVDPRQVVAGFLTLSMFVMLGNMIKHDHFSPVTEELGLEATGSESNTVKLDNNAEMNSIDTAGVEDLMDAIEEVKPCWTKPSPKNQPSNGFVTFSLTMGPEYHISQITDAVVVARYLGATLVLPDIRGNELGNKRKFQDMYNVDKFVRSLDGVVEVIDEIPDEVSAKKPAVIRVPNRVTESFITDTIQPIFQKNKYLRLAVIFSSVSLRPKETSNKDLDATACLAMFSGLELKHEYSEVARKMLDRLQELSKKSDGKVLAIDLRTDLLEKKSCKTTRGARRKGCYNPDEVLAFLRSVGFSPNTTIYLTETWWHKGLNDLKEEYPNTYTKDDIMPAEDKGEFLKSSNADLARALDLEICSQSDVFIPAVAGLFYGHVTGKRIASGRTQIIVPSQSSTSTHASDFISTYISNKNHLAYSCYC

SEQ ID NO: 9321 - protein, 422 aa, Sorghum bicolor
MAVDPRQVVAGFLTLSMFVMLGNMIKHDHFSSPVTEELALEATGVESNTVKLDNNAEMNSVDMAGVEDLMDAIEDVKPCWTKPSQKNQPSNGFVTFSLTMGPEYHISQITDAVVVARYLGATLVLPDIRGNELGNKRKFQDMYNVDKFVRSLDGVVEVIEEIPDEVSAKNPAVIRVPNRVTESFITDTIQPIFQKNKYLRLAVIFSSVSLRPKETNNKDLDATACLAMFSGLELKHEYSEVARKMLDRLQELSKKSDGKVLAIDLRTDLLEKKSCKTTRGARRKGCYNPEEVLAFLRNVGFSANTTIYLTETWWHKGLNDLKEEFPNTYTKDDIMPAENKGEFLKSSNADLARALDLEICSQSDVFIPAVAGLFYGHVTGKRIASGRTQIIVPSQSSTSTHASDFISTYISNKNHLAYSCYC

SEQ ID NO: 9322 - protein, 421 aa, Zea mays
MAVDPRQVVAGFLTLSMFVMLGNMIKHDHFSPVTEEMGLKATGARSNTMKLDNNAEMNSVDMAGVEDLMDTIEEVKPCWTKPSPKNQPSNGFVTFSLTMGPEYHISQITDAVVVARYLGATFVLPDIRGNELGNKRKFQDMYNVDKFVRSLDGVVEVIDEIPDEVSAKKPAVIRVPNRVTESFIMDTIQPIFKKNKYLRLAVIFSSVSLRPKETSNKDLDATACLAMFSGLELKHEYSEVARKMLDRLQELSKKSDGKVLAIDLRTDLLEKKSCKTTSGARRKGCYNPNEVLAFLRSVGFSANTTIYLTETWWHKGLNDLKEEFPNTYTKDDIMPAENKGEFLKSSNADLASALDLEICSQSDVFIPAVAGLFYGHVTGKRIASGRTQIIVPSQSSTSTHASDFTSTYISNKNHLAYTCYC

SEQ ID NO: 9323 - protein, 500 aa, Trigonella foenum-graecum
MSPLVLFPFALLLFFFLFKKHKTSKKPTNLPPGPKGLPFIGNLHQLDSSALGLNFYELSKKYGSLIYLKLGSRQTVVVSSAKMAKQVMKTHDIDFCNRPSLISHMKVSYNGLDQVFAPYREYWRHTKKLSFIHFLSVKRVSMYSSVRKYEVTQMMKKISEYASSNKVVNMSALLICLTSTIVCRTAFGRKYEEDGIERSMFQCLLKELQELLISFFYADYLPFVGGIIDRFTGKMSRLEKTFKVLDEFFQGIVDEHLDPERKNFPPHEDDVIDALIQLKNDPYCSMDLTPDHIKPLIMNLLFAGTDTITSVVVWAMTALMKNPRAMQKVQEEIRKVFAGKGFIEEEDVQKLPYLKAVIKETMRLYPSLPILLPRETMKKCDIEGYEIPDKTLVFVNAWAIHRDPEAWKDPEEFYPERFLNSDIDFKGQDFELIPFGSGRRVCPGLNMAVATVNLVLANLLYLFDWEMPEGVKREDIDIDGQPGLVQHKKNPLCLVAKKRI

SEQ ID NO: 9324 - protein, 394 aa, Trigonella foenum-graecum
MSPLVLFPFALLLFFFLFKKHKTSKKPTNLPPGPKGLPFIGNLHQLDSSALSLNFYELSKKYGSLIYLKLGSRQTVVVSSAKMAKQVMKTHDIDFCNRPSLISHMKVSYNGLDQVFAPYREYWRHTKKLSFIHFLSVKRVSMYSSVRKYEVTQMMKKISEYASSNKVVNMCELLICLTSTIVCRTVFGRKYEEDGIERSMFQCLLKELQELLISFFYADYLPFVGGIVDRFTGKMSRLEKTFKVLDGFFQGIVDEHLDPERKKFPPHEDDVIDALIQLKNDPYCSMDLTPDHIKPLRMNLLFAGTYTITSVVVWAMTALMKNPRAMQKVQEEIRKVFSGKGFIEEEDVQKLPYLKAVIKETMRLYPSLPILLPRETMKKCNIEGYEIPDKTLVS

SEQ ID NO: 9325 - protein, 503 aa, Trigonella foenum-graecum
MSPLVLFPFALLLFFFLFKKHKTSKKPTNLPPGPKGLPFIGNLHQLDSSALGLNFYELSKKYGSLIYLKLGSRQTVVVSSAKMAKQVMKTHDIDFCNRPSLISHMKVSYNGLDQVFAPYREYWRHTKKLSFIHFLSVKRVSMYSSVRKYEVTQMMKKISEYASSSKVVNMPALLICLTSTIVCRTAFGRKYEEDGIERSMFQCLLKELQELLISFFYADYLPFVGGIIDRFTGKMSRLEKTFKDLDGFFQGIVDEHLDPERKNFPPHEDDVIDALIQLKNDPYCSMDLTPDHIKPLIMNLLFAGTDTITSVVVWAMTALMKNPRAMQKVQEEIRKVFAGKGFIEEEDVQKLPYLKAVIKETMRLYPSLPILLPRETMKKCDIEGYEIPDKTLVFVNAWAIHRDPEAWKDPEEFYPERFLDSDIDFKGQDFELIPFGSGRRVCPGLNMAVATVDLLLANLLYLFDWEIPEGVKREDIDIEGQPGLVQHKKNPLYLVAKKRIECV

SEQ ID NO: 9326 - protein, 502 aa, Medicago truncatula
MSPLILLPFALLLFFLFKKHKTSKKSTTLPPGPKGLPFIGNLHQLDSSALGLNFYELSKKYGSLIYLKLGSRQTIVVSSAKMAKQVMKTHDIDFCNRPALISHMKFSYDGLDQFFSPYREYWRHTKKLSFIHFLSVKRVVMFSSVRKYETTQMITKISEHASSNKVVNLHELLMCLTSAVVCRTAFGRRFEDEAAERSMFHDLLKEAQEMTISFFYTDYLPFVGGIVDKFTGLMSRLEKLFKILDGFFQSVFDEHIDPNRKKLPPHEEDVIDALIELKNDPYCSMDLSAEHIKPLIMNMLLAGTDTIAAAVVWAMTALMKNPRVMQKVQEEIRKAYEGKGFIEEEDVQKLPYFKAVIKESMRLYPSLPVLLPRETMKKCDIEGYEIPDKTLVYINAWAIHRDPEAWKDPEEFYPERFIGSDIDLKGQDFELIPFGSGRRVCPGLNMAIATVDLVLANLLYLFDWEMPEGVKWENIDIDGLPGLVQHKKNPLCLIAKKRIECV

SEQ ID NO: 9327 - protein, 500 aa, Trigonella foenum-graecum
MSPLVLFPFALLLFIFFFKKHKTSKKPTNLPPGPKGLPFIGNLHQLDSSALGLNFYELSKKYGSLIYLKLGSRETIVVSSAKMAKQVMKTHDIDFCNRPSLISHMKVSYNGLDQVFAPYREYWRHTKKLSFIHFLSVKRVSMYSSVRKYEVTQMMKKISEYASSNKVVNMSALLICLTSTIVCRTAFGRKYEEDGIERSMFQCLLKELQELLISFFYADYLPFVGGIIDRFTGKMSRLEKTFKVLDEFFQGIVDEHLDPERKNFPPHEDDVIDALIQLKNDPYCSMDLTPDHIKPLIMNLLFAGTDTITSVVVWAMTALMKNPRAMQKVQEEIRKVFAGKGFIEEEDVQKLPYLKAVIKETMRLYPSLPILLPRETMKKCDIEGYEIPDKTLVFVNAWAIHRDPEAWKDPEEFYPERFLNSDIDFKGQDFELIPFGSGRRVCPGLNMAVATVNLVLANLLYLFDWEMPEGVKREDIDIDGQPGLVQHKKNPLCLVAKKRI

SEQ ID NO: 9328 - protein, 500 aa, Trigonella foenum-graecum
MSPLVLFPFALLLFFFLFKKHKTSKKPTNLPPGPKGLPFIGNLHQLDSSALGLNFYELSKKYGSLIYLKLGSRETIVVSSAKMAKQVMKTHDIDFCNRPSLISHMKVSYNGLDQVFAPYREYWRHTKKLSFIHFLSVKRVSMYSSVRKYEVTQMMKKISEYASSSKVVNMPALLICLTSTIVCRTAFGRKYEEDGIERSMFQCLLKELQELLISFFYADYLPFVGGIIDRFTGKMSRLEKTFKDLDGFFQGIVDEHLDPERKNFPPHEDDVIDALIQLKNDPYCSMDLTPDHIKPLIMNLLFAGTDTITSVVVWAMTALMKNPRAMQKVQEEIRKVFAGKGFIEEEDVQKLPYLKAVIKETMRLYPSLPILLPRETMKKCDIEGYEIPDKTLVFVNAWAIHRDPEAWKDPEEFYPERFLDSDIDFKGQDFELIPFGSGRRVCPGLNMAVATVNLVLANLLYLFDWEMPEGVKREDIDIDGQPGLVQHKKNPLCLVAKKRI

SEQ ID NO: 9329 - protein, 150 aa, Trigonella foenum-graecum
MNQNISPLVLFPFALLLFFFLFKKHKTSKKPTNLPPCPKGLLFIGNLHQLDGSALGLNFYELSKKYGSLIYLKLGSRQTVVVSSAKMAKQVMKTHDIDFCNRPSLISHMKLSYNGLDQVFAPYREYWRHAKKLSFIHFLSVKRVLNVLLS

SEQ ID NO: 9330 - protein, 144 aa, Vigna unguiculata
MMEHKRSPCSVDQSSYTSIASKRQKADLSISTKERKEKIGERIVALQQLVSPYGKTDTSSVLKEAMEYIGFLHKQVKLLSAPYLETSAAAKMQGMESCSLRSRGLCLVPVSFTIGVAESNGADIWAPIKTTTSPKLENDVSQFH

SEQ ID NO: 9331 - protein, 144 aa, Glycine max
MMEHKRSPCSVDQSSYTSIASKRQKADLSISTKERKEKIGKRIVALQQLVSPYGKTDTSSVLKEAMEYIGFLHKQVKLLSAPYLESSPAAKMQGMEPCSLRSRGLCLVPVSFTIGVAETNGADIWAPIKTTTSPKFEKDVSQFH

SEQ ID NO: 9332 - protein, 144 aa, Glycine max
MMEHKRRPCSVDQSSYTSIASKRQKADLSISTKERKEKIGERIVALQQLVSPYGKTDTSSVLKEAMEYIGFLHKQVKLLSAPYLESSPAAKMQGVEPCSLRSRGLCLVPVSVTIGVAESNGADIWAPIKTTTSPKFEKDVSQFH

SEQ ID NO: 9333 - protein, 144 aa, Cajanus cajan
MMEHKRSPCSVDQSSYTSIASKRQKADLSISSKERKEKIGERIVALQQLVSPYGKTDTSSVLKEAMDYIGFLHKQVKLLSAPYLESSPAVKMQGMEPCSLRSRGLCLVPVSITMGVAESNGADIWAPIKTTTSPKFENDVSQFH

SEQ ID NO: 9334 - protein, 144 aa, Phaseolus coccineus
MMEHKRSPCSVDQSSYTSIASKRQKADLSISTKERKEKIGERIVALQQLVSPYGKTDTSSVLEDAMEYIGFLHKQVKLLSAPYLETSAAAKMQGMDACSLRSGGLCLVPVSFTIGVAESNGADIWAPIKTATSPKLEKDVSQFH

SEQ ID NO: 9335 - protein, 144 aa, Lotus japonicus
MIGHKRSPCSVDQSSYTSIASKKQKADLSMSSKDRKEKVGERIVALQQLVSPYGKTDTSSVLNEAMEYIGFLHKQVKLLSAPYLESSPATMMEGIEPCSLRNRGLCLVPVSITMGVAESNGADIWAPIKTTSPKSEKDIVSQFH

SEQ ID NO: 9336 - protein, 357 aa, Glycine max
MSSKGVGEDCLGWAARDASGVLSPYKFSRRTPGNEDVLIKITHCGVCFADVVWTRNKHGDSKYPVVPGHEIAGIVTKVGSNVHRFKVGDHVGVGTYVNSCRDCEHCNDREEVHCTKGSVFTFNGVDFDGTITKGGYSSYIVVHERYCFTIPKSYALASAAPLLCAGITVYSPMVRHKMNQPGKSLGVIGLGGLGHMAVKFGKAFGLSVTVFSTSISKKEEALSLLGADKFVVSSNQEEMTALAKSLDFIIDTASGDHPFDPYMSLLKTYGVFVLVGFPSQVKFSPASLNIGSKTVAGSVTGGTKDIQEMIDFCAANEIHPNIEVIPIEYANEALERLINRDVKYRFVIDIENSLKEK

SEQ ID NO: 9337 - protein, 357 aa, Vigna unguiculata
  misc_feature (109)..(109): Xaa can be any naturally occurring amino acid
  misc_feature (140)..(140): Xaa can be any naturally occurring amino acid
MSSKGVDEQCLGWAARDASGVLSPYKFSRRNLGNEDVHIKITHCGVCYADVIWTRNKHGDSKYPVVPGHEIAGIVTKVGPNVHRFNVGDHVGVGTYVNSCRDCEYCNEXQEVLCTKGSVFTFNGVDFDGTITKGGYSSYXVVHERYCFTIPKGYPLASAAPLLCAGVTVYSPMVRHKMNQPGKSLGVIGLGGLGHMAVKFGKAFGLSVTVFSTSVSKKEEALTSLGADKFVVSSNQEEMKALAKSLDFIIDTASGDHPFDPYMSLLKPYGVFVLVGFPSEVKFSPASLNIGSKTFAGSITGGTKDIQEMIDFCAANDIHPMIEVIPIEYANEALERLVNRDIKYRFVIDIENSLKEN

SEQ ID NO: 9338 - protein, 355 aa, Arachis hypogaea
MSAEEANKDCLAWAARDSSGVLSPYKFSRRALGNDDVHIKITHCGVCYADVVWTRNKHGDSKYPVVPGHEIAGVVEKVGSSVQRFKVGDHVGVGTYVNSCRDCEYCNDRQEVHCVKGAVYTFNGVDVDGTITKGGYSSYIVVHERYCYVIPKNYPLASAAPLLCAGITVYSPMMRHKMNQPGKSLAVIGLGGLGHMAVKFGKAFGLNVTVISTSVSKKEEALSLLGADKFVVSTDKEQMAALAKSFDFIIDAASGDHPFDPYMALLKISGAMVLVGFPSEVKFSPANLILGMRTISGSVTGGTKETQEMIDFCAANGIHPSIEVVPIEYANQALERMINRDVKYRFVIDIQNSLK

SEQ ID NO: 9339 - protein, 355 aa, Manihot esculenta
MSSESVKEDCFAWAARDPSGVLSPYKFKRRTTGEDDVSLKITHCGICYADVIWTRNKLGDSKYPLVPGHEIVGMVQEAGPNVSRFKPGDRVGVGTYVNSCKECEYCNDREEVHCEKGSVFTFNAIDLDGTITKGGYSSYIVVHERYCFMIPDDYPLALAAPLLCAGITVYNPMMRHGMNQPGKSLGVIGLGGLGHMAVKFGKAFGLKVTVFSTSISKKEEALGVLGADNFVVSSDQEQMKALSKSLDFIVDTASGDHPFDPYMSLLKTAGVLVLVGFPSEVKFSPASLILGMRTVSGSITGGTKVTQEMLDFCAAKKIYPEIELIPIDYANEALERVVKRDVKYRFVIDIENSLK

SEQ ID NO: 9340 - protein, 355 aa, Quercus alba
MSSLAAKDDCLAWAARDPSGVLSPYNFSRRAVGSDDVSLKITHCGICYADLIWTRNFHGDSKYPVVPGHEIAGIVKEVGSNVHHFKVGDHVGVGTYVNSCRSCEYCNDGQEVHCVKGSVYTFNAVDADGSITKGGYSSYIVVHERYCFRIPENYPLASAAPLLCAGITVYSPMVRHKMNQPGKSLGVIGLGGLGHMAVKFGKAFGLNVTIFSTSVSKKEEALSLLGANRFVVSSDQEQMKALAKSFDFIIDTASGDHPFDPYMSLLKTAGVLVLVGFPSEVKFSPGSLNIGNKTISGSVTGGTKVTQEMIDFCAAHKIYPNIEVIPIQYANEALERLIKKDVKYRFVIDIENSLK

SEQ ID NO: 9341 - protein, 339 aa, Trigonella foenum-graecum
MADQNQKAEIFELNNGTMQLLVTNLGCTITSFSVPGKDGVLSDVVLGLDSIESYQKGLAPYFGCIVGRVANRIQNGKFTLDGVEYSLPLNKAPNSLHGGNVGFDKKVWEVIEYKKGETPSITFKYDSHDGEEGYPGDITVTATYTLTSSTTMRLDMEGVSKNKPTIINLAQHTYWNLAGHSSGDILNHSIKIPANHITPVDQHTVPTGEITPVKGTPFDFTSEKRIGDTINQVGMGYDHNYVLDCGEEKAGLRHAAKVRDPSSSRVLNLWTNAPGMQFYTANYVDNVAGKGGAVYGKHAALCLETQGFPDAVNKPNFPSVVVKPGEKYQHSMLFEFSIE

SEQ ID NO: 9342 - protein, 339 aa, Arachis hypogaea
MADQNQKPEIFELNNGTMDVKVTNLGCTIISLSVPGKDGALSDVVLGLDSVESYQKGLAPYFGCIVGRVANRIKEGKFTLDGVEYSLPLNKPPNSLHGGNIGFDKKVWEVVEYKKGETPSITFKYHSHDGEEGYPGDITVTATYTLISGTTMRLDMEGVPKDKPTIINLAQHTYWNLAGHNSGDVLNHSIQIWGNHVTPVDQNTVPTGEIMPVKGTPFDFTTENRIGNTIGQVGMGYDHNYVLDCGDEKAGLKHAAKVRDPSSSRVLNLWTNAPGMQFYTANYVNGVNGKGGAVYGKHAGLCLETQGFPNAINQPNFPCVVVRPGEKYQHSMLFEFSIE

SEQ ID NO: 9343 - protein, 339 aa, Phaseolus coccineus
MADQSPKPETFELSNGSMKVLLTNLGCTIISLSVPGKDGVLSDVVLGLDSVESYQKGLAPYFGCIVGRVANRIKDGKFTLDGVQYSLPLNKPPNSLHGGNVGFDKKVWEVVEHKKGETPSITFKYHSHDGEEGYPGDITITATYTLTSSTTLRLDMEGVPKDKPTIVNLAQHTYWNLAGHNSGNILDHSIQIWANHVIPVDQNTVPTGEIMSVKDTPFDFTSENRIGNNISEVGLGYDHNYVLDCGEEKDGLRHAAKVRDPSSSRVLNLWTNAPGVQFYTANYVNGVQGKGGAIYGKHAGLCLETQGFPNAINQPNFPSVVVRPGEKYEHTMLFEFSLE

SEQ ID NO: 9344 - protein, 339 aa, Glycine max
MADESPKPETFELNNGSMQVLLTNLGCTIISLSVPGKDGVLSDVVLGLESVESYQKGLAPYFGCIVGRVANRIKDGKFTLDGIHYSLPINNPPNSLHGGNVGFDKKVWEVVEHKKGETPSITFKCHSHDGEEGYPGDITVTATYTLTSSTTLRLDMEGVPKGKPTIVNLAQHTYWNLAGHNSGNILDHSIQLWANHITPVNENTVPTGEIMPVKGTPFDFTSFNRIGSTISQVGLGYDHNYVLDCGEEKEGLRHAAKVRDPSSSRVLNLWTNAPGVQFYTANYVNGVQGKGGAIYGKHAGLCLETQGFPNAINQPNFPSVVVRPGEKYQHTMLFEFSLE

SEQ ID NO: 9345 - protein, 339 aa, Glycine max
MADQSPKPETFELNNGSMQVLLSNLGCTIISLSVPGKDGLLSDIVLGLESVESYQKGLAPYFGCIVGRVANRIKDGKFTLDGIQYSLPINKPPNSLHGGNVGFDKKVWEVVEYKKGNTPSITFRCHSHDGEEGYPGDVTVTATYTLTSSTTLRLDMEGVPKDKPTIVNLAQHTYWNLAGHNSGNILDHSIQLWANHITPVDENTVPTGKIMPVKGTPFDFTSENRIGNTISQVGLGYDHNYVLDCGEEKEGLRHAAKVRDPSSSRVLNLWTNAPGVQFYTANYVNGVQGKGGAIYGKHAGLCLETQGFPNAINQPNFPSVVVRPGEKYQHTMLFEFSLE

SEQ ID NO: 9346 - protein, 339 aa, Vigna unguiculata
MADQSPKPETFELSNGSMKILLTNLGCTIISLSVPGKDGVLSDVVLGLDSVESYQKGLSPYFGCIVGRVANRIKDGKFTLDGVQYSLPLNKPPNSLHGGNVGFDKRVWEVVEHKKGETPSITFKYHSQDGEEGYPGDITFTATYTLTSNTTLRLDMEGIPKDKPTIVNLAQHTYWNLAGHNSGNVLDHSIQIWANHLTPVDENTVPTGEIKPVKGTPFDFTSEKRIGNNISEVGLGYDHNFVLDCGEEKDGLRHVAKVRDPSSSRVLNLWTSAPGVQFYTGNYVNGVVGKGGAVYEKHAGLCLETQGFPNAINQPNFPSVVVRPGEKYQHTMLYEFSVE

SEQ ID NO: 9347 - protein, 247 aa, Vigna unguiculata
MYIASMGRSFKDSLKLLEADIHHANTLASDFPREYDGACLQMRMSYSMAAHLFLFLVQWTDCNLAGALGLLRILIYKVYVDGTTTMSTHERKASIREFYAVIYPSLLQLQKGVTDTEDKKQKAVCLERYRKRDEEEHRQPSDIDIEREEECGICMEMNSKIVLPDCNHVMCLKCYHEWRTRSQSCPFCRDSLKRVNSGDLWVFTDGRDVVDMATVTRENLRRLFMYIDKLPLIIPDSLFDTYDSHLR

SEQ ID NO: 9348 - protein, 247 aa, Vitis vinifera
MYIASMRKSFKDSLKVLEADLQHANTLASDFPREYDGACLQMRMSYSPAAHLFLFLVQWTDCHLAGALGLLRILIYKVYVDGTTTMSTHERKASIREFYAVIYPSLLQLERGLTDTEDKKQKAVCMERYRRRDDEEHKQYSDVDIEREEECGICMEMNSKIVLPNCNHAMCLKCYREWRSRSQSCPFCRDSLKRVNSGDLWVFTDSRDIIDMVTVTRENLRRLFMYIDKLPLIIPDSLFDQYDSHLR

SEQ ID NO: 9349 - protein, 242 aa, Glycine max
MGRSFKDSLKLLEADIHHANTLASDFPREYDGACLQMRMSYSPAAHLFLFLVQWTDCNLAGALGLLRILIYKVYADGTTTMSTHERKASIREFYAVIYPSLLQLQKGVTDTEDTKQKAVCMERYRKRDDEEHRQPSDIDIEREEECGICMEMNSKIVLPDCNHVMCLKCYHEWRTRSQSCPFCRDNLKRVNSGDLWVFTDNRDVVDMATVTRENLRRLFMYIDKLPLVIPDFLFDTYDSHLR

SEQ ID NO: 9350 - protein, 242 aa, Euphorbia peplus
MRKSFKDSLKVLEADIQHANTLASDFPREYDGACLQMRMSYSPAAHLFLFLVQWTDCNLAGALGLLRILIYKVYVDGTTTMSTHERKASIREFYAVIYPSLLQLERGVTDTEDKKQKVVCMERYRRRDDEGNKQHSDVDMEREEECGICMEMNSKIVLPNCNHAMCLKCYREWRTRSQSCPFCRDSLKRVNSADLWVFTDSRDIVDMATVARENLRRLFIYIDKLPLIIPESLFDTYDSHIR

SEQ ID NO: 9351 - protein, 242 aa, Vitis vinifera
MRKSFKDSLKVLEADLQHANTLASDFPREYDGACLQMRMSYSPAAHLFLFLVQWTDCHLAGALGLLRILIYKVYVDGTTTMSTHERKASIREFYAVIYPSLLQLERGLTDTEDKKQKAVCMERYRRRDDEEHKQYSDVDIEREEECGICMEMNSKIVLPNCNHAMCLKCYREWRSRSQSCPFCRDSLKRVNSGDLWVFTDSRDIIDMVTVTRENLRRLFMYIDKLPLIIPDSLFDQYDSHLR

SEQ ID NO: 9352 - protein, 146 aa, Phaseolus coccineus
MGRSFKDSLKLLEADIHHANTLASDFPREYDGACFQMRMSYSMAAHLFIFLVQWTDCNLAGALGLLRILIYKVYVDGTTTMSTYERKASIREFYAVIYPSLLQLQKGVTDTEDKKQKAVCSERYRKRDEEEHRQLSVIDIEREEEC

SEQ ID NO: 9353 - protein, 242 aa, Lotus japonicus
MGRSFKESLKLLEADIHHANTLASDFPREYDGACLQMRMSYSPAARLFLFLVQWTDCNLAGALGLLRILIYKVYVDGTTTMSVHERKASIREFYGFIYPSLLQLQKGVTDTEDKKQKAVCMERYRRRDDEEDRQSSDIDIEREEECGICMEMNSKIVLPDCNHAMCLKCYHEWRTRSQSCPFCRDSLESVNSGDLWVLTDSRDVVDMATVTRENIRRLFMYIDKLPLIIPDSLFDTYDSHLR

SEQ ID NO: 9354 - protein, 242 aa, Glycine max
MRKSFKDSLKVLEADIQHANTLASDFPREYDGACLQMRMSYSPAAHLFLFLVQWTDCHLAGALGLLRILIYKVYVDGTTTMSTHERKASIREFYAVIYPSLLQLEKGVTDTEDKKQKVVCMERYRRRDDEEYRQSSDIDIEREDECGICMDMNSKIVLPNCNHAMCLKCYREWRTISQSCPFCRDSLKRVNSGDLWVFTDRRDVVDMATVTRENLRRLFMYIDKLPLIVPDSLFDTYDSHIR

SEQ ID NO: 9355 - protein, 162 aa, Trigonella foenum-graecum
MSTHERKASIREFYAVIYPSLLQLEKGVTDSEDKKQKAACMERYRRRDDEDCRQSSDIDIEREDECGICMEMNSKIVLPNCNHAMCLKCYREWRTRSQSCPFCRDSLKRVNSGDLWVYTDRRDVVDMATVTRENLRRLFMYIDKLPLIVPDSLFDTYDSHIR

SEQ ID NO: 9356 - protein, 247 aa, Carica papaya
MYIGSMRKSFKDSLKVLEADIQHANTLASDFPRDYDGACLQMRMSYSPAAHLFLFLVQWTDCHLAGALGLLRILIYKVYVDGTTTMSTHERKASIREFYAVIYPSLLQLQKGVTDTEDKKQKAVCMERYRRRDEEEHRLQTDADIEREEECGICMEMNSKIVLPNCNHAMCLKCYREWRTRSQSCPFCRDSLKRVNSGDLWVYTDSRDVVDMATVTRENFRRLFLYVDKLPLIVPDNLFDPYDSHLR

SEQ ID NO: 9357 - protein, 242 aa, Glycine max
MRKSFKDSLKVLEADIQHANTLASDFPREYDGACLQMRMSYSPAAHLFLFLVQWTDCHLAGALGLLRILIYKVYVDGTTTMSTHERKASIREFYAVIYPSLLQLEKGVTDTEDKKQKAVCMERYRRRDDEEYRQSSDIDIEREDECGICMDMNSKIVLPNCNHAMCLKCYREWRTISQSCPFCRDSLKRVNSGDLWVFTDRRDVVDMATVTRENLRRLFMYIDKLPLIVPDSLFDTYDSHIR

SEQ ID NO: 9358 - protein, 334 aa, Ricinus communis
MGKGGERHVEEEEAEGVMATDFFWSYTDEPHASRRRQILSQYPQIKQLFGPDPFAFFKVSVVVLLQLGTAALLHDSGWLKILAIAYFFGSFLNHNLFLAIHELSHNLAFSTPVYNRWLGIFANLPVGVPMSVTFQKYHLEHHRFQGVDGIDMDIPSQIEAHLVRNVITKSIWVIFQLFFYALRPLFLKPKPPGYWEFINLFVQIALDVAMVYFWGWKSFAYLILSTFVGGGMHPMAAHFISEHYVFNPEQETYSYYGPLNFVTWHVGYHNEHHDFPRIPGSKLHKVKEIAPEYYEGLDSYKSWSQVIYMYVMDRTVGPFSRMKRKVSTTTKKSE

SEQ ID NO: 9359 - protein, 247 aa, Vigna unguiculata
MYVASMRKSFKDSLKVLEADIQHANTLASDFPREYDGACLQMRMSYSPAAHLFLFLVQWTDCHLAGALGLLRILIYKVYVDGTTTMSTHERKASIREFYAVIYPSLLQLQKGITDTEDKKQKAVCMERYRRRDDEDYRQSSDIDIEREDECGICMDMNTKIVLPNCNHAMCLKCYREWRTISQSCPFCRDSLKRVNSGDLWVFTDRRDVVDMATVTRENLRRLFMYIDKLPLIVPDSLFDAYDSHIR

SEQ ID NO: 9360 - protein, 151 aa, Heritiera littoralis
MRKSFKDSLKVLEADIQHANTVASDFPREYDGACLQMRMSYSPAAHLFLFLVQWTDCHLAGALGLLRILIYKVYVDGTTTMSTHERKASIREFYAVIYPSLLQLQRGVTDTEDKNRKQCAWKGTEEEKMKSIGSSLTWILKEKKNVEYAWR

SEQ ID NO: 9361 - protein, 242 aa, Manihot esculenta
MRKSFKDSLKVLEADIQHANTMASDFPREYDGACLQMRMSYSPAAHLFLFLVQWSDCHLAGALGLLRILIYKVYVDGTTTMSTHERKASIREFYAVIYPSLLQLQSGVTDTEDKKQKAACMERFRRRDDEERRQLSEVDIEREEECGICMEMNSKIVLPNCNHAMCLKCYREWRSRSQSCPFCRDSLKRVNSGDLWMFTDSRDIVDMATVTRENLRRLFMYIDKLPLIVPDSLFDNYDSHLR

SEQ ID NO: 9362 - protein, 242 aa, Ricinus communis
MRKSFKDSLKVLEADIQHANTLASDFPRDYDGACLQMRMSYSPAAHLFLFLVQWTDCHLAGALGLLRILIYKVYVDGTTTMSTHERKASIREFYAVIYPSLLQLQRGVTDTEDKKQKAVCLERYRRRDEEEHRLRTDVDIEREEECGICMEMNSKIVLPNCNHALCLKCYHEWRSRSQSCPFCRDSLKRVNSGDLWVFTDSRDVVDTATVTRENLRRLFMYIDKLPLIVPDSLFDTYDSHLR

SEQ ID NO: 9363 - protein, 242 aa, Castanea mollissima
MRKSFKDSLKVLEADIQHANTLASDCPREYDGACLQMRMSYSPAAHIFLFLVQWTDCNLAAALGLLRILIYKVYVDGTTTMSTHERKASIREFYAVIYPSILQLQRGVSDTEDKKQKAVCMERYRRRDDEEHRLRSDVDIEREEECGICMEMNSKIVLPNCNHAMCLKCYREWRSRSQSCPFCRDSLKRVNSGDLWVFTDSKDIVDMATVTRENLRRLFQYIDKLPLIVPDSLFDTYDSHLR

SEQ ID NO: 9364 - protein, 246 aa, Tropaeolum majus
MYIGSTRRSFKDSLKVLEADIQHANTLASDFPREYDGACLQLRMSYSPAAHLFLFLVQWTDCNLAGALGLLRILIYKVYVDGTTTMSTHERKASIREFYAVIYPSLMQLQTGITDNEDKKQKAVCMERYKRRDEEHILHTDVDIEREEECGICMETNSKIVLPNCNHAMCLKCYREWRSRSQSCPFCRDSLKRVNSGDLWVYTDCGDIIDMATVTRENLRRLFTYIDKLPLIVPDHLFDTYDSHLR

SEQ ID NO: 9365 - protein, 242 aa, Glycine max
MGRSFKDSLKLLEADIHHANTLASDFPREYDGTCLQMRMSYSPAAHLFLFFVQWTDCNLAGALGLLRILIYKVYVDGTTTMSTLERKASIREFYAIIYPSLVQLQESVADTEDKKQKAVCMERYRKRDDEEHRQPSDIDIEREEECGICMEMNSKIVLPDCNHVMCLTCYHEWRTRSQSCPFCRNSLKRVNSGDLWVFTDNRDVVDMATATRENLRRLFMYIDKLPLVIPDFLFDTYDSHLR

SEQ ID NO: 9366 - protein, 242 aa, Medicago truncatula
MRKSFKDSLKLLQADIQHANTLASDFPREYDGACLQMRMSYSPAATLFLFFVQWTDCHLAGALGLLRILIYKVYVDGTTTMSTHERKASIREFYAVIYPSLLQLEKGVTDSEDKKQKAVCMERYRRRDDDDCRQSSDIDIERDDECGICMEMNSKIVLPNCNHVMCLKCYREWRTRSQSCPFCRDSLKRVNSGDLWVYTDRRDVVDMATVTRENLRRLFMYIDKLPLIVPDSIFDAYDSHIR

SEQ ID NO: 9367 - protein, 242 aa, Arachis hypogaea
MRRSFKDSLKVLEADIQHANTLASEFPKECDGACLQMRMSYSPAAHLFLFLVQWADCNLAGALGLLRILIYKVYVDGTTTMSTHERKASIREFYAVIYPSLLQLQKGVTDSEDKKQKAVCMERYRKRDDEDHQLHSDIDIEREEECGICMEVNSKIVLPNCIHAMCLKCYREWRTRSQSCPFCRDSLKRVNSCDLWVFTDSRDVVDMETVTREDIKRLFMYIDKLPLIIPDSLFDPYDSQLR

SEQ ID NO: 9368 - protein, 247 aa, Populus trichocarpa
MYIGSVRKSFKDSLKVLEADIQHANTLASDISRDYDGACLQMRMSYSPAAHLFLFLVQWTDCHLAGALGLLRILIYKVYVDGTTTMTTHERKASIREFYAVIYPSLLQLQRGVTDTEDKEQKAVCMERYRRRDDEEHRQHADVDIEREEECGICMEMNSKIVLPNCHHAMCLKCYREWRSRSQSCPFCRDSLKRVNSGDLWVFTDSKDIVDMATVTRDNLRRLFMYVDKLPLIIPDNLFDTYDSHVR

SEQ ID NO: 9369 - protein, 242 aa, Citrus clementina
MRKSFKDSLKVLEADIQHANTLASDFPREYDGACLQMRMSYSPAAHLFLFLVQWTDCHLAGALGLLRILIYKVYVDGTTTMSTHERKASIREFYAIIYPSLLQLQRGVTDTEDKKQKAVYMERYRRRDDEEQRQYTDADIEREEECGICMETNSKIVLPNCNHAMCLKCYREWRTRSQSCPFCRDSLKRVNSGDLWVYMDSRDIIDSATVTRENLRRLFLYIDKLPLIIPDNLFDPYDSHLR

SEQ ID NO: 9370 - protein, 242 aa, Unknown
  Sequence found in Organisms: Citrus sinensis, Citrus sinensis
MRKSFKDSLKVLEADIQHANTLASDFPREYDGACLQMRMSYSPAAHLFLFLVQWTDCHLAGALGLLRILIYKVYVDGTTTMSTHERKASIREFYAIIYPSLLQLQRGVTDTEDKKQKAVYMERYRRRDDEEQRQYTDADIEREEECGICMETNSKIVLPNCNHAMCLKCYREWRIRSQSCPFCRDSLKRVNSGDLWVYMDSRDIIDSATVTRENLRRLFLYIDKLPLIIPDNLFDPYDSHLR

SEQ ID NO: 9371 - protein, 75 aa, Valeriana officinalis
MRKSFKDSLKVLQADIQHANTLASDFPREYDGACLQMRMSYSPAAHYFLISCSVDRLSPGWCSRAFKDSYLQGVC

SEQ ID NO: 9372 - protein, 242 aa, Euonymus alatus
MRKSFKDSLKVLEADIQHANTLASDFPRDYDGACLQMRMSYSPAAHLFLFLVQWTDCNLAGALGLLRILIYKVYVDGTTTMSTHERKASIREFYAIIYPSLLQLQRGVIDTEDKKQKAVCMERYRRRDDEDRRQYTDVEIEREEECGICMEMNNKIVLPNCNHTLCLKCYREWRSRSQSCPFCRDSLKRVNSGDLWVFTDSRDIIDMATVTRENLRRLFMYIDKLPLIVPDNLFDAYDSHLK

SEQ ID NO: 9373 - protein, 245 aa, Silene vulgaris
MYVASTGKSFKDSLKVLEADIQHANTLASELPREYDGACLQMRMSYAPAAHFLLFLVQWTDCHLAGALGLLRILIYKVYVDGTTTMSTHERKASIREFYGVIYPSLLQLENGVTDTEDKKQKSVCMERYRKRDEHRHFSDVDSEREEECGICMESYSKIVLPNCNHALCLKCYREWRSRSQSCPFCRDSLKRVNSGDLWVFTDSRDVVDMATLTKENLRRLFMYIEKLPLIIPESLFDAYDSHLK

SEQ ID NO: 9374 - protein, 242 aa, Gossypium hirsutum
MRKSFKDSLKVLEADIQHANTLASDFPREYDGACLQMRMSYSPAAHLFLFLVQWTDFHLAGALGLLRILIYKVYVDGTTTMSTHERKASIREFYTVIYPSLLQLQSGVTDSEDKQQKAACVERYRRREDEEYKQLTDIDFEREEECGICMETNSKMLLPNCNHTMCLKCYREWRSISQSCPFCRDSLKRVNSGDLWVYTDSRDIIDMATVTRENLRRLFMYIDKLPLIIPDTIFDTYDSHLK

SEQ ID NO: 9375 - protein, 242 aa, Fragaria vesca
MRKSFKDSLKVLEADIQHANTLASDYPREYDGACLQMRMSYSPAAHLFLFLVQWTDCNLAGALGLLRILIYKVYVDGTTTMSTHERKASIRDFYAVIYPSLLQLQRGVTDSEDKRQKAVCMERYRKRDDEENRQCSDIEIEREEECGICMETNSKIVLPNCNHAMCLKCYRDWRTRSQSCPFCRDSLKRVNSGDLWVYTDSRDIVDMATVMRENHRRLFIYVDKLPVIIPDNLFDPYDSHLR

SEQ ID NO: 9376 - protein, 242 aa, Euonymus alatus
MRKSFKDSLKVLEADIQHANTLASDFPRDYDGACLQMRMSYSPAAHLFLFLVQWTDCNLAGALGLLRILIYKVYVDGTTTMSTHERKASIREFYAIIYPSLLQLQSGVSDTEDKKQKAVCMERYRRRDDEDRRQYTDVEIEREEECGICMEMSSKIVLPNCNHALCLKCYREWRSRSQSCPFCRDSLKRVNSGDLWVFTDCRDIIDMATVTRENLRRLFMYIDKLPLIVPDDLFDVYDSHLK

SEQ ID NO: 9377 - protein, 242 aa, Gossypium hirsutum
MRKSFKDSLKVLEADIQHANTLASDFPREYDGACLQMRMSYSPAAHLFLFLVQWTDFHLAGALGLLRILIYKVYVDGTTTMSTHERKASIREFYTVIYPSLLQLQSGVTDSEDKQQKAACVESYRRREDEEYKQLTDIDFEREEECGICMETNSKMLLPNCNHTMCLKCYREWRSRSQSCPFCRDSLKRVNSGDLWVYTDSRDIIDMATVTRENLRRLFTYIDKLPLIIPDTIFDTYDSHLK

SEQ ID NO: 9378 - protein, 243 aa, Prunus persica
MRKSFKDSLKVLEADIQHANTLASDYPREYDGACLQMRMSYSPAAHLFLFLVQWTDCNLAGALGLLRILIYKVYVDGSTTIMSTKERKASIREFYAVIYPSLLQLQRGVTDSEDKKQKAVCVERYRKRDDEENRQCSDIDIEREEECGICMETNSKIVLPNCNHAMCLKCYRDWRTRSQSCPFCRDNLKRVNSGDLWVYTDCRDIVDMETVMRENLRRLFMYIDKLPLVTPDNPFDPYDSHLR

SEQ ID NO: 9379 - protein, 162 aa, Cajanus cajan
MSTHERKASIREFYAVIYPSLLQLQNGVTDTEDKKQKAVCMERYRKRDEEDYRQSSDIDIEREEECGICMEMNSKIVLPDCNHVMCLKCYHEWRTRSQSCPFCRDSLKRVNSGDLWVFTDSRDIVDMATVTRENLRRLFMYIDKLPLIIPDSLFDTYDSHLR

SEQ ID NO: 9380 - protein, 242 aa, Cucumis sativus
MRKSFKDSLKVLEADIQHANTLASEFPGEYDGPCLQMRMSYSPAAHLFLFLVQWTDCHLAGALGLLRILIYKVYVDGTTTMSTHERKASIREFYAVIYPSLLQLQRGVTDTEDKKQKAVCMERYRRRDDEECIQRSDADIEREEECGICMETTSKVVLPNCNHALCLKCYREWRTRSQSCPFCRDSLKRVNSGDLWVFTDNRDIVDMATVTRENLKRLFKYIDKLPTIVPDSLFDAYDTHLR

SEQ ID NO: 9381 - protein, 242 aa, Unknown
  Sequence found in Organisms: Cucumis melo, Citrullus lanatus
MRKSFKDSLKVLEADIQHANTLASEFPGEYDGPCLQMRMSYSPAAHLFLFLVQWTDCHLAGALGLLRILIYKVYVDGTTTMSTHERKASIREFYAVIYPSLLQLQRGVTDTEDKKQKAVCMERYRRRDDDECIQRSDADIEREEECGICMETTSKVVLPNCNHALCLKCYREWRTRSQSCPFCRDSLKRVNSGDLWVFTDNRDIVDMATVTRENLKRLFKYIDKLPTIVPDSLFDAYDTHLR

SEQ ID NO: 9382 - protein, 242 aa, Populus trichocarpa
MTKSFKDSIKVLEADLQHANTLASDFSRDYDGACLQMRMSYAPAANLFLFLFQWTDCHLAGALGLLRILIYKVYVDGTTTMFTHERKASIKEFYAVIYPSLLQLQRGVTDTEDKKQKAVCLERYRRRDDEEHRQHTDIDIEREEECGICMEMNSKIVLPNCNHAMCLKCYREWRTRSQSCPFCRDSLKRVNSGDLWVFTDGRDIVDTATVTRENLRRLFMYIDKLPLILPDNLFDLYDSHIR

SEQ ID NO: 9383 - protein, 242 aa, Malus domestica
MRKSFKDSLKVLEADIQHANTLASDFPREYDGACVQMRMSYSPAAHLFLFLVQWTDCNLAGALGLLRILIYKVYVDGSTTMSTKERKASIREFYAVIYPSLLQLQGGVTDSEDKRQKAVCLERYCKRDDEESRQCSDIDIEREEECGICMETNSKIVLPNCNHVLCLKCYRDWRSRSQSCPFCRDNLKRVNSGDLWVYTDSRDIIDMETVMTENLRRLFTYIDKLPLITPDNPFDSYDSHLR

SEQ ID NO: 9384 - protein, 242 aa, Solanum phureja
MRKSFKDSLKVLEADIQHANTLASDFPREYDGACLQMRMSYSPAAHLFLFLVQWTDCHLAGALGLLRILIYKVYVDGTTTMSVHERKASIREFYAVIYPSLLQLERGVTDSEDKKQKAVCQERYRRRDDEDYRQSSDSDIEREDECGICMEMNSKIVLPKCNHALCLKCYREWRSRSQSCPFCRDSLKRVNSGDLWVYMDNKDIVDMSTITRENLRRLFMFIDKLPLIVPDNVFDHYDTHIR

SEQ ID NO: 9385 - protein, 242 aa, Eucalyptus grandis
MRKSFKDSLKVLEADIQHANTLASDFPRDYDGASLQMRLSYGPAAHFFLFLVQWADCHLAGALGLLRILIYKVYVDGTTTMSTHERKASIREFYAVIYPSLLQLERGVTDTEDRRQKTTCMERYKRREEEEHRQFADIEFEKEDECGICMEMNSKIVLPNCSHVMCLKCYREWRTRSQSCPFCRNNLKRVNSGDLWIFMDSRDIVDMFTVTRENLRRLFLYIDKLPLVEPDNLLETYDSHLR

SEQ ID NO: 9386 - protein, 242 aa, Mimulus guttatus
MRKSFKDSLKLLEADIQHANTLASDFPREYDGACLQMRMSYSPAAHFFLFLVQWTDCHLAGALGLLRILIYKVYVDGTTTMSTHERKASIREFYAVIYPSLLQLERGVTDSEDKKQKAVCLERYRRKDEEEHKQCSDLDIEREDECGICMEMNSKIVLPNCNHAMCLKCYREWHSRSQSCPFCRDSLKRVNSCDLWVFLETRDAIDMVSITRENLKRLFIYIDKLPVVVPDSLFDAYDTHVR

SEQ ID NO: 9387 - protein, 242 aa, Solanum lycopersicum
MRKSFKDSLKVLEADIQHANTLASDFPREYDGACLQMRMSYSPAAHLFLFLVQWTDCHLAGALGLLRILIYKVYVDGTTTMSVHERKASIREFYAVIYPSLLQLERGVTDSEDKKQKAVCQERYRRRDDEDYRQSSDSDIEREEECGICMEMNSKIVLPKCNHALCLKCYREWRSRSQSCPFCRDSLKRVNSSDLWVYMDNKDIVDMSMITRENLRRLFMFIDKLPLIVPDNVFDHYDTHIR

SEQ ID NO: 9388 - protein, 242 aa, Silene vulgaris
MRKSFKDSLKVLEADIQHANTLASELSREYDGACLQMRMSYAPAAHFLLFLVQWTDCNLAGALGLLRILIYKVYVDGTTTMSTHERKASIREFYAVIFPSLMQLENGITDTEDRKQKAVCMEKYHKRDEEECIQFSDEDIEREEECGICMEDCSKIVLPNCNHVMCLKCYRDWRSRSQSCPFCRDSLKRVNSGDLWVYTDNNDVVDMKTLTRENLRRLFMYIDKLPLIVPESLLDAYDSHLK

SEQ ID NO: 9389 - protein, 225 aa, Theobroma cacao
MTEDQASDFPREYDGACVQMRMSYSPAAHLFLFLVQWTDCHLAGALGLLRILIYKVYVDGTTTMSTHERKASIREFYAVIYPSLLQLQRGVTDTEDKKQKAVCMERYRRREDEEYRQLTDVDFEREEECGICMEMNSKIVLPNCNHAMCLKCYREWRSRSQSCPFCRDSLKRVNSGDLWVFTDSRDIIDMATVTRENLRRLFMYIDKLPLIVPDTIFDTYDSHLR

SEQ ID NO: 9390 - protein, 68 aa, Tropaeolum majus
MRKSFKDSLKVLEADIQHANTLASEFPREYDGACLQLRMSYSSAAHLLLFWCNGQTAILLEPSDFYEY

SEQ ID NO: 9391 - protein, 242 aa, Orobanche aegyptiaca
MRKSFKDSLKVLEADIQHANTLASDFSREYDGACLQMRMSYSPAAHFFLFLVQWTDCHLAGALGLLRILIYKVYVDGTTTMSTHERKASIREFYAVIYPSLLQLERGVTDSEDKKQKAVCLERYKRKDEEEHRHCSELDIEREEECGICMEMNSKIVLPNCNHAMCLKCYREWRSRSQSCPFCRDSLKRVDSCDLWVFLDGRDVIDMTAITRENLKRLFLYIDKLPLVVPDTLFDAYDTHVR

SEQ ID NO: 9392 - protein, 241 aa, Coffea canephora
RKPFKDSLKVLEADIQHANTLASDFPREYDGACLQMRMSYSPAAHLFLFLVQWTDCHLAGALGLLRILIYKVYVDGTTTMSTHERKASIREFYAIIYPSLMQLQRGVTDSEDKKQKAVCLERYKRRDEEEHRQISELEVEREEECGICMEMNSKIVLPNCNHAMCMKCYREWRLRSQSCPFCRDSLKRVNSGDLWVLMDSKDVVDMATITRENLRRLFMYIDKLPLVVPDNLFDTYDNHLR

SEQ ID NO: 9393 - protein, 242 aa, Triphysaria pusilla
MRKSFKDSLKLLEADIQHANTLASDFSREYDGACLQMRMSYSPAAHFFLFLVQWTDCNLAGALGLLRILIYKVYVDGTTTMSTHERKASIREFYAVIYPSLMQLERGVTDSEDKKQKAVCLERYRRKDEEEQRQCLELDIEREDECGICMEMNSKIVLPNCNHVMCQKCYREWRTRSQSCPFCRDSLKRVNSGDLWVFIDGRDAIDMMTITRDNLKRLFMYIDKLPLVVPDDLFDAYDTHVR

SEQ ID NO: 9394 - protein, 242 aa, Ananas comosus
MRKSFKDSLKVLEADIQHANSLASDFPREYDGACLQMRMSYSPAAHLFLFLVQWTDCSLAGALGLLRILIYKVYVDGTTTMSTHERKASIREFYAVIFPSLMQLHKGINDMEDKKQKAVCIERYRRRDEDERWHFSEIDVEREDECGICMETNSRVVLPNCSHAMCMKCYREWRSRSQSCPFCRDSLKRVNSGDLWIFTDGRDIIDMATVTRENLRRLFMYIDKLPVVIPDSVLDSYDSHVK

SEQ ID NO: 9395 - protein, 519 aa, Trigonella foenum-graecum
IGLIVGYFLFIYFQPTDVEDPKITPIVDQDDETLQKMLPEIPNWIKNPDFDRIDWLNKFIELMWPYLDKAICKTAKNIAKPIIEEQIPKYKIDSVEFQTLTLGTLPPTFQGMKVYVTDEKELIMEPSIKWAGNPNVTIAVKAFGLKATVQVVDLQVFLLPRITLKPLVPSFPCFANIYVSLMEKPHVDFGLKLVGADLMSIPGVYRIVQELIKDQVANMYLWPKNLEVQILDMAKALRRPVGILHVKVVQAMKLKKKDLLGASDPYVKLKLTDDKMPSKKTTVKHKNLNPEWNEEFNLVVKDPETQVLQLNVYDWEQVGKHDKMGMNVITLKEVSPEEPKRFTLDLLKTLEPNDAQNEKSRGQIVVELTYKPLNEEEMGKGFDETQTIPKAPEGTPAGGGQLVVIVHEAQDVEGKHHTNPQARLIFRGEEKKTKRMKKNRDPRWEDEFKFTAEEPPTNDRLHVEVVSTSSRNLLHQKESLGYVDINLGDVVSNKRINEKYHLIDSKNGRIQVELQWRTA

SEQ ID NO: 9396 - protein, 475 aa, Cajanus cajan
MFPEIPLWIKNPDFDRLDWLNRFLEYMWPYLDKAICKTARNIAKPIIAEQIPKYKIDSVEFETLTLGSLPPTFQGMKVYVTDEKELIMEPSVKWAGNPNVTISVKAFGLKATVQVVDLQVFLLPRITLKPLVPSFPCFANIYVSLMEKPHVDFGLKLIGADLMSIPGIYRIVQELIKDQVANMYLWPKTLEVPILDMSKALKRPVGILHVKVLHAMKLKKKDLLGASDPYVKLKLSEDKLPSKKTTVKHKNLNPEWNEEFNMVVKDPESQVLEINVYDWEQVGKHDKMGMNVIPLKEVSPEEPKRFTLDLLKNMDPNDVQNEKSRGQIVVELTYKPFKEEDLGKGFEETQTVPKAPEGTPAGGGLLVVIVHEAQDVEGKYHTNPHVRLIFRGEEKKLSALKRTEIQDGKTNSILRWRSLPPMIDYMWRLSALRHETCSTKRNHWVISTSILGMLSPTKELTRSIILLTPRMVASR

SEQ ID NO: 9397 - protein, 539 aa, Glycine max
MGFFGTILGFLGFGVGISIGLVSGYFLFIYFQPTNVEDPEIKPLSEQEQETLQRMFPEIPLWIKNPDFDRLDWLNKFVEYMWPYLDKAICKTAKNIAKPIIAEQIPKYKIDSVEFETLTLGSLPPTFQGMKVFVTDEKELIMEPSVKWAGNPNVTVSVKAFGLKATVQVVDLQVFLLPRITLKPLVPSFPCFANIYVSLMEKPHVDFGLKLIGADLMSIPGVYRIVQELIKDQVANMYLWPKTLEVQVLDMSKALKRPVGILHVKVLQAMKLKKKDLLGASDPYVKLKLTEDKLPSKKTTVKHNNLNPEWNEEFNIVVKDPDSQVLEINVYDWEQVGKRDKMGMNVIPLKEVSPEEPKRFTLDLLKNMDPNDAQNEKSRGQIVVELTYKPFKEEDLGKGFEETQTVPKAPEGTPAGGGLLVVIVHEAQDVEGKYHTNPHVRLIFRGDEKKTKRIKKNRDPRWEDEFQFMVDEPPTNDRLHVEVVSTSSRNLLHQKESLGYIDINLGDVVANKRINEKYHLIDSKNGRLQIELQWRTSEA

SEQ ID NO: 9398 - protein, 539 aa, Glycine max
MGFFGTILGFLGFGVGISIGLVAGYFLFIYFQPTNVEDPEIKPLAEQEQETLQRMFPEIPLWIKNPDFDRLDWLNKFVEYMWPYLDKAICKTAKNIAKPIIAEQIPKYKIDSVEFETLTLGSLPPTFQGMKVYVTDEKELIMEPSVKWAANPNVTVSVKAFGLKATVQVVDLQVFLLPRITLKPLVPSFPCFANIYVSLMEKPHVDFGLKLIGADLMSIPGVYRIVQELIKDQVANMYLWPKTLEVQVLDMSKALKRPVGILHVKVLQAIKLKKKDLLGASDPYVKLKLTEDKLPSKKTTVKHKNLNPEWNEEFNMVVKDPDSQVLEINVYDWEQVGKHDKMGMNVIPLKEVSPEETKRFSLDLLKNMDPNDVQNEKSRGQIVVELTYKPFKEEDLGKGFEETQTVPKAPEGTPAGGGLLVVIVHEAQDVEGKYHTNPHVRLIFRGEEKKTKRIKKNRDPRWEDEFQFMVEEPPTNDRLHVEVVSTSSRNLLHQKEPLGYIDINLGDVVANKRINEKYHLIDSKNGRLQIELQWRTLEA

SEQ ID NO: 9399 - protein, 539 aa, Phaseolus coccineus
MGFFSAILGFFGFGVGISIGLVAGYFLFIYFQPTDVEDPEIKPLVEQEQETLQRMFPEIPLWVKSPDFDRLDWLNKFLEYMWPYLDKAICKTAKNIAKPIIAEQIPKYKIDSVEFETLTLGSLPPTFQGMKVYVTDEKELIMEPSVKWAGNPNVTVSVKAFGLKATVQVVDLQVFLLPRVTLKPLVPSFPCFANINVSLMEKPHVDFGLKLIGADLMSIPGVYRIVQDLIKDQVANMYLWPKTLEVPILDMSKALRRPVGILHVKVLHAMKLKKKDLLGASDPYVKLKLTDDKLPSKKTSVKHKNLNPEWNEEFNLIVKDPDSQVLEINVYDWEQVGKHDKMGMNVVSLKDVSPEEPKSFTLDLLKTMDPNDVQNEKSRGQIVVELTYKPFKEEDLAKGFDETQTVPKAPEGTPEGGGLLVVIVHEAQDVEGKYHTNPHVRLIFRGEEKKTKRIKKNRDPRWEDEFSFMVEEPPTNDRLHVEVLSTSSRNLLHQKETLGYIDINLGDVVANKRINERYHLIDSKNGRLQVELQWRTSQA

SEQ ID NO: 9400 - protein, 538 aa, Citrus clementina
MGVISTIFGFCGFGVGISSGLVIGYFLFIYFQPTDVKNPEIRPLVERDSETLQQMLPEIPLWVKCPDYDRVDWLNKFLELMWPYLDKAICKTAKNIAKPIIAEQIPKYKIESVEFETLTLGTLPPTFQGMKVYVTDEKELIMEPCLKWAANPNVTIGVKAFGLKATVQVVDLQVFAQPRITLKPLVPAFPCFANIYVSLMEKPHVDFGLKLVGADLMSIPGLYRFVQELIKTQVANMYLWPKTLEVPILDPSKAYRRPVGILHVKVVKAMNLKKKDLLGASDPYVKLKITEDKLPSKKTTVKHKNLNPEWNEEYNFTVRDPESQAVELAVYDWEQVGKHDKMGMNVVPLKELTPEEPTVKTLDLLKNMDLNDGQNEKSRGQLVVEFMYKPFKEEDLPKSFEESQTVQKAPENTPAGGGLLVVIVHEAQDVEGKHHTNPYARILFRGEERKTKHVKKNRDPRWEEEFQFMLEEPPTNDRLHVEVCSVSSRIGLLHPKETLGYIDINLSDVVSNKRINEKYHLIDSKNGRIQIELQWRTA

SEQ ID NO: 9401 - protein, 538 aa, Citrus sinensis
MGVISTIFGFCGFGVGISSGLVIGYFLFIYFQPTDVKNPEIRPLVERDSETLQQMLPEIPLWVKCPDYDRVDWLNKFLELMWPYLDKAICKTAKNIAKPIIAEQIPKYKIESVEFETLTLGTLPPTFQGMKVYVTDEKELIMEPCLKWAANPNVTIGVKAFGLKATVQVVDLQVFAQPRITLKPLVPAFPCFANIYVSLMEKPHVDFGLKLVGADLMSIPGLYRFVQELIKTQVANMYLWPKTLEVPILDPSKAYRRPVGILHVKVVKAMNLKKKDLLGASDPYVKLKITEDKLPSKKTTVKHKNLNPEWNEEYNFTVRDPESQAVELAVYDWEQVGKHDKMGMNVVPLKELTPEEPSVKTLDLLKNMDLNDGQNEKSRGQLVVEFIYKPFKEEDLPKSFEESQTVQKAPENTPAGGGLLVVIVHEAQDVEGKHHTNPYARILFRGEERKTKHVKKNRDPRWEEEFQFMLEEPPTNDRLHVEVCSVSSRIGLLHPKETLGYIDINLSDVVSNKRINEKYHLIDSKNGRIQIELQWRTA

SEQ ID NO: 9402 - protein, 538 aa, Citrus sinensis
MGVISTIFGFCGFGVGISSGLVIGYFLFIYFQPTDVKNPEIRPLVERDSETLQQMLPEIPLWVKCPDYDRVDWLNKFLELMWPYLDKAICKTAKNIAKPIIAEQIPKYKIESVEFETLTLGTLPPTFQGMKVYVTDEKELIMEPCLKWAANPNVTIGVKAFGLKATVQVVDLQVFAQPRITLKPLVPAFPCFANIYVSLMEKPHVDFGLKLVGADLMSIPGLYRFVQELIKTQVANMYLWPKTLEVPILDPSKAYRRPVGILHVKVVKAMNLKKKDLLGASDPYVKLKITEDKLPSKKTTVKHKNLNPEWNEEYNFTVRDPESQAVELAVYDWEQVGKHDKMGMNVVPLKELTPEEPTVKTLDLLKNMDLNDGQNEKSRGQLVVEFIYKPFKEEDLPKSFEESQTVQKAPENTPAGGGLLVVIVHEAQDVEGKHHTNPYARILFRGEERKTKHVKKNRDPRWEEEFQFMLEEPPTNDRLHVEVCSVSSRIGLLHPKETLGYIDINLSDVVSNKRINEKYHLIDSKNGRIQIELQWRTA

SEQ ID NO: 9403 - protein, 538 aa, Manihot esculenta
MGFFSTIFGFCGFGVGISMGLMIGYYLFIYFQPSDDPEIRPLVEQDSETLQRMLPEIPLWVKNPDYDRIDWLNKFLEYMWPYLDKAICKTVKNIAAPIIAEQIPKYKIDSVEFETLTLGSLPPTFTGMKVYVTDEKELIMEPCFKWAGNPNVTVAVKAFGLKVTAQVLDLQVFALPRITLKPLVPSFPCFAKIYVSLMEKPHVDFGLKLVGADLMSIPGLYRVIQEIIKDQVANMYLWPKTLEVQIMDPTKALKKPVGILSVKVLRALKLKKKDLLGASDPYVKIKLTEDKLPSKKTTVKHKNLNPEWNEEFNLVVKDPETQAVEFHVYDWEQVGKHDKMGMKVVPLKELPPEEPKFMTLDLLKNMDMNDSQNEKSRGQLEVELTYKPFKEEEMPSGFEESSNTVQKAPDGTPAGGGLLVVIVHEAQDVEGKHHTNPHARLIFRGEERKTKHIKKNRDPRWEEEFQFMLDEPPTNDRLHVEVVSTSKRMGLLHPKESLGYVDISLADVVSNKRINEKYHLIDSKNGRIQIEMQWRTSS

SEQ ID NO: 9404 - protein, 538 aa, Theobroma cacao
MGFFSTVLGFCGFGVGISAGLVIGYYFFIYFQPSDVKDPEIRPLVEQDSETLQRMLPEIPLWVKNPDYDRVDWINKFLEYMWPYLDKAICATAKNIAKPIIEEQIPKYKIDAVEFETLTLGSLPPTFQGMKVYVTDEKELIMEPLIKWAGNPNVTVAVKAFGLKATVQVVDLQVFALPRITLKPLVPSFPCFANIYVSLMEKPHIDFGLKLIGADLMSIPGLYRFVQELIKDQVANMYLWPKTLQVPILDPAKAFKRPVGILHVKVVRAMKLRKKDLLGASDPYVKLKLTEDKLSSKKTTVKHKNLNPGWNEEFDMLVKDPETQALEFNVFDWEQVGKHDKMGMNVVPLKELTPEEPKVMTLELLKNMDLNDPQNEKSRGQLVMELTYKPLKDDEIPKTFEESKTVQKAPEDTPDGGGVLVVIVHEAQDVEGKHHTNPYVRVLFRGEEKKTKHVKKNRDPRWEEEFAFMLDEPPTNDKLHMEVLSSSSRIGLLHPKESLGYIDINLSDVVSNRRINERYHLIDSKNGRIQIELQWRTK

SEQ ID NO: 9405 - protein, 536 aa, Glycine max
MGFFGTIFGFFGFGIGISIGFVIGYFLFIYVQPTDVKDPEIQPLAEEDSETLQRMIPEIPLWIKNPDFDRVDWLNKLIEYMWPYLDKAICKTAKNIAKPIIDEQIPKYKIDSVEFEEFTLGSLPPTFQGMKVYETDEKELIMEPSIKWAGNPNVIVAVKKFGLKAIIQVMDLQAFLAPRITLKPLVPSFPCFANIYVSLMEKPHVDFGLKLVGVDLMSIPGFYKFVQEFIKDQVANMYLWPKTLEVQVIDPTKALKRPVGILNAKILKAMKLKKKDLLGASDPYVKLNLTEDKLTSKKTTVKHKNLNPEWNEEFSLVVKDPESQALELYVYDWEQVGKHDKMGMNMVPLKELLPEEPKVFTLDLLKNMDPNDAQNEKSRGQIVLELTYKPFREEDLAGFDETQPIQKAPEGTPPGGGLLVVIIHEAQDIEGKYHTNPHVRLIFRGEEKRTKVMKKNRDPRWEEEFQFLVEEPPTNDKLHVEVVSTSSRNLLRQKESLGYADISLADVVANNRINERHHLIDSKNGRIQIELQWRAS

SEQ ID NO: 9406 - protein, 538 aa, Populus trichocarpa
MGFLSTISGFCGFGVGLSTGLTIGYYLFIYFQPTDVKDPEVRPLAEQDSETLQRILPEIPLWVKNPDYDRIDWLNRFIQLMWPYLDKAICKTVKNIAKPIIAEQIPKYKIDAVEFETLTLGTLPPTFHGMKVYVTDEKELIMEPCIKWAGNPNVTVAVKAFGLKATAQVVDLQVFASPRITLKPLVPSFPCFANIYVSLMEKPHVDFGLKLLGADLMSIPGLYRVVQEIIKDQVANMYLWPKTLEVPILDPANAMKRPVGILKVKVLRAMKLKKKDLMGASDPYVKIKLTEDKLPAKKTTVKHKNLNPEWNEEFNLVVKDPESQALELRVYDWEQVGKHDRMGMNVVPLKDLTPEEPKVMTLDLLKNMDLNDPQNEKSRGQLMVELTYKPFKEDDLNKSFKDEVEQKAPEGTPAGGGLLVVTIHEAQDVEGKHHTNPYVRLLFRGEEMKTKRVKKNRDPRWEEEFQFTLEEPPVNAKLHVEVVSTSSRIGLLHPKESLGYVEINLSDVVSNRRINERYHLIDSKNGKIQIELQWRPAS

SEQ ID NO: 9407 - protein, 539 aa, Vitis vinifera
MGIVSTILGFCGFGVGISIGLFIGYYLFIYFQPTDVKDPIVRPLVEQDSKTLQRLLPEIPQWVKNPDYDRVDWLNKFIENMWPYLDKAICKTAKNIAKPIIAEQIPKYKIDSVEFEALTLGSLPPTFQGMKVYATDEKELIMELSMKWAGNPNITVAVKAFGLRATVQVVDLQVFAAPRITLKPLVPSFPCFANIFVSLMEKPHVDFGLKLLGADVMAIPGLYRLVQELIKDQVANMYLWPKTLEVPIMDPAKAMKKPVGILSVKVVRAMKLKKKDIMGASDPYVKMKLTEDKLPSKKTTVKHKNLNPEWNEEFNMVVKDPESQALEVIVYDWEQVGKHDKMGMNVIPLKELTPDEPKVLTLDLLKNMDPNDVQNEKSRGQIVLEALYKPFKDTEIPKDLEDPNAIEKAPEGTPAGGGLLVIIVHEAQEVEGKHHTNPYVRLLFRGEERKTKYVKKNRDPRWEEEFQFMLEEPPTNDRIHVEVVSTSSRMGLLHPKETLGYVDINLSDVVSNKRINEKYHLIDSKNGKIQIELQWRTST

SEQ ID NO: 9408 - protein, 539 aa, Vitis vinifera
MGIVSTILGFCGFGVGISIGLLIGYYLFIYFQPTDVKDPIVRPLVEQDSKTLQRLLPEIPQWVKNPDYDRVDWLNKFIENMWPYLDKAICKTAKNIAKPIIAEQIPKYKIDSVEFEALTLGSLPPTFQGMKVYATDEKELIMELSMKWAGNPNITVAVKAFGLRATVQVVDLQVFAAPRITLKPLVPSFPCFANIFVSLMEKPHVDFGLKLLGADVMAIPGLYRLVQELIKDQVANMYLWPKTLEVPIMDPAKAMKKPVGILSVKVVRAMKLKKKDLMGASDPYVKMKLTEDKLPSKKTTVKLKNLNPEWNEEFNMVVKDPESQALEVNVYDWEQVGKHDKMGMNVIPLKELTPDEPKVLTLDLLKNMDPNDVQNEKSRGQIVLEALYKPFKDTEIPKDLEDPNAIEKAPDGTPAGGGLLVIIVHEAQEVEGKHHTNPYVRLLFRGEERKTKYIKKNRDPRWEEEFSFMLEEPPTNDRIHVEVVSTSSRMGLLHPKETLGYVDINLSDVVSNKRINEKYHLIDSKNGKIQIELQWRTST

SEQ ID NO: 9409 - protein, 228 aa, Glycine max
MKMSLVWPLLTRRGFSTSSENLVASVLFERLPVVIPKIDPVVYAFQEFSFRWRQQYQRRYPDEFLDKSDARGKGDYQIDYVPAPRITEADQSNDRRSLQRALDRRLYLLLYGNAYGAPSGKPVWHFPEKVYESEDTMRKCAESALKSVIGDLSNTYFVGNAPMAHMVVQPTENQSGSTSFKRFFFKSQVIAKNKFDIGKCEDFVWVTKDELTEYFPEQAEFLNKMIIS

SEQ ID NO: 9410 - protein, 228 aa, Cajanus cajan
MKISLVRPLLTKRGFSSSSENLVASVLFERLPVVIPKIDPVVYAFQEFSFRWRQQYQRRYPDEFLDKSDARGKGDYQIDYVPAPRITEADKSNDRRSLQRALDRRLYLLLYGNAYGAPSGKPMWHFPEKVYESEDTMRKCAESALKSVLGDLSNTYFVGNAPMAHMVVQPTEDQSGSTSFKRFFFKSQVIAKNKFNIGKCEDFVWVTKDELMEYFPEQAEFLNKMFIS

SEQ ID NO: 9411 - protein, 228 aa, Glycine max
MKMSLVRPLLTKRGFSTSSENLVASVLFERLPVVIPKIDPVVYAFQEFSFRWRQQYQRRYPDEFLDKSDARGKGDYQIDYVPAPRVTEADKNNDRRSLQRALDRRLYLLLYGIAYGAPSGKPVWHFPEKVYESEDNMRKCAESALKSVLGDLSNTYFVGNAPMAHTVVQPTEDQSRSTSFKRFFFKSQVIAKNKFNIGKCEDHVWVTKDELMEYFPEQAEFLNKMIIS

SEQ ID NO: 9412 - protein, 230 aa, Glycine max
MKMSLVQLRPLLTRRGFSASSENLVASVLFERLPVVIPKIDPVVYAFQEFSFRWRQQYQRRYPDEFLDKSDARGKGDYQIDYVPAPRVTEADKNNDRRSLQRALDRRLYLLLYGNAYGAPSGKPVWHFPEKVYESEDTMRKCAESALKSVLGDLSNTYFVGNAPMAHMVVQPTEDQSRSTSFKRFFFKSQVIAKNKFNIGKCEDHVWVTKDELMEYFPEQAEFLNKMIIS

SEQ ID NO: 9413 - protein, 138 aa, Trigonella foenum-graecum
MKMSLVRPLLTSSEKMVASVLFERLPVVIPKIDPIVYAFQEFSFRWRQQYQRRYPDEFLDRSDARGKGDYQIEYVPAPRITEADKTMIEGHCKELSTEDSTFFSMVMLMGLQVGSLCGIFQRNFMNQRKPCVSALSLH

SEQ ID NO: 9414 - protein, 228 aa, Vigna unguiculata
MKMSLVRPLLTRRGFSTSSENLVASVLFERLPVVIPKIDPVVYAFQEFSFRWRQQYQRRYPDEFLDKSDARGKGDYQIDYVPAPRFTEADKNNDKRSLQRALDRRLYLLVYGNAHGAPSGKPVWHFPEKVYESEDTMRKCAESALESIIGDLSNTYFVGNAPMGHMVVQPTEDQSGSTSYKRFFFKSQVIAKNKFNIAKCEDFVWVTKDELMEYFPEQAEFFNKMIIS

SEQ ID NO: 9415 - protein, 228 aa, Cajanus cajan
MKMSFIRPLLTRRGFSTSSENLVASVLFERLPVVIPKIDPVVYAFQEFSFRWRQQYQRRYPDEFLDKSDARGKGDYQIDYVPAPRVTEADKNNDRRSLQRALDKRLYLLVYGNAYGTPSGKRVWHFPEKVYESEDTMRKCAESALKSVIGDLSNTYFVGNAPMGHMVVQPTEDQSGSTSYKKFFFKSQVIAKNKFNIGKCEDFVWVTKDELMEYFHEQAEFFNKMIIS

SEQ ID NO: 9416 - protein, 233 aa, Trifolium pratense
  misc_feature (80)..(80): Xaa can be any naturally occurring amino acid
  misc_feature (104)..(104): Xaa can be any naturally occurring amino acid
MKKMSLVRPLLTRRRRGFSTMTTSDKMVASVLFERLPVVIPKIDPIVYAFQEFSFRWRQQYQRRYPDEFLDRSDARGKGXYQIDYVPAPRITEADQNNDRRSLXRALDRRLYLLLYGDAYGAPSGKPVWHFPEKLYESEETMRKCAESALKSVIGDLSNTYFVGNAPMAHMVVQPNEDHSVSTSFKKFFFKSQVIAKNKFDFEKCKDFVWVTKDELMEYFPEQAEFFNKMIIS

SEQ ID NO: 9417 - protein, 228 aa, Arachis hypogaea
MRMSLIRPLLARRGFSTSSEKLVASVLFERLPVVIPKVDPVVYAFQEFSFRWRQQFQRRYPDEFLDKSNARGKGDYQIDYVPAPRITEADKTNDRKSLQRALDRRLYLLLFGNTYGAPSGKPVWHFPEKVYESEENMRKCAETALKSIIGDLSHTYFVGNAPMGHMVVQPTEDTSKSTPFKRFFFKSQVIAKNKFNIGKCEDFVWVTKDELLEYFPEQAEFLNKMILS

SEQ ID NO: 9418 - protein, 228 aa, Phaseolus coccineus
MKMSLVRPLLTRRGFSTSSENLVASVLFERLPVVIPKIDPVVYAFQEFSFRWQQQYQRRYPDEFIDKSETRGKGDYHIDYVPAARFTEADKNNDKRSLQRVLDRRLYLLVYGNAHGAPSGKPLWHFPEKVYESEDTMRKCAESALESIIGDLSNTYFVGNAPMGHMVVQPTEDQSGSASYKRFFFKSQVIAKNKFNIAKCEDFVWVTKDELMEYFPEQADFFNKMIIS

SEQ ID NO: 9419 - protein, 370 aa, Trigonella foenum-graecum
MAATTTPAALRFLPPNPTTRKTLHIFSILKPNVVSLRSFSHKYPFSLPPCKCSFTAPVSTTTYEFSDNASEMELRLNIGSMDIRSTKDISVDANDTSLAIRVLQSGSPITLIDTNPLFDRIKPSETIWYIDDDQLVVNFKKHDPELKWPDIMQSWESLAAGSSQLLKGTSIYLVGDSTEINQKVAEELSTGLGYTPLSTKELLETYSNQTVDSWLLAEGSDSVAEGEGTVLESISSHVRAVVATLGGKHGAAGRSDKWRHLYAGFTVWLSQTEASDEDSAREETHRNVKDRITAYTNADVVVKLQGWDPAYAKSVAQGCLSALKQLILSDKKLPGKKSLYIRLGCRGDWPNIKPPGWDPSSEGGKTLGTQ

SEQ ID NO: 9420 - protein, 382 aa, Trifolium pratense
EMVATTPAALHFLPPNTTTTKTIHFFSILKPNVISLRSFSHSSSSSSLFSLSHRYPFSLPPCKCSFTAPVSTTTYEFSDNASEMELKLNIGSMDIRSTKDILVDANDTSLTIKVLRSGSPITLIETNPLFDRIKPSETIWYIDDDQLIVNFKKHDPELKWPDIMQSWESLAAGSSQLLQGTSIYLVGDSTEINQKVAEELATGLGYTPLGTKELLETYSNQTVDSWLLAEGSDSVAEGEGAILESISSHVRTVVATLGGKHGAAGRSDKWRHLYAGFTVWLSQTEASDEDSAREETHRNVKDGVSAYTNADVVVKLQGWDPAYAKSVAQGCLSALKQLILSDKKLPGKKGLYIRLGCRGDWPNIQPPGWDPSREGGEIPGTQ

SEQ ID NO: 9421 - protein, 344 aa, Cajanus cajan
MAAAPACLCYLSQNPTISNLNLSLFKPNVLSLRSFFHSPFPSLSQKHYLRLRPCKCSSTAPLSTTTYEFSDGSSEVELRLNIGGLDIRSSRDILVDTNDTSLAIRVLRPGSPITLIETNPLFDRIKSSETIWYIDDDQLVVNFKKQDPDLKWPDIMESWESLTAGSSQLLQGTSIYLVGDSTEINQNVAQELATGLGYTPLSTKELLEAYTKQTVDSWLLAEGSDSVAEAESAVLESISSHARAVVATLGGKHGAAGRSDKWQHLYAGFTVWLSQTEALDEDSAREETHNNVKDGIISYTNSDVVVKLQGWDPAYTKNVAQACLSALKQLILSDKKLPGKKAST

SEQ ID NO: 9422 - protein, 231 aa, Trigonella foenum-graecum
MQEMAKAKAEEKKIGMTETWLRKHRPIYNAATRHPFILSIRDGTVQSHSFKTWLAQDYLFVRAFVPFVASVLMKACKESDDSDDVEVILGGMGSLKDELSWFKRESNKWGISLSDVLPQKPNTNYCRLLESLMSPEVDYTAALTAFWAIEMVYQESFAHCIEQGSKTPPELKETCERWGNEGFGQYCQSLQKLVNQRLQKASDDELKQAEVVLLSIIEHEVEFWNMSRGNV

SEQ ID NO: 9423 - protein, 225 aa, Lotus japonicus
MKVEEKKIGMIETWLRKHRIHYDAATRHPLILSIRDGTIHINSFKTWLAQDYLFVREFVPFVASVLIKASKESDDSADMEVILGGMASLGDEISWFKREANKWGIELSDVVPQQANINYSRLLESLMRSDVEYTVAMTAFWAIEAVYQESFAHCIGEGSKAPPELEETCARWGNEGFGQYCQSLQKIANQRLQKASDDELKKAEVVFLSVLEHEVEFWNMSRGNV

SEQ ID NO: 9424 - protein, 229 aa, Glycine max
MEEKAKAEQKKIGMTETWLKKHRLLYNGATRHPLIISIRDGTINTASFKTWLAQDYLFVRAFVPFVASVLIKAWKESDCSGDMEVILGGMASLEDEISWFKTEANKWGISLSDVVPQQANKNYCGLLESLMSPDAEYTVAITAFWAIETVYQESFAHCIEEGSKTPPELKETCVRWGNEAFGKYCQSLQNIANRCLQKASDEELKKAEVMLLSVLEHEVEFWNMSRGNV

SEQ ID NO: 9425 - protein, 793 aa, Glycine max
MTRKQKAESKAHEVEHSPKKAKVEKEDGQINGKSETGVAEEYDEFCKVTNEHLPLEQMREIMEANSLDSSGSDLEIARRCQDLLFYGALDKCSVCNGSLEFDGRRYVCRGFYSEWASCTFSTRNPPRKQEPIKLPDSVQDSLASDLLKKYQDPSHRPHRDLGLAEKPFTGMMISLMGRLTRTHHYWKTTIEKHGGKVANSIIGATCLVASPAERERGGTSKLAEAMERGIPVVREAWLIDSIEKQEPQPLESYDLVSDLSVDGKGIPWDKQDPGEEAIESLSAELKLYGKRGVYKDSKLQEQGGKIFERDGILYNCAFSVCDQGLGLNDYCVMQLIVVPENPLHLYFKKGRVGDDPNAEEQLEEWDNVDGALKEFARLFDEITGNEFEPWEREKKFQKKPLKFYPIDMDDGVEVRHGALGLRQLGIAATHCKLEPLVANFMKVLCSQEIYKYALMEMGYDSPDLPIGMVTNLHLKRCEDVLLEFIDKMKSLKETGPKAEAVWTDFSQRWFTLMHSTRPFNFRDYQEIAEHAAAALEGVRDITQASHLIGDMTGSTIDDPLSETYKKLGCSISALDKSSDDYEMIVKYLEKTYEPVKVGDIEYGVSVENIFAVQTGGCPSYEDIVKLPNKVLLWCGSRSSNLLRHLHKGFSPAICSLPVPGYMFGKAIICSDAAAEAARYGFTAVDRPEGFLVLAIASLGNEITELKSPPEDTSSLEEKKVGVKGLGKKKTDESEHFVWKDDIKVPCGKLVASDHQDSPLEYNEYAVYDKKQARISYLVGVKYEEKGAVIDTAE

SEQ ID NO: 9426 - protein, 103 aa, Lotus japonicus
MERVTKIVSERPVVIFSKSSCCMSHSIKTLFCDFGVNPAVYELDEIPRGRDIEQALVSRLGCSPSVPTVFIGGELVGGANEVMSLHLNRSLIPMLKKAGALWL

SEQ ID NO: 9427 - protein, 103 aa, Lotus japonicus
MERVTKMVSERPVVIFSKSSCCMSHSIKTLFCDFGVNPAVYELDEIPRGRDIEQALSRQLGCSPSVPTVFIGGELVGGANQVMSLHLNRSLIPMLKKAGALWL

SEQ ID NO: 9428 - protein, 102 aa, Cajanus cajan
MDRVTKMVSERAVVIFSKSSCCMSHTIKTLFCDFGVNPAVHELDEIPRGRDIEQALSRLGCSPSVPAVFIGGELVGGANEVMSLHLNRSLIPMLKKAGALWV

SEQ ID NO: 9429 - protein, 102 aa, Glycine max
MERVTKMVSERPVVIFSKSSCCMSHTIKTLLCDFGVNPAVHELDEIPRGRDIEQALSRLGCSPSVPAVFISGELVGGANEVMSLHLNRSLIPMLKKAGALWV

SEQ ID NO: 9430 - protein, 102 aa, Glycine max
MERVTKMVSERPVVIFSKSSCCMSHTIKTLFCDFGVNPAVHELDEIPRGRDIEQALSRLGCSPSVPAVFIAGDLIGGANEVMSLHLNRSLIPMLKKAGALWV

SEQ ID NO: 9431 - protein, 102 aa, Cleome spinosa
MERITKMVKERPVVIFSKSSCCMSHTIKTLLCDFGVNPAVQELDEVPRGREIEQALSRLGCSPSVPAVFIGGEFVGGANEVMSLHLNRSLIPMLKRAGALWL

SEQ ID NO: 9432 - protein, 102 aa, Phaseolus coccineus
MDRVTKMVSERPVVIFSKSSCCMSHSIKTLFCDFGVNPSVHELDEIPRGRDIEQALSRLGCSPSVPAVFIAGELVGGANEVMTLHLNRSLIPMLKKAGALWV

SEQ ID NO: 9433 - protein, 102 aa, Lotus japonicus
MERVTKMVSERPVVIFSKSSCCISHSIKTLLCDFGVNPAVYELDEISRGRDIEQALSRLGCNPSVPAVFIGGELVGGAKEVMSLHLNRSLIPMLKNAGALWV

SEQ ID NO: 9434 - protein, 102 aa, Arachis hypogaea
MDRVTKMASERAVVIFSKSSCCMCHTIKTLLCDFGVNPAVHELDEIPRGRDVEQALSRLGCNPSVPAVFIGGELVGGANEVMSLHLNRSLIPMLKRAGALWV

SEQ ID NO: 9435 - protein, 102 aa, Malus domestica
MEAVTKMASERPVVIFSKSSCCMSHSIKTLLCDFGVNPAVYELDEMQRGREIEQALSRLGCNPTVPAVFIGGELVGGANEVMSLHLKRSLIPMLKRVGALWV

SEQ ID NO: 9436 - protein, 102 aa, Eutrema parvulum
MEMITKMVLERPVVIYSKSSCCMSHTIKTLLCDFGANPAVYELDEVPRGREIEQALLRLGCSPAVPAVFIGGELVGGANEVMSLHLNGSLIPMLKRAGALWV

SEQ ID NO: 9437 - protein, 102 aa, Arachis hypogaea
MDRVTKLVSERPVVIFSRSTCCMCHTIKTLFCDFGVNPAVHELDEIQRGRDIEQALSRFGCNPSVPAVFIGGELVGGTNEVMSLHLNRSLIPMLKKAGALWV

SEQ ID NO: 9438 - protein, 102 aa, Arabidopsis thaliana
MDMITKMVMERPVVIYSKSSCCMSHTIKTLLCDFGANPAVYELDEISRGREIEQALLRLGCSPAVPGVFIGGELVGGANEVMSLHLNGSLIPMLKRAGALWV

SEQ ID NO: 9439 - protein, 102 aa, Gossypium hirsutum
MERVTKLASEKPVVIFSKSSCCMSHTIKTLFYDFGVNPAVHELDEISRGREIEQTLSRLGCNPSVPAVFIGGEFVGGANEVMSLHLNRSLIPMLRRVGALWV

SEQ ID NO: 9440 - protein, 81 aa, Tropaeolum majus
MDKVTKLVAERPVVIFSKSSCCMCHTIKTLFCDFGVNPAVHELDEIPRGREIEQALSRLGRSPTVPVVFIGGELVGGTMKL

SEQ ID NO: 9441 - protein, 102 aa, Fragaria vesca
MEAVTKMASERPVVIFSKSSCCMSHSIKTLLSDFGVNPAVYELDEMHRGREIEQALLRLGCSPSVPAVFIGGEFVGGANEVMSLHLKRSLIPMLKRVGALWV

SEQ ID NO: 9442 - protein, 102 aa, Fragaria vesca
MEAVTKMVSERPVVIFSKSSCCISHSIKTLLSDFGVNPAVYELDEMQRGREIEQALLRLGCSPSVPAVFIGGEFVGGANEVMSLHLKRSLIPMLKRVGALWV

SEQ ID NO: 9443 - protein, 102 aa, Fragaria vesca
MEAVTKMASERPVVIFSKSSCCMSHSIKTLLSDFGVNPAVYELDEMQRGREIEQALLRLGCSPSVPAVFIGGEFVGGANEVMSLHLKRSLIPMLKRVGALWV

SEQ ID NO: 9444 - protein, 80 aa, Gossypium hirsutum
MCHTIKTLFYEFGVNPAVYELDEIPRGRELEQALLRLGCSPSVPVVYIGGEFVGGANEVMSLHLNRSLIPMLRRAGALWV

SEQ ID NO: 9445 - protein, 102 aa, Cannabis sativa
MERVTKMASEKPVVIFSRSTCCMCHTIKTLFCDFGVNPTVYELDEIPRGREIEQALTMLGCSPTVPAVFIGGQLVGGANEVMSLHLKRSLIPMLKSVGALWV

SEQ ID NO: 9446 - protein, 102 aa, Brassica napus
MEMITKMVLERPVVIYSKSSCCMSHTVKTLLCDFGANPAVHELDEIPRGREIEQALLRLGCSPAVPANFIGGELVGGANEVMSLHLNGSLIPMLKQAGALWV

SEQ ID NO: 9447 - protein, 102 aa, Unknown
  Sequence found in Organisms: Citrus clementina, Citrus sinensis
MERVAKMASERPVVIFSKSSCCICHSIKTLFCDFGVNPAVYELDEMPGGRELEQDLQRLGCSPAVPAVFIGGELVGGANQVMSLHLNRSLIPMLKRVGAIWV

SEQ ID NO: 9448 - protein, 102 aa, Unknown
  Sequence found in Organisms: Thellungiella halophila, Eutrema halophilum
MEMITKMVLERPVVIYSKSACCMSHTIKTLLCDFGANPAVYELDEVSRGREIEQALLRLGCSPAVPAVFIGGELVGGANEVMSLHLNGSLIPMLKRAGALWV

SEQ ID NO: 9449 - protein, 102 aa, Unknown
  Sequence found in Organisms: Castanea mollissima, Quercus alba
MERVTTLASERPVVIFSKSSCCMCHSIKTLFNDFGVNPTVYELDEIQRGRDIEQALSRLGCSPSVPAVFIGGELVGGANEVMSLHLKRSLIPMLRRAGAIWV

SEQ ID NO: 9450 - protein, 102 aa, Carica papaya
MERLTKMVQEKPVVIFSKSSCCMCHTVKTLICDFGVNPAVHELDEIPRGREIEQALARLGCSPTVPAVFIGGELVGGASEVMSLHLSRSLIPLLKRAGALWV

SEQ ID NO: 9451 - protein, 102 aa, Raphanus sativus
MEMITKMVLERPVVIYSKSSCCMSHTVKTLLCDFGANPAVYELDEVSRGREIEQALLRLGCSPAVPAVFIGGELVGGANEVMSLHLNGSLIPMLKRAGALWV

SEQ ID NO: 9452 - protein, 102 aa, Glycine max
MDRVTQMASERPVVIFSRSSCCMCHTIKTLFSDFGVHPNVHELDEIPRGNDIEQALSRLGCSPSVPVVFIGGELVGGANEVMSLHLNRSLIPMLRRAGALWV

SEQ ID NO: 9453 - protein, 102 aa, Glycine max
MDRVTQMASERPVVIFSRSSCCMCHTIKTLFSDFGVHPNVHELDEIPRGKDIEQALSRLGCSPSVPAVFIGGELVGGANEVMSLHLNRSLIPMLRRAGALWV

SEQ ID NO: 9454 - protein, 102 aa, Brassica napus
MEMITKMVLERPVVIYSKSSCCMSHTVKTLLCDFGANPAVYELDEVSRGREIEQALLRLGCSPAVPAVFIGGELVGGANEVMSLHLNGSLIPMLKQAGALWV

SEQ ID NO: 9455 - protein, 102 aa, Lippia dulcis
MDRVSKMVAEKPVVIFSKSSCCMSHSVRSLFCDFGVNPMVYELDEIPRGREIEQALSRLGCNPTVPAVFIGGEFVGGANEVMSLHLSRSLKPMLKRAGALWL

SEQ ID NO: 9456 - protein, 102 aa, Malus domestica
MDAVTNMASERPVVIFSKSSCCMSHSIKTLLCDFGVNPAVYELDQMQRGREIEQALSRLGCNPTVPAVFIGGELVGGANEVMSLHLKRSLIPMLKRVGALWV

SEQ ID NO: 9457 - protein, 102 aa, Arabidopsis lyrata
MDMITKMVMERPVVIYSKSSCCMSHTIKTLLCDFGANPAVYELDELPRGRDIERALLRLGCSPAVPAVFIGGELVGGANEVMSLHLNGSLIPMLKRAGALWV

SEQ ID NO: 9458 - protein, 102 aa, Unknown
  Sequence found in Organisms: Brassica napus, Brassica rapa
MEMITKMVLERPVVIYSKSSCCMSHTVKTLLCDFGANPAVYELDEVSRGREIEQALLRLGCGPAVPAVFIGGELVGGANEVMSLHLNGSLIPMLKQAGALWV

SEQ ID NO: 9459 - protein, 102 aa, Cleome spinosa
MEVVTKFVSEKPVVIFSKSSCCMSHTIKTLFHDFGVNATVHELDEMARGREVEQALAILGCSPTVPAVFIGGQLVGGANQVMSLHLSRSLIPMLKKAGALWV

SEQ ID NO: 9460 - protein, 101 aa, Populus trichocarpa
MERVTNLASERPVVIFSKSSCCMCHTIKTLFNEFGVNVAVHELDEMPRGREIEQALSRFGCPTLPAVFIGGELVGGANEVMSLHLNRSLIPMLKRAGALWV

SEQ ID NO: 9461 - protein, 102 aa, Prunus persica
MEVVTKMASERPVVIFSKSSCCMCHSIKTLFSDFGVNPAVYELDEMQRGKEIEQALSRLGCNPTVPAVFIGGEFVGGANEVMNLHLQRSLIPMLKRAGALWV

SEQ ID NO: 9462 - protein, 102 aa, Raphanus sativus
MEMITKMVMERPVVIYSKSSCCMSHTVKTLLCDFGANPAVHELDEVPRGREIEQALLRLGCSPAVPAIFIGGELVGGANEVMSLHLNGSLIPMLKQAGALWV

SEQ ID NO: 9463 - protein, 102 aa, Fragaria vesca
MEAVTKMVSERPVVIFSKSSCCISYSIKTLLSDFGVNPAVYELDEMQRGREIEQALLRLGCSPSVPAVFIGGEFVGGANEIMSLHLKRSLIPMLKRVGALWI

SEQ ID NO: 9464 - protein, 102 aa, Eutrema parvulum
MEKVQKLISEKSVVIFSKNSCCMSHTIKTLFIDFGVNPTVYELDEINRGKEIEQALAQLGCSPTVPVVFIGGQLVGGANQVMSLHLNRSLIPMLKRVGALWL

SEQ ID NO: 9465 - protein, 102 aa, Brassica juncea
MEMITKMVLERPVVIYSKSLCCMSHTVKTLLCDFGANPAVYELDEVSRGREIEQALLRLGCGPAVPAVFIGGELVGGANEVMSLHLNGSLIPMLKQAGALWV

SEQ ID NO: 9466 - protein, 102 aa, Brassica napus
MEMVKRMVLERPVVIYSKSLCCMSHTVKTLLCDFGANPAVYELDEVSRGREIEQALLRLGCSPAVPAVFIGGELVGGANEVMSLHLNGSLIPMLKRAGALWV

SEQ ID NO: 9467 - protein, 102 aa, Citrus sinensis
  misc_feature (73)..(73): Xaa can be any naturally occurring amino acid
MEGVAKMASERPVVIFSKSSCCICHSIKTLFCDFGVNPAVYELDEMPGGRELEQDLQRLGCSPAVPAVFIGGXLVGGANQVMSLHLNRSLIPMLKRVGAIWV

SEQ ID NO: 9468 - protein, 101 aa, Populus trichocarpa
MERVTKLASERPVVIFSKTTCCMCHTIKTLFCDFGVNPAVHELDEMPRGREIEQALTRAGCPTLPAVFIGGEIVGGANEVMSLHLSRSLIPMLKHAGALWV

SEQ ID NO: 9469 - protein, 101 aa, Populus trichocarpa
MERVTNLASERPVVIFSKSTCCMCHTIKTLFNEFGVNVAVHELDEMPRGREIEQALSRFGCPTLPAVFIGGELVGGANEVMSLHLNRSLIPMLKRAGALWV

SEQ ID NO: 9470 - protein, 269 aa, Glycine max
MLRIAPKFFTTVPLRTISPFACRFSVRSIADSSPFNKIRIQRDDTAFDAYVVGKNDAPGIVVLQEWWGVDFEIKNHAVMISQLGRGFKALIPDLYRGKVGLDVAEAQHLFDGLDWQGAVKDINASVNWLKANGSKKAGVTGFCMGGALAIASSVLVPNVDATVAFYGVPSSELADPAQAKAPVQAHFGELDNFVGFSDVTAAKALEEKLKASGVPHEVHIYPGNGHAFMNRSPEGIKRRKNMGMPDEDEAAVQLAWSRFQSWMTHYLSS

SEQ ID NO: 9471 - protein, 243 aa, Trigonella foenum-graecum
MADSAAPFSKIQIQRDDNTTFDAYVIGKHDAPGIVVLQEWWGVDFEIKNHAAMISQLGRGFKALIPDLYRGKVGLDVAEAQHLFDGLDWPGAVKDIHASVDWLKANGSKKAGVTGFCMGGALAIASSVLVPHVDAVVAFYGVPSSELADPAQAKAPVQAHFGELDNFVGFSDVTAAKALEEKLKAARIPHEVHIYPGNRHAFMNRSPEGISRRKNMGLPDEDEASVQLAWSRFQLWMTQYLSS

SEQ ID NO: 9472 - protein, 269 aa, Cajanus cajan
MLRVAPKFFSSVPLRTISPFACRFSLRSIADSAPFNKIRIQRDDTAFDAYVVGKTDAPGIVVLQEWWGVDFEIKNHAVMISQLGRGFKALIPDLYRGKVGLDVAEAQHLFDGLDWQGAVKDIHASVNWLKANGSKKAGVTGFCMGGALAIASSVLVPDVDAVVAFYGVPSSELADPAKAKAPVQAHFGELDNFVGFSDVTATKALEEKLKVSGVPHEVHIYPGNAHAFMNRSPEGIQRRKSMGMPDEDEAAVQLAWSRFQSWMTHYLTA

SEQ ID NO: 9473 - protein, 242 aa, Trifolium pratense
MADSAPFNKIQIQRDDNTTFDAYVIGKEDAPGIVVLQEWWGVDFEIKNHAAMISQLGLGFKALIPDLYRGKVGLDVAEAQHLFEGLDWPGAVKDIHASVDWLKANGSKKAGVTGFCMGGALAIASSVLVPHVDAVVAFYGVPSSELADPAQAKAPVQAHFGELDNFVGFSDVTAAKALEEKLKASGVPHEVHIYPGNSHAFMNRSPEGINRRKTMGLPDEDEASVQLAWSRFQSWMTKYLSN

SEQ ID NO: 9474 - protein, 273 aa, Arachis hypogaea
MLGIVRASSSSRLFSTFRRVSPFSSRFSVRSMAHSAPPFNKITIQRDNTTFDAYVVGKEDAPGIVVLQEWWGVDFEIKNHAVKISQLGPGFKALIPDLYRGKVGLDVAEAQHLMDGLDWQGAVKDIEASVNWLKANGSNKVGVTGYCMGGALSIASSVLVPGVDAVVAFYGVPSSDLADPAKARAPIQAHFGELDNFVGFSDVTAAKALEEKLKASGVPHEVHIYPGNSHAFMNRSPEGIERRKSMGLPDQDEGAVQLAWSRFESWMTRYLSS

SEQ ID NO: 9475 - protein, 270 aa, Vigna unguiculata
MLSVAPKFFTTAPLRTVSPFACRFSVRSIADSVPFNKIRIQRDDDTAFDAYVVGKNNAPGIVVLQEWWGVDFEIKNHAVMISQLGRGFKALIPDLYRGKVGLDVAEAQHLMNGLDWQGAVKDIHASVNWLKANGSAKAGVTGFCMGGALAIASSVLVPNVDAAVAFYGVPSSELADPAQAKAPVQAHFGELDNFVGFSDVTAAKALEKKLKESGVAHEVHIYPNNGHAFMNRSPEGIKRRKNMGMSDEDEAAVQLAWSRFQSWMTHYLTV

SEQ ID NO: 9476 - protein, 281 aa, Castanea mollissima
MLAAIFTTSRLFPNFKPSLSTFSLVRTLSPSSASRFQVRSMASSSPFKKIQIQREDTAFDAYVVGKEDAPGIVVLQEWWGVDFEIKNHAEKISQLGPGFKALIPDLYRGKVGLDVAEAQHLMDGLDWQGAVKDICASVNWLKANGSKKVGVTGFCMGGALSIASSVLAPEVDAVVAFYGVPSSELADPAQAKAPVQAHFGELDNFVGFSDVTAAKALEEKLKASGVPYEVHIYPGNAHAFMNRSPEGLKRRKGMGLPDEDEASAELAWSRFQSWMTRYLSA

SEQ ID NO: 9477 - protein, 281 aa, Quercus alba
MLATIFTTSRLFPNFKPSLSTFSLVRTLSPSSASRFQVRSMASSSPFKKIQIQREDTAFDAYVVGKEDAPGIVVLQEWWGVDFEIKNHAEKISQLGPGFKALIPDLYRGKVGLDVAEAQHLMDGLDWQGAVKDIRASVNWLKANGSKKVGVTGFCMGGALSIASSVLAPEVDAVVAFYGVPSSELADPAQAKAPVQAHFGELDNFVGFSDVTAAKALEEKLKASGVPYEVHIYPGNAHAFMNRSPEGLKRRKGMGLPDEDEASAELAWSRFQSWMTRYLSA

SEQ ID NO: 9478 - protein, 283 aa, Theobroma cacao
MFAAALISSSPCRTFSRNCVPKPSSFTLSRVLPPFAARFSVRSMADSALKKVQIQRDNTAFDAYVVGKEDAPGIVVLQEWWGVDLEIKNHALKISQLDSGFKALIPDLYRGKVGLDVAEAQHLMDGLDWQGAVKDIRASVNWLKANGSKKVGVTGFCMGGALSIASSVLVPEVDAVVAFYGVPSPELADPALAKAPVQAHFGELDNIVGFSDVTAAKALEEKLKASEIPYEMHIYPGNAHAFMNRSPEGIERRKGMGMPDEDEAAVQLAWSRFQSWMTRFLSS

SEQ ID NO: 9479 - protein, 352 aa, Vigna unguiculata
MSSQTAAAEAPLLRNRHDAARAPALALLLGRAGRRGPSMLVRETAARELEERRADWGYSKPVVALDMSWNMAFVVVSAAMLACTISERPNSPIRVWIVGYALQCLVHVVLVWLEYRRRSRRDSRRGQGTQDVESQAGSDNEEGGNDSDSDVDGSSGNSSRSRFTKRCESINTGVSFLWWIVGFYWVVSGGDVLLQDAPRLYWLSVVFLAFDVFFAIFCVVLACLIGIALCCCLPCIIAILYAVAGQEGASEADLSILPKYRFRILSNEDKPSGGAGSMVPIETSSAYLANERLLLPEDAECCICLCSYEDGAELHALPCNHHFHSSCIVKWLKMNATCPLCKYNILKGNEQV

SEQ ID NO: 9480 - protein, 612 aa, Vigna unguiculata
MFVLGASSAAATTAATTTAATIPSRILCGTLHSPYPLTTPHNFSSHLLSKTLVRSSSLHFRGVPIKAMAETDTIAASKIASSSSVPGTKQALISLSDKKDLAFVGNGLQELGYTIVSTGGTASALEKAGVAVTKVEQLTQFPEMLDGRVKTLHPNIHGGILARRDLKHHIEALNTHGIGTFDVVVVNLYPFYDKVTAAGGIEFEDGIENIDIGGPAMIRAAAKNHKDVLVVVDTEDYPALLEFLKGNQDDEKFRLKLAWKAFQHVASYDSAVSEWLWKQSVGDKFPPSLTVPLSLKSSLRYGENPHQKAAFYVDKKLSEVNAGGIATAIQHHGKEMSYNNYLDADAAWNCVCEFKNPTCVVVKHTNPCGVASRDDILEAYRLAVKADPVSAFGGIVAFNVEIDEALAKEIREFRSPTDGETRMFYEIVVAPSYTEKGLEILRGKSKTLRILEAKKNEPGKLSLRQVGGGWLAQDSDDLTPQDIKFNVVSGKAPQDDELRDAEFAWLCVKHVKSNAIVIAKNNCMLGMGSGQPNRVESLRIAMRKAGDDVKGAALASDAFFPFAWKDAVEEACESGIGVIAEPGGSIRDQDAIDCCNKYGVSLLFTNVRHFRH

SEQ ID NO: 9481 - protein, 604 aa, Glycine max
MFVLGVSSSAAAAPAAATSSTHHLLSGTLHSPSSLSTSHLFPTTSVRSSSLHFRCVPIKAMAEVDTIAVSKTASSSAPGSKQALISLSDKKDLAFVGNGLQELGYTIVSTGGTASALESAGVAVTKVEKLTKFPEMLDGRVKTLHPNIHGGILARRDQKHHIDALSAHGIGTFDVVVVNLYPFYDKVTSAGGVEFEDGIENIDIGGPAMIRAAAKNHKDVLVVVDTEDYPALLEFLKRNQDDQKFRLKLAWKAFQHVASYDSAVSEWLWKQSVGDKFPPSLTVPLSLKSSLRYGENPHQKAAFYIDKSISEVNAGGIATAIQHHGKEMSYNNYLDADAAWNCVCEFRNPTCVVVKHTNPCGVASRDDILEAYRLAVKADPVSAFGGIVAFNVEIDEALAKEIREFRSPTDGETRMFYEIVVAPSYTEKGLEILCGKSKTLRILEAKKNEAGKLSLRQVGGGWLAQDSDDLTPHDIKFNVVSEKAPQDDELRDAEFAWLCVKHVKSNAIVIAKNNCMLGMGSGQPNRVESLRIAMRKAGDDVKGAALVSDAFFPFAWKDAVEEACESGIGVIAEPGGSIRDQDAIDCCNKYGVSLLFTNVRHFRH

SEQ ID NO: 9482 - protein, 594 aa, Arachis hypogaea
MFAPAATSPTTAAARLLRASLFSPSSHSRFLPPTSVRSSLCFNYLPIKAMADTTSVSHPITASASSSDSGRKQALKSLSDKKDLAFVGNGLQELGYTIVSTGGTASALESAGVAVTKVEQLTQFPEMLDGRVKTLHPNIHGGILARRDQKHHIEALNTHGIGTFDVVVVNLYPFYDKVTSTGVEFEDGIENIDIGGPAMIRAAAKNYRDVLVVVDSQDYPALLEFLKGNQDDQMFRLKLAWKAFAHVSAYDSAVSERLWKQSGGDKFPPSLTVPLSLKSSLRYGENPHQKAAFYVDKRLSEVNGGGIATAIQHHGKEMSYNNYLDADAAWNCVCEFRDPTCVVVKHTNPCGVASRNDILEAYRLAVKADPVSAFGGIVAFNVEVDEVLAKEIREFRSPTDGETRMFYEIVVAPGYTEEGLDVLRGKSKTLRILEAKKNEAGKLSLRQVGGGWLVQDSDDLTPHDIKFSVVSERTPVDDELRDAEFAWLCVKHVKSNAIVIAKNKCMLGMGSGQPNRLESLRIAMRKAGDDVKGAALASDAFFPFAWKDAVEEACESGVGVIAEPGGSIRDKDAIDCCNKYGVSLVFTQVRHFRH

SEQ ID NO: 9483 - protein, 604 aa, Gossypium hirsutum
MLGTAASAATIPPTTAHAANTIRRAFHSNPFNSLSSSHHSILCARFRCLSLRSFTAVSTKAMSHPQTLDAPHPQSSAAGNKQALISLSDKKDLALLGNGLQELGYTIVSTGGTASALENAGVSVTKVEQLTCFPEMLDGRVKTLHPNIHGGILARRDQKHHMEALNKYGIGTFDVVVVNLYPFYDKVTSMGGIAFDDGIENIDIGGPAMIRAAAKNHKDVLVVVDSQDYPALLEFLEGSQDDQQFRRKLAWKAFEHVASYDSAVSEWLWKQTVGDKFPPSLTVPLSLKSSLRYGENPHQKAAFYVDKSLSEVNAGGIATAIQHHGKEMSYNNYLDADAAWNCVSEFRNPTCVVVKHTNPCGVASRDDILEAYRLAVKADPVSAFGGIVAFNIEVDEALAKEIREFRSPTDGETRMFYEIVVAPKYTEKGLEILRGKSKTLRILEAKKNEKGKLSLRQVGGGWLAQDSDDLTPEDIQFNVVSEKKPQDNELCDAEFAWLCVKHVKSNAIVIAKDNRMLGMGSGQPNRLESLRIALRKAGDEVKGAALASDAFFPFAWKDAVEEACESGIGVIAEPGGSIRDGDAVDCCNKYGVSLLLTNVRHFKH

SEQ ID NO: 9484 - protein, 604 aa, Vitis vinifera
MLGLATTATATTATAAPTTAAKNRVLCSSGRLQRWFQRSSVACYRISSPSLRSNFCAVKAMAEADTISILKAQSQSNASGNKQALISLSDKKDLAFLGNGLQSLGYTIVSTGGTASALENAGVSVTKVEQLTCFPEMLDGRVKTLHPNIHGGILARRDQKLHMEALNEHGIGTFDVVVVNLYPFYDKVSSGGIEFEDGIENIDIGGPAMIRAAAKNHKDVLVVVDSQDYSALLEFLQGNQDDQLFRRKLAWKAFQHVASYDSAVSEWLWKQTVGDKFPPSLTVPLSLKSSLRYGENPHQKAAFYVDKSLSEVNAGGIATAIQHHGKEMSYNNYLDADAAWNCVSEFKNPTCVIVKHTNPCGVASRDDILEAYRLAVKADPVSAFGGIVAFNIEVDEALAKEIREFRSPTDGETRMFYEIVVAPKYSQKGLDILRGKSKTLRILEAGKNEKGKLSLRQVGGGWLAQDSDDLTPEDIPFKLVSEKAPPESELRDAEFAWLCVKHVKSNAIVIAKNNCMLGMGSGQPNRRESLRIAVRKAGDEVKGAALASDAFFPFAWKDAVEEACESGIGIIAEPGGSIRDGDAIDCCNKYGVSLLFTNVRHFRH

SEQ ID NO: 9485 - protein, 447 aa, Zea mays
MHAPPLVAFAGGACPASAASSLSPWLASLRPAIVAAPARLLWFRRGALRLEAKAAWRATGGGRGPRVPAKGAVLASYMGAEEVVGPLSLLDEEELILHIRKERDNGKLPADVAINLEELYYNYRNAVLQNGDPNAYEIMLSNMTALFDRVLLDVQNPFTFPPYHKAVREPFDYYMFGQNYIRPLVDFRNSYVGNISLFHDMEEKLHQGHNVVLMSNHQTEADPAIIALLLEKTNPWISENIVYVAGDRVVTDPLCKPFSMGRNLICVYSKKHMNDFPELIEMKRRSNTRSLKEMALLLRGGSQLIWIAPSGGRDRPNPSTGEWYPAHFDSSTVDNMRRLLEHAGVPGHIYPLSLLCYEVMPPPQQVEKEIGEQRVISFHGVGLSATEETKYGDITCHTKNADEGRELFTNTLYNSVVNQYNVLKSAIFRDRGAAVSNNAISLSQPWR

SEQ ID NO: 9486 - protein, 447 aa, Zea mays
MHAPPLVTFAGGACPTTASASPSPWLASPRDAIFAAPARPLRSRRGTLRLEAKAAWRAAGGGRGPRVPAKGAVLASYMGAEEVVGPSSLLDEEEFISHIRKELDNGKLPADVASNLEELYYNYRNAVLQNGDPNAYEVMLSNMMTLFDRVLLDVQNPFNFPPYHKALREPFDYYMFGQNYIRPLVDFRNSYVGNISLFHDIEENLHQGHNVVLMSNHQSEADPAIIALLLEKTNPWISENIVYVAGDRVVTDPLCKPFSMGRNLICVYSKKHMNDFPELIEMKRRSNTRSLKEMALLLRGGSQLIWIAPSGGRDRPNPSSGEWYPAPFDSSAVDNMRRLLEHAGVPGHIYPLSLLCYEVMPPPQQVEKEIGEQRVISFHGAGLSVTEEINYGDITAHTKNADEGRELFTNTLYNSVVNQYNVLKSAIFRDRGAAVSNNVISLSQPWR

SEQ ID NO: 9487 - protein, 449 aa, Setaria italica
MHAPPLVALAGGACPPAAASSSTPPWLASPRAAILLAAPARLLRSRRGALRLEAKAAWRAAGGGRGPRVPAKGAVLASYTGAEEVVGPSPLVDEEELSLHIRKEVEEGNLPADVASALEELYYNYKNAVLQNGDPNAHDIMLSNMTALFDRVLLDVQNPFTFPPYHKAIREPFDYYMFGQNYIRPLVDFRNSYVGNISIFHDMEEKLRQGHNVVLMSNHQTEADPAIIALLLEKTNPWISENIVYVAGDRVVTDPLCKPFSMGRNLICVYSKKHMDDYPELIEMKRRSNTRSLKEMALLLRGGSQLIWIAPSGGRDRPDHSTGEWYPAPFDSSSVDNMRRLLEHAGVPGHIYPLSLLCYEIMPPPQQVEKEIGEQRVISFHGVGLSVTEEIKYGDITAHTKNADEGRELFANTLYNSVVNQYNILKSAIFRDHVGAASNTAISLSQPWR

SEQ ID NO: 9488 - protein, 376 aa, Panicum virgatum
MGAEEVVGPSPLLDEEGLDDEVLILHIRKEVEEGNLPADVASSLEELYYNYKNAVLKTGDPNAYEIMLSNMMALFDRVMLDVQNPFTFPPYHKAIREPFDYYMFGQNYIRPLVDFRNSYVGNISLFHDMEEKLRQGHNVVLMSNHQTEADPAIIALLLEKSNPWISENIVYVAGDRVVTDPLCKPFSMGRNLICVYSKKHMNDYPDLLEKKRRLNTRSLKEMALLLRGGSQLIWIAPSGGRDRPDPSTGEWYPAPFNSSSVDNMRRLLEHAGVPGHIYPLSLLCYEVMPPPQQVEKEIGEQRVISFHGVGLSVTEEIKYGDITAHTKNADEGRELFTDTLYSSVVNQYNVLKSAIFRDRGAAAASNTAISLSQPWR

SEQ ID NO: 9489 - protein, 300 aa, Zea mays
MRAAQIDPSPAAPPKSRLKRLFERQLLRVSPAERLPSAPPGGGDKDELPEPSSLCLDGMVRSFLEDGGGGGGAERAAAAARCCNCFHAGDTSDDEDGPAAADAAAADIAETIKGLVHCASLRERNLLADVSTLVERHRASGARKRDLLRLLAGSLRAAGHDAAVCLSRWDRSPSHPAGDHAYLDVLLPAASERAGRERVLVDVDFRSAFEVARPTKAYRAVLQRLPPVFVGRDDRLRLLVAAAADAARASLKKRGLHLPPWRKPEYMRARWLSPYDREAPQPEASTGELAGDGEGGGPTA

SEQ ID NO: 9490 - protein, 309 aa, Setaria italica
MRAAQIDPSAAAPPRSRFKRLFERQVPRVSPAERLPAAPAGGEKDELSEPSSLCLDGMVRSFLEDGVGGGGGERGAAARCCNCFHAGDTSDDEDGPASADAAAADIAETIKGLVHCASLRERNLLADVSTQVERHRASGARKRDLLRLLAESLRAAGHDAAVCLSRWDKSSSHLAGEHAYLDVLLPAGSDRAERERVLVDVDFRSAFEVARPTKAYRAVLQRLPSVFVGREDRLRLLVAAAADAARASLKKRGLHLPPWRKPEYMRAKWLSPYDRETPPPPPPPLPQPQQPEASTGELAGDGEGGAPSA

SEQ ID NO: 9491 - protein, 307 aa, Oryza sativa
MRAAAAAAGQIDPSPGAPAKSRLKRLFERQLLRVSPAERLPSVAGVGEKDESSEPSSVCLDGMVRSFLEDGVGVERPAGAARCCNCFHGGEASDDDDDGPAAAEAAATSDAAETIKGLVHCASLRERNLLADVSTLVERHRAAGARKRDLLRLLADSLRAAGHDAAVCISRWDKSSSHPKGEHAYLDVLLPPASDRAERERILVDVDFRSEFEVARPTKAYRAVLQRLPSVFVGKEDRLRLLVAAAADAARASLKKRGLHLPPWRKPEYMRAKWLSPYERDVPSPQQPDASAGELAVDGEGGGAWTQ

SEQ ID NO: 9492 - protein, 309 aa, Leymus cinereus x Leymus triticoides
MRPAAAQIDPSPSPAALAKSRLKRLFERQVLRVSPAERLPPVSAGGDKEKDDLEPSSVCLDGMVRSFLEDGGGAVGERASAARYCNCFNGGDASDDEDGPAAAEASAISDAAETIKGLVHCASLRERNLLADVSTLVERHRAAGARKRDLLRLLAASLRAMGHDAALCLSRWDKSSSHPAGEHAYVDVLLPAGSERGDRERVLVDVDFRSQFEVARPTKAYRAVLQRLPSAFVGREDRLRLLVAAAADSSRASLKKRGLHLAPWRKPEYMRAKWLSPYEREAPSPAPDGSASASELADTGEGGEDGPKV

SEQ ID NO: 9493 - protein, 311 aa, Pseudoroegneria spicata
  misc_feature (77)..(77): Xaa can be any naturally occurring amino acid
  misc_feature (150)..(150): Xaa can be any naturally occurring amino acid
MRAAAAQIDPSPSPSPAALAKSRLKRLFERQVLRVSPAERLPPVSAGGDKEKDDLEPSSVCLDGMVRSFLEDGGGAXGERASAARCCNCFNGGDASDDEDGPAAAEASAISDAAETIKGLVHCASLRERNLLADVSTLVERHRAAGARKXDLLRLLATSLRAMGHDAALCLSRWDKSSSHPAGEHAYVDVLLPAGSERGDRERVLVDVDFRSQFEVARPTKAYRAVLQRLPSAFVGKEDRLRLLVAAAADSSRASLKKRGLHLPPWRKPEYMRAKWLSPYEREAPPPAPDAPASASELADIGEGGGDGAKA

SEQ ID NO: 9494 - protein, 739 aa, Malus domestica
MEHSRTNGKLVLLKFLHGFILLWMITCPESAALHSPTLLGNESDRLALLDFKKRITGDPLNVMSSWNHSTDICSWFGVSCHRSTKRVLTLNLEAQKLVGSLPPSIGNLTYITRLNLGKNMFHGEIPQEIGRLRSLQYLNLSSNSFSGKIPTNISHCAQLRMLNLEVNGITGSIPIQLISLLRLTHLRLSSNNLSGTIPGWIGNFSSLTRLHLGDNNLQGSIPTELAHITGLDSLIVSENNLSGMVPSRIYNISSIRYISVSVNQLHGELPPNLGTMLPNLVGFYCFMNKFRGNIPASFSNASRFQLLDLGMNWLTGTLPGESLGSLRSLVKLSVEGNQLGKRKVGDLNFLSFLANCTSLEHLGLGFNNFGGGIPGSIANLSTQLHYLSLGGNVIHGSLPNGIGNLINLTFLALEHNHLGGIVPDEIGKLKKLEQLYLDVNQFSGSIPSSLGNMTSLLNLYMESNGFEGSIPPSLGNCQNLLDLDLSNNNLTGTIPKMLMKLSTLSISLDLSDNYLTGPLPFEVGDLVHLMELNVLRNNLSGEIPSSLGSCASLEHLYLQGNKFQGTIPQSLKDLKALEKLDLSSNNLSGQIPEFIGKLGALKYLNLSYNDFEGELPKEGIFANSIAYDILYVLAEYGTGGQVSILGDVYSYGILLLEMFTRKRPTNDMFKGGLSIYQFVPMALPDHVMDVVDHSIILDLETDALFDSLCHLCSHLSYSSSPSSESSPAIFGTWRSIILT

SEQ ID NO: 9495 - protein, 110 aa, Unknown
  Sequence found in Organisms: Brassica napus, Zea mays, Pennisetum glaucum, Malus domestica, Coffea canephora, Eucalyptus grandis, Festuca arundinacea, Avena sativa
MAKHHPDLIMCRKQPGIAIGRLCEKCDGKCVVCDSYVRPCTLVRVCDECNYGSFQGRCVICGGVGISDAYYCKECTQQEKDRDGCPKIVNLGSAKTDLFYERKKYGFKKR

SEQ ID NO: 9496 - protein, 110 aa, Eucalyptus grandis
MAKHHPDLIMCRKQPGIAIGRLCEKYDGKCVICDSYVRPCTLVRVCDECNYGSFQGRCVICGGVGISDAYYCKECTQQEKDRDGCPKIVNLGSAKTDLFYERKKYGFKKR

SEQ ID NO: 9497 - protein, 110 aa, Unknown
  Sequence found in Organisms: Arabidopsis thaliana, Arabidopsis lyrata, Cleome gynandra, Euonymus alatus, Eutrema halophilum, Eutrema parvulum, Tripterygium wilfordii
MAKHHPDLIMCRKQPGIAIGRLCEKCDGKCVICDSYVRPCTLVRICDECNYGSFQGRCVICGGVGISDAYYCKECTQQEKDRDGCPKIVNLGSAKTDLFYERKKYGFKKR

SEQ ID NO: 9498 - protein, 110 aa, Flaveria ramosissima
MAKHHPDLIMCRKQPGIAIGRLCEKCDGKCVICDSYVRPCTLVRVCDECNYGSFQGRCVICGGVGISDAYYCKECTQQEKDRDGCPKIVNLGSAKTDLFYERQKYGFKKR

SEQ ID NO: 9499 - protein, 110 aa, Linum usitatissimum
MAKHHPDLIMCRKQPGIAIGRLCEKCDGKCVICDSYVRPCTLVRVCDECNYGSFQGRCVICGGVGIFDAYYCKECTQQEKDRDGCPKIVNLGSAKTDLFYERKKYGFKKR

SEQ ID NO: 9500 - protein, 110 aa, Fraxinus spp
MAKHHPDLIMCRKQPGIAIGRLCEKCDGKCVICDSYVRPCTLVRVCDECNYGSFQGRCVICGGVGISDAYYCKECTQQEKDTDGCPKIVNLGSAKTDLFYERKKYGFKKR

SEQ ID NO: 9501 - protein, 110 aa, Unknown
  Sequence found in Organisms: Adiantum capillus-veneris, Pteridium aquilinum
MAKHHPDLIMCRKQPGIAIGRLCEKCDGKCVICDSYVRPCTLVRVCDECNYGSFQGRCVICGGAGISDAYYCKECTQQEKDRDGCPKIVNLGSAKTDLFYERKKYGFKKR

SEQ ID NO: 9502 - protein, 110 aa, Unknown
  Sequence found in Organisms: Bruguiera gymnorhiza, Rhizophora mangle
MAKHHPDLIMCRKQPGIAIGRLCEKDDGKCVICDSYVRPCTLVRVCDECNYGSFQGRCVICGGVGISDAYYCKECTQQEKDRDGCPKIVNLGSAKTDLFYERKKYGFKKR

SEQ ID NO: 9503 - protein, 110 aa, Ricinus communis
MAKHHPDLIMCRKEPGIAIGRLCEKCDGKCVICDSYVRPCTLVRVCDECNYGSFQGRCVICGGVGISDAYYCKECTQQEKDRDGCPKIVNLGSAKTDLFYERKKYGFKKR

SEQ ID NO: 9504 - protein, 110 aa, Cichorium intybus
MAKHHPDLIMCRKQPGIAIGRLCEKCDGKCVICDSYVRPCTLVRVCDECNYGSFQGRCVICGGVGISDAYYCKECTQQEKDRDGCPKIVNLGSVKTDLFYERKKYGFKKR

SEQ ID NO: 9505 - protein, 110 aa, Cynara scolymus
  misc_feature (31)..(31): Xaa can be any naturally occurring amino acid
MAKHHPDLIMCRKQPGIAIGRLCEKCDGKCXICDSYVRPCTLVRVCDECNYGSFQGRCVICGGVGISDAYYCKECTQQEKDRDGCPKIVNLGSAKTDLFYERKKYGFKKR

SEQ ID NO: 9506 - protein, 110 aa, Setaria italica
MAKHHPDLIMCRKQPGIAIGRLCEKCDGKCVICDSYVRPCTLVRVCDECNYGSFQGRCVICGGVGISDAYYCKECTQQEKDRDGCPKIVNLGSAKTDLSYERKKYGFKKR

SEQ ID NO: 9507 - protein, 110 aa, Eragrostis curvula
  misc_feature (29)..(29): Xaa can be any naturally occurring amino acid
MAKHHPDLIMCRKQPGIAIGRLCEKCDGXCVICDSYVRPCTLVRVCDECNYGSFQGRCVICGGVGISDAYYCKECTQQEKDRDGCPKIVNLGSAKTDLFYERKKYGFKKR

SEQ ID NO: 9508 - protein, 110 aa, Medicago truncatula
MAKHHPDLIMCRKTPGIAIGRLCEKCDGKCVICDSYVRPCTLVRVCDECNYGSFQGRCVICGGVGISDAYYCKECTQQEKDRDGCPKIVNLGSAKTDLFYERKKYGFKKR

SEQ ID NO: 9509 - protein, 110 aa, Mimulus guttatus
MAKHHPDLIMCRKQPGIAIGRLCEKCDGKCVICDSYVRPCTLVRVCDECNYGSFQGRCVICGGPGISDAYYCKECTQQEKDRDGCPKIVNLGSAKTDLFYERKKYGFKKR

SEQ ID NO: 9510 - protein, 110 aa, Triphysaria pusilla
MAKHHPDLIMCRKQPGIAIGRLCEKCDGKCVICDSYVRPCTLVRVCDECNYGSFQGRCVICGGNGISDAYYCKECTQQEKDRDGCPKIVNLGSAKTDLFYERKKYGFKKR

SEQ ID NO: 9511 - protein, 110 aa, Triphysaria pusilla
MAKHHPDLIMCRKQPGIAIGHLCEKCDGKCVICDSYVRPCTLVRVCDECNYGSFQGRCVICGGVGISDAYYCKECTQQEKDRDGCPKIVNLGSAKTDLFYERKKYGFKKR

SEQ ID NO: 9512 - protein, 114 aa, Fraxinus spp
MAKHHPDLIMCRKQPGIAIGRLCEKCDGKCVICDSYVRPCTLVRVCDECNYGSFQGRCVICGGWGFLMPTTAKNVLSRKKTGTDAPKLSIWAVPKLIYSMNERNMDSRKDDAFQ

SEQ ID NO: 9513 - protein, 110 aa, Unknown
  Sequence found in Organisms: Brassica napus, Brassica oleracea, Brassica rapa, Raphanus sativus
MAKHHPDLIMCRKQPGIAIGRLCEKCDGKCVVCDSYVRPCTLVRICDECNYGSFQGRCVICGGVGISDAYYCKECTQQEKDRDGCPKIVNLGSAKTDLFYERKKYGFKKR

SEQ ID NO: 9514 - protein, 110 aa, Unknown
  Sequence found in Organisms: Cephalotaxus harringtonia, Ceratodon purpureus, Cryptomeria japonica, Gnetum gnemon, Marchantia polymorpha, Pinus taeda, Pseudotsuga menziesii and additional organisms as disclosed in Tables 53 and 54
MAKHHPDLIMCRKQPGIAIGRLCEKCDGKCVICDSYVRPCTLVRVCDECNYGSYQGRCVICGGLGISDAYYCKECTQQEKDRDGCPKIVNLGSAKTDLFYERKKYGFKKR

SEQ ID NO: 9515 - protein, 110 aa, Unknown
  Sequence found in Organisms: Euphorbia peplus, Euphorbia esula
MAKHHPDLIMCRKQPGIAIGRLCEKDDGKCVICDSYVRPCTLVRTCDECNYGSFQGRCVICGGVGISDAYYCKECTQQEKDRDGCPKIVNLGSAKTDLFYERKKYGFKKR

SEQ ID NO: 9516 - protein, 110 aa, Utricularia gibba
MAKHHPDLIMCRKQPGIAIGRLCEKDDGKCVICDSYVRPCTLVRVCDECNYGSFQGRCVICGGVGISDAYYCKECTQLEKDRDGCPKIVNLGSAKTDLFYERKKYGFKKR

SEQ ID NO: 9517 - protein, 110 aa, Musa acuminata
MAKHHPDLIMCRKQPGIAIGHLCEKCDGKCVICDSYVRPCTLVRVCDECNYGSFQSRCVICGGVGISDAYYCKECTQQEKDRDGCPKIVNLGSAKTDLFYERKKYGFKKR

SEQ ID NO: 9518 - protein, 110 aa, Unknown
  Sequence found in Organisms: Musa acuminata, Manihot esculenta, Ricinus communis, Jatropha curcas
MAKHHPDLIMCRKQPGIAIGRLCEKDDGKCVICDSYVRPCTLVRICDECNYGSFQGRCVICGGVGISDAYYCKECTQQEKDRDGCPKIVNLGSAKTDLFYERKKYGFKKR

SEQ ID NO: 9519 - protein, 110 aa, Guizotia abyssinica
MAKHHPDLIMCRKQPGIAIGRLCEKCDGKCVICDSYVRPCTLVRVCDECNYGSFQGRCVLCGGVGISDAYYCKECTQQEKDRDGCPKIVNLGSAKTDLFYERKKYGFKER

SEQ ID NO: 9520 - protein, 109 aa, Rhizophora mangle
MAKHHPDLIMCRKQPGIAIGRLCEKDDGKCVICDSYVRPCTLVRVCDECNYGSFQGRCVICGVGISDAYYCKECTQQEKDRDGCPKIVNLGSAKTDLFYERKKYGFKKR

SEQ ID NO: 9521 - protein, 110 aa, Pisum sativum
MAKHHPDLIMCRKQPGIAIERLCEKCDGKCVICDSYVRPCTLVRVCDECNYGSFQGRCVICGGAGISDAYYCKECTQQEKDRDGCPKIVNLGSAKTDLFYERKKYGFKKR

SEQ ID NO: 9522 - protein, 131 aa, Senecio madagascariensis
MAKHHPDLIMCRKQPGIAIGRLCEKCDGKCVICDSYVRPCTLVRVCEECNYGSFQGRCVICGGVGISDAYYCKECTQQEKDRDGCPKIVNLGSAKTDLFYERKNMGSRNDDNCIFLKMIVLEDETKYPGIR

SEQ ID NO: 9523 - protein, 110 aa, Euphorbia peplus
MAKHHPDLIMCRKQPGIAIGRLCEKDDGKCVICDSYVRPCTLVRICDECNYGSFQGRCVICGGVGISDAYYCKECTQQEKDRDGCPKIVNLGSAKTDLFYERKKYGFQKR

SEQ ID NO: 9524 - protein, 110 aa, Phalaenopsis aphrodite
MAKHHPDLIMCRKQPGIAIGRLCEKDDGKCVVCDSYVRPCTLVRICDECNYGSFQGRCVICGGVGISDAYYCKECTQQEKDRDGCPKIVNLGSAKTDLFYERKKYGFKKR

SEQ ID NO: 9525 - protein, 110 aa, Unknown
  Sequence found in Organisms: Lippia dulcis, Populus trichocarpa, Salvia sclarea
MAKHHPDLIMCRKQPGIAIGRLCEKDDGKCVICDSYVRPCTLVRICDECNYGSFQGRCVICGGVGISDAYYCKECTQLEKDRDGCPKIVNLGSAKTDLFYERKKYGFKKR

SEQ ID NO: 9526 - protein, 110 aa, Unknown
  Sequence found in Organisms: Brassica napus, Brassica rapa, Raphanus sativus
MAKHHPDLIMCRKQPGIAIGRLCEKCDGKCVVCDSYVRPCTLVRICDECNYGSFQGRCTICGGVGISDAYYCKECTQQEKDRDGCPKIVNLGSAKTDLFYERKKYGFKKR

SEQ ID NO: 9527 - protein, 110 aa, Ocimum basilicum
MAKHHPDLIMCRKQPGIAIGRLCEKDDGKCVICDSYVRPCTLVRTCDECNYGSFQGRCVICGGVGISDAYYCKECTQLEKDRDGCPKIVNLGSAKTDLFYERKKYGFKKR

SEQ ID NO: 9528 - protein, 110 aa, Liriodendron tulipifera
MAKHHPDLIMCRKQPGIAIGRLCEKCDGKCVVCDSYVRPCTLVRVCDECNYGSFQSRCVICGGLGISDAYYCKECTQQEKDRDGCPKIVNLGSAKTDLFYERKKYGFKKR

SEQ ID NO: 9529 - protein, 110 aa, Mimulus guttatus
MAKHHPDLIMCRKQPGIAIGRLCEKDDGKCVICDSYVRPCTLVRICDECNYGSFQGRCVICGGVGISDAYYCKECTQMEKDRDGCPKIVNLGSAKTDLFYERKKYGFKKR

SEQ ID NO: 9530 - protein, 110 aa, Physcomitrella patens
MAKHHPDLIMCRKQPGIAIGRLCEKCDGKCVICDSYVRPCTLVRTCDECNYGSYQGRCVICGGLGISDAYYCKECTQQEKDRDGCPKIVNLGSAKTDLFYERKKYGFKKR

SEQ ID NO: 9531 - protein, 88 aa, Cedrus atlantica
MAKHHPDLIMCRKQPGIAIGRLCEKCDGKCVICDSYVRPCTLVRVCDECNYGSYQGRCVICGGLGISDAYTARNAHSRRKIGMDVPKL

SEQ ID NO: 9532 - protein, 63 aa, Gossypium hirsutum
MAKHHPDLIMCRKQPGIAIGRLCEKCDGKCVICDSYVRPCTLLQVCDECNYGSFQGRCVICVV

SEQ ID NO: 9533 - protein, 161 aa, Cycas rumphii
MAKHHPDLIMCRKQPGIAIGRLCEKCDGKCVICDSYVRPCTLVRVCDECNYGSYQGRCVICGGLGISDAYYCKECTQQEKDRDGCPKIVNLGSAKQIYFTNGRNMGLKRDSGTLVVLTNKWGWEFTFLYVAHWGHCNVLYFRSVMLGFYLLAQRRWTRNFE

SEQ ID NO: 9534 - protein, 110 aa, Pinus pinaster
MAKHHPDLIMCRKQPGIAIGSLCEKCDGKCVICDSYVRPCTLVRVCDECNYGSSQGRCVICGGLGISDAYYCKECTQQEKDRDGCSKIVNLGSAKTDLFYERKKYGFKKR

SEQ ID NO: 9535 - protein, 110 aa, Beta vulgaris
  misc_feature (6)..(6): Xaa can be any naturally occurring amino acid
  misc_feature (12)..(12): Xaa can be any naturally occurring amino acid
  misc_feature (24)..(24): Xaa can be any naturally occurring amino acid
  misc_feature (30)..(30): Xaa can be any naturally occurring amino acid
MAKHHXDLIMCXKQPGIAIGRLCXKCDGKXVICDSYVRPCTLVRVCDECNYGSFQGRCVICGGVGISDAYYCKECTQQEKDRDGCPKIVNLGSAKTDLFYERKKYGFKKR

SEQ ID NO: 9536 - protein, 110 aa, Theobroma cacao
MAKHHPDLIMCRKQPGIAIGRLCEKCDGKCVICDSLVRPCTLVRVCDECNYGSFQGRCVVCGGLGISDAYYCKECTQLEKDRDGCPKIVNLGSAKTDLFYERKKYGFKKR

SEQ ID NO: 9537 - protein, 110 aa, Raphanus sativus
  misc_feature (43)..(43): Xaa can be any naturally occurring amino acid
MAKHHPDLIMCRKQPGIAIGRLCEKCDGKCVVCDSYVRPCTLXRICDECNYGSFQGRCTICGGVGISDAYYCKECTQQEKDRDGCPKIVNLGSAKTDLFYERKKYGFKKR

SEQ ID NO: 9538 - protein, 81 aa, Malus domestica
MAKHHPDLIMCRNQPGIAIGRLCEKCDGKCVICDSYVCPCTLVLVCDECNYGSFQGRCVICGGVGISDAYYCKECTQQEKD

SEQ ID NO: 9539 - protein, 684 aa, Ceratodon purpureus
MRGGLAGAWKPGTAKPAPLVVTIEDLNDDASFAIHASVQKQRHQLPVYKQRENLLFLVENHGTTVVVGETGSGKTTQIPQLLVEAGWAEGGRAIACTQPRQIAAQTIAARVAEEMRVTLGTQVGYSVRFDEVATRGVTKIKYMTDGVLLREMMTDPLLSIYSVIMVDEAHERSIATDILLGLLKKIIRRRPELRLIVASATMDTTAFRDFFNTSGEKLQTSSLGGSLPNRTPAVLFVEGRTHSVLVHYSDEPVKDYLQAAVSTAISIHKIEGPGDILVFLTGLDDVNAAVQMISEEAEKLPRALVALPLYAGLPASDQELVFRPSLSSRRKVVLATNIAETSVTIPGIVYVIDSGFSKQKFYNPITNVEALVAAPVSQASAEQRAGRAGRERPGKCFRLYTEETFATMRPQGVPEIQKSNLLSTVLQLKALGIDNVMQFDWLAPPPAECMVRALELLYALGIMDEYAKLTSPLGYQVSELPLDPMSAKMLLTAVEIGCQKEGLTIAAVMSVQTIWASGRERKEMDEARAQFGVAEGDMVSYLNVYEGYLRAKNQRQWCYENCVNYHAMAKVVKVRFQLSRLLLQLGGIKQQHDGDVKLVTKAITAGFFSNAARLEAEGGNTYRSLRGNQELFIHPSSVLFRASPKWVVFQSIIFLERHYIWNVTAIDPAWLSESAPHFYQLGRV

SEQ ID NO: 9540 - protein, 110 aa, Orobanche aegyptiaca
MAKHHPDLIMCRKQPGIAIGRLCEKDDGKCVVCDSYVRPCTLVRICDECNYGSFQSRCVICGGVGISDAYYCKECTQLEKDRDGCPKIVNLGSAKTDLFYERKKYGFKKR

SEQ ID NO: 9541 - protein, 110 aa, Populus trichocarpa
MAKHHPDLIMCRKQPGIAIGRVCEKDDGKCVICDSLVRPCTLVRICDECNYGSFQGRCVICGGVGISDAYYCKECTQLEKDRDGCPKIVNLGSAKTDLFYERKKYGFKKR

SEQ ID NO: 9542 - protein, 110 aa, Prunus persica
MAKHNPDLIMCRKQPGIAIGRLCEKCDGKCVICDSLVRPCTLVRVCDECNYGSFQGRCVVCGGVGISDAYYCKECTQLEKDRDGCPKIVNLGSAKTDLFYERKKYGFKNR

SEQ ID NO: 9543 - protein, 110 aa, Zamia vazquezii
  misc_feature (35)..(35): Xaa can be any naturally occurring amino acid
  misc_feature (67)..(67): Xaa can be any naturally occurring amino acid
  misc_feature (91)..(91): Xaa can be any naturally occurring amino acid
MAKHHPDLIMCRKQPGIAIGRLCEKCDGKCVICDXYVRPCTLVRVCDECNYGSYQGRCVICGGLGIXDAYYCKECTQQEKDRDGCPKIVNXGSAKTDLFYERKKYGFKKR

SEQ ID NO: 9544 - protein, 110 aa, Malus domestica
MAKHHPDLIMCRKQPGIAIGRLCEKCDGKCVICDSLVRPCTLVRVWDECNYGSFQGRCVVCGGLGISDAYYCKECTQLEKDRDGCPKIVNLGSAKTDLFYERKKYGFKRR

SEQ ID NO: 9545 - protein, 111 aa, Heritiera littoralis
MAKHHPDLIMCRKQPGIAIGRLCEKCDGKCVICDSYVRPCTLVRVCDECNYGSFQGRCVICGGVGISDAYYCKECTQQEKDRDGCPKIVNLGSAKTDLFYERKNMVLRKDD

SEQ ID NO: 9546 - protein, 105 aa, Platanus occidentalis
PDLIMCRKQPGIAIGRLCEKCDGKCVICDSLVRPCTLVRVCDECNYGSFQGRCVVCGGVGISDAYYCKECTQQEKDRDGCPKIVNLGSAKTDLFYERKKYGFKKR

SEQ ID NO: 9547 - protein, 110 aa, Volvox carteri
MAKHHPDLIMCMKQPGVAIGRLCEKCDGKCPICDSYVRPCTLVRVCDECNYGSYEGRCVICGGIGISDAYYCKECTLQEKDRDGCPKIINLGSAKTDLFYERKKYGFKKR

SEQ ID NO: 9548 - protein, 101 aa, Fagopyrum esculentum
MAKHHPDLIMCRKQPGIAIGRLCEKCDGKCVICDSYVRPCTLVRVCDECNYGSFQGRCVICGGVGISDAYYCKECTQQEKDRDGCPKIVNLGSAKTDLFYE

SEQ ID NO: 9549 - protein, 110 aa, Chlamydomonas reinhardtii
MAKHHPDLIMCMKQPGVAIGRLCEKDDGKCPICDSYVRPCTLVRVCDECNYGSYEGRCVICGGIGISDAYYCKECTLQEKDRDGCPKIINLGSAKTDLFYERKKYGFKKR

SEQ ID NO: 9550 - protein, 110 aa, Solanum tuberosum
MAKHHPDLIFCRKQPGVAIGRLCEKCDGKCVICDSYVRPCTLVRICDECNYGSYQGRCVICGGPGVSDAYYCKECTVQEKDRDGCPKIVNLGSSKTDLFYERKKYGFKRR

SEQ ID NO: 9551 - protein, 99 aa, Unknown
  Sequence found in Organisms: Ambrosia trifida, Ipomoea batatas
MAKHHPDLIMCRKQPGIAIGRLCEKCDGKCVICDSYVRPCTLVRVCDECNYGSFQGRCVICGGVGISDAYYCKECTQQEKDRDGCPKIVNLGSAKTDLF

SEQ ID NO: 9552 - protein, 122 aa, Silene vulgaris
VPILSERWRSIIPDLIFCRKQPGVAIGRLCDKCDGRCVICDSYVRPCTLVRICDECNYGSYQGRCVICGGVVVSDAYYCKECTIQEKDRDGCPKIVNLGSAKTDLFYETEKVQLQEKLTQVV

SEQ ID NO: 9553 - protein, 101 aa, Brassica juncea
MCRKQPGIAIGRLCEKCDGKCVVCDSYVRPCTLVRICDECNYGSFQGRCVICGGVGISDAYYCKECTQQEKDRDGCPKIVNLGSAKTDLFYERKKYGFKKR

SEQ ID NO: 9554 - protein, 106 aa, Distylium racemosum
MAKHHPDLIMCRKQPGIAIGRLCEKCDGKCVICDSYVRPCTLVRVCDECNYGSYQGRCVICGGLGISDAYYCKECTQQEKDRDGCPKIVNLGSAKTDLFMKERIWF

SEQ ID NO: 9555 - protein, 101 aa, Brassica juncea
MCRKQPGIAIGRLCEKCDGKCVVCDSYVRPCTLVRICDECNYGSFQGRCTICGGVGISDAYYCKECTQQEKDRDGCPKIVNLGSAKTDLFYERKKYGFKKR

SEQ ID NO: 9556 - protein, 154 aa, Arabidopsis lyrata
MAKHHPDLIMCRKQPGIAIGRLCEKCDGKCVICDSYVRPCTLVRICDECNYGSFQGRCVICGGVGISDAYYCKECTQQEKDRDGCPKIVNLGSAKTDLFYELVSSARLTFSFSENEKMMMVKGRSLMVSTNDYDGPSANARHNPPGRRGGGRRG

SEQ ID NO: 9557 - protein, 90 aa, Cirsium arvense
MNAIMDRIKDVASFVVVLVYPMLTTVRNVQFKRKIEMVAQRSLTLGAQKQIYSTRERSMDLKDGSPVSVSKIHSSKTSFNRPGFFWCYIF

SEQ ID NO: 9558 - protein, 99 aa, Brassica rapa
  misc_feature (1)..(1): Xaa can be any naturally occurring amino acid
XKQPGIAIGRLCEKCDGKCVVCDSYVRPCTLVRICDECNYGSFQGRCVICGGVGISDAYYCKECTQQEKDRDGCPKIVNLGSAKTDLFYERKKYGFKKR

SEQ ID NO: 9559 - protein, 77 aa, Brassica napus
MSYVRPCTLARICDECNYGSIQGRCVICGGVGISDAYYCIECTQQEIDRDGCPMIVNLGSAKTDLLYARKKFGFKKR

SEQ ID NO: 9560 - protein, 126 aa, Pennisetum glaucum
MAKHHPDLIMCRKQPGIAIGRLCEKCDGKCVICDSYVRPCTLVRVCDECNYGSFQGRCVICGGVGISDAYYCKECTQQEKDRDGCPKIVNLGSAKTDLFYERKKYGFKKWGRGGCRVLNWLRVLSH

SEQ ID NO: 9561 - protein, 115 aa, Fragaria vesca
LEIMAAKHHPDLIMCRKQPGIAIGRLCEKCDGKCVLCDSMVRPFTLVRICDECNYGSFQGRCVVCGGVGISDAYYCKECSQLEKDRDGCPKIVNLGTARTDLIYERKKYGFKKRS

SEQ ID NO: 9562 - protein, 98 aa, Pteridium aquilinum
SRPGIAIGRLCEKCDGKCVICDSYVRPCTLVRVCDECNYGSFQGRCVICGGASISDAYYCKECTQQEKDRDGCPKIVNLGSAKTDLFYERKKYGFKKR

SEQ ID NO: 9563 - protein, 121 aa, Plantago ovata
MAKHHPDLIMCRKQPGIAIGRLCEKCDGKCVICDSYVRPCTLVRVCDECNYGSFQGRCVICGGVGISDAYYCKECTQQEKDRDGCPKIVNLGSAKTDLFYERKNMVLRNDDLQAALLNFYI

SEQ ID NO: 9564 - protein, 99 aa, Podocarpus macrophillus
MAKHHPDLIMCRKQPGIAIGRLCEKCDGKCVICDSYVRPCTLVRVCDECNYGSYQGRCVICGGQGISDAYYCKECTQQEKDRDGCPKIVNLGSAKQIYL

SEQ ID NO: 9565 - protein, 93 aa, Amborella trichopoda
MAKHHPDLIMCRKQPGIAIGRLCEKCDGKCVICDSYVRPCTLVRVCDECNYWSFPGTMCSYCRRIGISKCILLPGMHPKGEGPRWVAQDWELG

SEQ ID NO: 9566 - protein, 112 aa, Ostreococcus lucimarinus
QSKHHPDLIMCRKMPGISIGRLCEKCDGKCVICDSHVRPATLVRVCDECNYGTNQGRCVICGAVGVSDAYYCKGCTLMEKDRDGCPKIINLGAARTDLFYERKKYGFKPRDG

SEQ ID NO: 9567 - protein, 83 aa, Nicotiana tabacum
  misc_feature (47)..(47): Xaa can be any naturally occurring amino acid
  misc_feature (60)..(60): Xaa can be any naturally occurring amino acid
  misc_feature (77)..(77): Xaa can be any naturally occurring amino acid
MNVTMNPFQGRCVICGGVGISDAYYCTQNVLSRRKIGMVVPKIVKSXVVPKNRIWFYERXTQYGFTEENERLEFYPXFLPVPG

SEQ ID NO: 9568 - protein, 90 aa, Artemisia annua
MAKHHPDLIMCRKQPGIAIGRLCEKCDGKCVICDSYVRPCTLVRVCDECNYGSFQGRCVICGGVGISDAYYCKECTQQEKDRDGCPKIVN

SEQ ID NO: 9569 - protein, 91 aa, Hevea brasiliensis
MAKHHPDLIMCRKQPGIAIGRLCEKDDGKCVICDSYVRPCTLVRICDECNYGSFQGRCVICGGVGISDAYYCKECTQQEKDRDGCPKIVNL

SEQ ID NO: 9570 - protein, 89 aa, Populus trichocarpa
LCEKCDGKCVICDSYVRPCTLVRVCDECNYGSFQGRCVICGGVGISDAYYCKECTQQEKDRDGCPKIVNLGSAKTDLFYERKKYGFKKR

SEQ ID NO: 9571 - protein, 125 aa, Flaveria ramosissima
MAKHHPDLIMCRKQPGIAIGRLCEKCDGKCVICDSYVRPCTLVRVCDECNYGSFQGRCVICGGVGISDAYYCKECTQQEKDRDGCPKIVNLGSAKTDLFTNAKNMVLRNDDKQLFVLIIVTPSMR

SEQ ID NO: 9572 - protein, 61 aa, Actinidia deliciosa
PGVETFLKVRISYICCSQVLPLDDYVRNVMENVLFVTLMCVRAHSCGFAMNATMDLFRVAV

SEQ ID NO: 9573 - protein, 802 aa, Zea mays
MSGGTGSSGRAAPRYAPDDPTLPKPWRGLVDGTTGYLYYWNPETNVTQYERPVPPESQLLPPPPPLPPPPPRSRDRRDRSRSRSRTPPRRDHRDRDRDRDRRHDEHASSKTASSHHHPAPVAVADDPSTEAYRRRHEITVTGDNVPTPITSFEAGGFPSEILKEIQRAGFASPTPIQAQSWPIAMQNQDVVAIAKTGSGKTLGYLLPGFMHIKRLQNSTRNGPTVLVLAPTRELATQILDEAVKFGRSSRISCTCLYGGAPKGPQLRDLDRGVDVVVATPGRLNDILEMRKVSLKQVSYLVLDEADRMLDMGFEPQIRKIVKEIPHRRQTLMYTATWPKEVRRIADDLLVHPVQVTIGSVDSLVANSSITQHVEIITPSEKQRRLEQILRSQDSGSKILIFCTTKRMCDQLARTLTRQFGASAIHGDKSQSEREKVLNQFRSGRSPILVATDVAARGLDIKDIRVVINYDFPTGVEDYVHRIGRTGRAGATGVAYTFFCDQDSKYAADLIKILEGANQRVPRDLEDMASRGGGRGRKRNHWASRPDRGGSRSELDSRYSSRDGLASSGKSESGRGSRGRDDNGSRGRYDPGETDGRSRRSTRGRSRSRSKSDSRSRSPSPKKSRRHEGRRSRTKSRSRSRSRRNHGASHSKSRSPVASRRYEKTASGSARPNSGHAEHKSPPRSHSRDDHVNHSDHKDDHKDDHMEDGKMERVDLDRSPSPHDDKSAPYSPVYNGKASGSMSPNGQPEAGAKFVEPSGKPEPASPVRCSKGRDDDEEGIIDEDGEIGEDDPRANAAVQNGNN

SEQ ID NO: 9574 - protein, 806 aa, Setaria italica
MSGSSGRAAPRYAPDDPSLPKPWRGLVDGTTGYLYYWNPETNVTQYEKPMPPEDQLPPPPPPLPPPPPRSRDRRDRSRSRSRTPPRRDHRDRDRDRDRDRRHDEHASSKSASSHHHPAPAAVADDPSTEAYRRRHEITVTGDNVPAPMTSFEAGGFPPEILKEIQRAGFASPTPIQAQSWPIAMQSQDVVAIAKTGSGKTLGYLLPGFMHIKRLQNSTRNGPTVLVLAPTRELATQILDEAVKFGRSARISCTCLYGGAPKGPQLRDLDRGVDVVVATPGRLNDILEMRRVSLKQVSYLVLDEADRMLDMGFEPQIRKIVKEIPHRRQTLMYTATWPKEVRRIADDLLVHPVQVTIGSVDELVANSAITQHVEVITPSEKLRRLEQILRSQDSGSKVLIFCTTKKMCDQLARTLTRQFGASAIHGDKSQSEREKVLNHFRSGRSPILVATDVAARGLDIKDIRVVINYDFPTGVEDYVHRIGRTGRAGATGVAYTFFCDQDSKYAADLIKILEGANQKVPRDLEDMASRGGGRGRKRNRWASRPDRGGSRSELDSRYSGRDASGRSPRGGRGRDDYGGRGRHDYGETDGRSRRSARGRSRSRSRSDSRSRSPSPKRARRHEATRSRTKSRSRSRTKSRSRSRSRSYTRNRRASRSRSRSPVGSRRYETAAAVSGSARPNSGHSEHKSPPRSQSGNDHHVNHSEDDHHMEDGKMEKVDLDRSPSPQDDKSAPYSPVYNGKASGSKSPNGQPDGNAKSVEASEKPNPASPVRHSKSREDEEEGVIDEDGEIAEDDPRSSAAATQNGDN

SEQ ID NO: 9575 - protein, 778 aa, Zea mays
MSGASGSTGRAAPRYAPDDLTLLKPWRGLVDGTTGYLYYWNPETNVTQYERPMPPENQLPPPPPPLPPPPPRSRDRRDRSRSRSRTPPRRDRRDRDRDDEHASSKTASSHHHPAPIAVADYPSTEAYRRRHEITVTGDNVPAPITSFEAGGFPSEILKEIQRAGFASPTPIQAQSWPIAMQNQDVVAIAKTGSGKTLGYLLPGFMHIKRLQNSTRNGPTVLVLAPTRELATQILDEAMKFGRSSRISCTCLYGGAPKGPQLRDLDRGVDVVVATPGRLNDILEMRRVSLKQVSYLVLDEADRMLDMGFEPQIRKIVKEIPHRRQTLMYTATWPKEVRRIADDLLVHPLQVTIGNVDELVANSAITQHIEVITPSEKQRRLEQILRSQVSGSKILIFCTTKRMCDQLARTLTRQFGASAIHGDKSQSEREKVLNHFRSGRSPILVATDVAARGLDIKDIRVVINYDFPTGVEDYVHRIGRTGRAGATGVAYTFFCDQDSKYAADLIKILEGANQQVPRDLEDMASRGGGRGKKRNRWASRSERGGPRSELDSRYSGRDGLASSGRSESGRGSHGRDDYGSRGRYDSGETDGRSRRSARGRSRSRSPSPKRSHHHEARRSRSRSRSRSCRNFRASRSKSHSPVASSRHEKAAVISGSTQPNLGYAEHKSPPRSHSGDDHVNHPDQKDDHMGDGKMERVDLDRSPSPQYDKSAPYSPAYNGKASDSMSPNVQPKADAKYVKPSGKPEPASPLRHSKGRDDDEGIIDDDGEIAEGEMMMKVS

SEQ ID NO: 9576 - protein, 792 aa, Oryza sativa
MSAGTAPAAPRYAPDDPSLPKPWRGLVDGTTGYLYYWNPETNITQYEKPLPPEDQLPPPPPLPPPPPRSGRGDRDRDRRDRSRSRTPPRRDHRDRDRDRDRRHDDHRSAPSHHHPLPAAAAIAADDPSTEAYRHRHEITVVGDNVPAPITSFETGGFPPEILKEIQRAGFSSPTPIQAQSWPIALQCQDVVAIAKTGSGKTLGYLLPGFMHIKRLQNNPRSGPTVLVLAPTRELATQILEEAVKFGRSSRISSTCLYGGAPKGPQLRDLDRGVDVVVATPGRLNDILEMRRISLKQVSYLVLDEADRMLDMGFEPQIRKIVKEIPPRRQTLMYTATWPKEVRRIAEDLLVHPVQVTIGSVDELVANSAITQNVELITPSEKLRRLEQILRSQDSGSKVLIFCTTKRMCDQLARTLTRQFGASAIHGDKSQSEREKVLSHFRSGRSPILVATDVAARGLDIKDIRVVINYDFPTGIEDYVHRIGRTGRAGATGVAYTFFCDQDSKYAADLIKILEGANQRVPRDLADMASRGGRGGRKRNRWATRSDRGGSHSELDSRYGGRDGLSGSSGRLDSSRSSRRHDYGDDGRSRRSGRGRSRSRSRSDSDRYSRSPKRSRRHSRSRTRSRSRSRSRSYTRNRRASRSRSRSPGASRRHERSATGSGSALPDSGHGERKRTPEADPSRNHTNHSDPKDDRHPEDGKVGKVDLDRSPTPQDKSGPYSPAYNGKTSRSVSPGNQVEGNNKAAEVSKNPDPSSPPHHGKTREDEEEGMIDEDGEIADDPRANATVQNGGDN

SEQ ID NO: 9577 - protein, 301 aa, Panicum virgatum
  misc_feature (176)..(176): Xaa can be any naturally occurring amino acid
MECLTTSFARNVGKEHNFVCSSKLASENQWVPRRICCYAPSLTNFSQRHKFTAIAYPMSPIIGRRSRWRSFAASLNLEDGPAPSDSTSSSSDQTADGDAPENLLSQKLSSDELKTLLADSERSKLLRRLSEANQYNRFLKRQLQLKDDAVIMFKSELAALELELQALVGLAEEIAXFDVPLRSRKINGKYIQSLLLSRLEAVHGKIMEQVKDVDSLKPQEISVYWVGMAENVQIMGSFDGWSQGETMSMEYSGDYGRFSATLKLRPGRYEIKFLVDGEWRLSPEYPMAGEGMMQNNILVVE

SEQ ID NO: 9578 - protein, 295 aa, Setaria italica
MECLTASFPRNVGKEHNFVCSSKLGSENQWVPRRICCYVPSSTNSSQQHKFTTTTYPMSPTIGRRSRWRSFAASLNLEDGPAPSDSTSSDGDASENPLSQKLSSDELKSLLADSERSKLLRRLSEANQYNRFLKRQLQLKDDAVVKFKSELAALELELQALVGLAEEIANFDVPLGSRKINGKYIQSHLLSRLEAVHGKVMDQIKDVDSLKPQEISVYWVGMAENVQIMGSFDGWSQGETMSREYSGDYGRFSATLKLRPGRYEIKFLVDGEWRLSPEYPMAGEGLTQNNIIVVE

SEQ ID NO: 9579 - protein, 272 aa, Saccharum officinarum
MECLTASFARNVGKEHSFVCSSKLVSENQWIPKRICCYASSLTNSSRCRKFTNMAYPMSPIIRKRSRWRSFAASLNLEDGPAPSDLTSSSSEQTADADGTTNGDASEDLLSQKLSSDELKALLADSERSKLLRRLSEANQYNRFLKRQLQIKDDAVVKFKGELAVLELELQALVGLAEEIANFDVPLGSRRINGKHIQSHLLSRLEAVHDKIMEQIKDVDSLKTQEISVYWVGMAENVQIMGSFDGWSQGEAMSMEYSGDYGRFSATLKLRP

SEQ ID NO: 9580 - protein, 581 aa, Zea mays
MGSACSRKRGQLVQEDDLYSARFSKSGSFKWLLHTLPRSNFADVQRRAQGPAPNRCPSLVELCVAKVCKDINMYSDLSLLPRDLSQQIFNELVECGCLTEASLGAFRDCDLQDICLGDYPGVTDAWMEVVASQGQSLLSVDLSCSDVTDSGFNLLKDCSSMQSLACDYCDQISEHGLKTLSGFSNLTSLSIKKCAAVTAEGAKAFANLVNLVNLDLERCPKINGGLIHLKGLKKLEKLNLRYCNGITDSDMKYLSDLTNLRELQLSSCKISAFGVSYLRGLHKLGHLNLEGCAVTAVCLEVISELASLVLLNLSRCGICDEGCENLKGLTKLKALSLGFNQITDACLIHLKDLVNLECLNLDSCKIGDEGLFHLKGLIQLKNLELSDTEVGSNGLRHLSGLRNLQSINLSFTLVTDIGLKKISGLSSLKSLNLDNRQITDTGLASLTGLTGLTHLDLFGARITDSGMSCFRFFKNIQSLEVCGGLITDAGVKNIKDLKALTLLNLSQNGKLTDKTLELISGLTALVSLNVSNSRVSNSGLHHLKPLQNLRSLSLESCRVTASEMDKLRLVALPNLISVRPE

SEQ ID NO: 9581 - protein, 581 aa, Panicum virgatum
MGSACSRKRGQLVHEDDLYGARFSKSGSFKWLLHTLPRSNSADVHRRAQEGTPGRCPSLVELCVAKVREDMSSYSDFSLLPRDLSQQIFNELVECGGLTEASLGAFRDCDLQDICLGEYPGVTDAWMEVVASQGQSLLSVDISCSDVTDSGLNLLKDCSSMQSLACDYCDQISEHGLKTLLGFSNLTSLSIKKCAAVTAEGAKAFANLVNLVNLDLERCPKIHGGLVHLKGLRKLEKLNLRYCNCITDSDMKYLSDLTNLRELQLSSCRISDFGVSYLRGLHKLAHLNLEGCAVTAACLEVISGLASLILLNLSRCGICDEGCENLEDLVKLKALNLGFNHITDACLIHLKDLINLECLNLDSCKIGDEGLFHLKGLVQLKNLELSDTEVGSNGLRHLSGLRNLQSINLSFTLITDIGLKKISGLSSLKNLNLDNRQITDTGLAALTSLTGLTHLDLFGARITDAGTNCFRFFKNLQSLEVCGGSITDAGVKNIKDLKALTLLNLSQNGNLTDKTLELISGLTALVSLNVSNSRVSNSGLHHLTPLQNLRSLSLESCRVTPAEIKKLRLAALPNLISVRPE

SEQ ID NO: 9582 - protein, 151 aa, Saccharum officinarum
MGSACSRKRGQLVQEDDLYSARFSKSGSFKWLLYTLPRSNSADVQRRTQGPAPGRCPSLVELCVAKVCKDINTYSDFSLLPRDLSQQIFNELVECGCLTEASLGAFHDCALQDICLGDYPGVTDAWMEVVASQGQSLLSVDLSCSDVKDSG

SEQ ID NO: 9583 - protein, 580 aa, Brachypodium distachyon
MGSACSRKRGQLVHEDELYSVRFSKSGSFKWLLHTLSRSSSDVLRKAQRPGPGHCPSLVELCVARVREDISRYSDFSMLPRDLSQQIFNELVEWSYLTEESLEAFRDCALQDICLEEYPGVKDAWMEVVASQGQSLLSVDISCSDVTDSGLDVLKDCSNMQSLACNYCDQISEHGLKTLSGLSNLTSLSLKKCAAVTAEGAKAFADLVNLVNLDLERCPKIHGGLVHLKGLRKLETLNMRYCNCITDSDMKYLSDLTNLRELQLSCCKISDIGVSYLKGLSKLAHLNLEGCAVTAACLEAISGLASLILLNLNRCGIYDEGCENLEGLVKLKVLNLGFNHITDACLVHLKELVSLECLNLDSCKIGDEGLLHLKGLLQLRSLELSDTEVGSNGLRHLSGLRNLQSMNLSFTLVTDIGLKKVAGLNSLKSLNLDNRQITDNGLAALAGLTGLTHLDLFGARITDSGTNCLRYFKELQSLELCGGLITDAGVKNIKDLKALTLLNLSQNGNLTDRTLELISGLTALVSLNLSNTRVSNAGLHHLKLLQNLRSLSLDSCKVTASEIKKIQLASLPNLISVRPE

SEQ ID NO: 9584 - protein, 581 aa, Oryza sativa
MGSACSRKRGQLLVDEEDLYSARFSKSSSFKWLLHTLPRSGSDVHRKVQGPVPVRCPSLMELCVAKVREDIGKYSDFSLLPRDLSQQVFNELVEWNILTEELLGAFRDCALQDICLADYPGVRDAWMEVAASQGQSLLSVDISCSDVTDGGLNQLKDCINLQSLSCNYCDQISEHGLKTLSGLSNVTSLSFKKCSAVTAEGAKAFANMVNLGSLDLERCPKIHGGLVHLKGLRKLEKLNLRYCNGITDSDMKHLSDLTNLRELQLSCCKISDLGVSYLRGLSKLAHLNLEGCAVTAACLEVISGLASLVLLNLSRCGVYDEGCEHLEGLVKLKVLNLGFNYITDACLVHLKELINLECLNLDSCKIGDEGLAHLKGLLKLRSLELSDTEVGSNGLRHLSGLRNLQSINLSFTLVTDIGLKKISGLNSLRSLNLDNRQITDNGLAALTCLTGLTHLDLFGARITDAGTNCLKYFKNLQSLEVCGGLITDAGVKNIKDLKALTLLNLSQNGNLTDKSLELISRLTALVSLNVSNSRVSNSGLHHLKPLQNLRSLSLESCKVTAIEIKKLQLAALPNLVSVRPE

SEQ ID NO: 9585 - protein, 522 aa, Setaria italica
MELCVAKVREDMNRYSDFSQLPRDLSQQIFNELVESGYLTEASLGAFHDCDLQDICLGEYPGVTDAWMEVVASQGQSLLSVDISCSDVTDSGLNLLKDCSSMQSLACDYCDRISEHGLKTLSGFSNLTSLSIKKCAAVTAEGAKAFANLVNLVNLDLERCPKIHGGLVHLKGLKKLEKLNMRYCNCITDSDMKYLSDLTNLRELQLSSCKISDFGVSYLRGLHKLAHLNLEGCAVTAACLEVISGLASLVLLNLSRCGICDEGCENLEGLVKLKALNLGFNHITDACLIHLKDLINLECLNLDSCKIGDEGLFHLKGLVQLKSLELSDTEVGSNGLRHLSGLRNLQSINLSFTLVTDIGLKKISGLSSLKSLNLDNRQITDTGLAALTSLTGLTHLDLFGARITDAGTNCFRFFKNLQSLEVCGGLITDAGVKNIKDLKALTLLNLSQNGNLTDKTLELISGLTALVSLNVSNSRVSNSGLHHLKPLQNLRSLSLESCRVTPTEIKKLRLAALPNLISVRPE

SEQ ID NO: 9586 - protein, 580 aa, Triticum aestivum
MGSACSRNRGQVVHEDQLYSVKFSKSGSFKWLLHTLSRSSSDVLRKAQGPGPGRRPSLVELCVARVREDISRYSDFSMLPRDLSQQIFNELVRCSYINEELLGAFRDCALQDICLDEYPGVKDAWMEVIASQGQSLLSVDISCSDVTDSGLNLLKDCSNMQSLACNYCDRISEHGLKTVSGLSNLTSLSLKKCAAVTAEGAKAFAKLVNLVNLDLERCPKIHGGLVHLKGLRKLETLNMRYCNGITDSDMKYLSDFTSLRELQLSCCKISDCGVSYLRGLSKLSHLNLEGCAVTAACLEAISGLASLVLLNLNRCGICDEGCEKLEGLVKLKVLNLGFNHITDACLVHLRELINLECLNLDSCKIGDEGLLHLKGLLQLRSLELSDTAVGSNGLRHLSGLRNLHSMNLSFTVITDIGLKKIAGMNSLRSLNLDNRQITDNGLAALTTLTGLTHLDLFGARITDAGTNCLRCFKGLRSLELCGGLITDAGVKNIKDLKDLTLLNLSQNGNLTDKTLEIISGLTALVSLNLSSSRVSNAGLHHLRPLQNLRSLSLDSCKVTACEIKKLQLAALPNLVSVRPE

SEQ ID NO: 9587 - protein, 580 aa, Hordeum vulgare
MGSACSRNRGQVVHEDQLYSVKFSKSGSFKWLMHTLSRSSSDVLRKAQGPTPGRRPTLVELCVARVREDISRYSDFSMLPRDLSQLIFNELVQCSYINEELLGAFRDCALQDICLDEYPGVKDAWMEVIASQGQSLLSVDISCSDVTDSGLNLLKDCSNMQSLACNYCDQISEHGLKTVSGLSNLTSLSLKKCAAVTADGAKAFANLVNLVNLDLERCPKIHGGLVHLKGLRKLETLNMRYCNGITDSDMKYLSDFTSLKELQLSCCKISDCGVSYLRGLSKLSHLNLEGCAVTAACLEAISGLASLVLLNLNRCAICDEGCEKLEGLVKLKVLNLGFNHITDACLVHLRELINLECLNLDSCKIGDEGLLHLKGLLQLRSLELSDTAVGSNGLRHLSGLRNLHSMNLSFTVITDIGLKKIAGLNSLKSLNLDNRQITDNGLAALTTLTGLTHLDLFGARITDAGTSCFRCFKGLQSLEACGGLITDAGVKNIKDLKALTLLNLSQNGNLTDKTLEIISGLTSLVSLNLSYSRVSNAGLHHLRPLQNLRSLSLDSCKVTACEVKKLQLAALPNLVSVRPE

SEQ ID NO: 9588 - protein, 197 aa, Saccharum officinarum
MESPPLTAEAIAFTEKKMDMTLEDIIKMSKKKNPGGKKPPRQPIKKHPFQNGNSNKGNGKVQRFMESRSTIRQGVLAQRRSNLGGSQFSATKQAAKKAAAMPMRNGAVRWNKPSASTLVQRRPVGDAFQNAKVKESQNQAAPRTMDALFAQMKAQRMRTVPQQQANPAPGRHFNQQRRVQQQQRRGRGYGGRNVGNQ

SEQ ID NO: 9589 - protein, 197 aa, Zea mays
MESPPLTAEAIAFTEKKMDMTLEDIIKMSKKKNPGGKNPPRQPIKKRPFQNANTNKGNGKVQRFMESRSTIRQGVLAQRRSNLGGSQFAATKQAAKKAAAMPMRSGAVYWKKPSASTLVQRRSVGDAFQNTKVKESQNHAAPRTMDALFARMKAQRMRTAPQQQANPASGRDFNQQRRVQQQQRRGRAYGGRVVGNQ

SEQ ID NO: 9590 - protein, 197 aa, Panicum virgatum
MESLPLTAEAIAFTEKKMDMTLEDIIKMSKKKNPGGKKPPRQPIKKRPFQNGNSIQGNTKVQRFMESRSTIRQGVLAQRRSNLGGNQFPVTKQAAKKAAAMPMRNKAGRWNKPSTSTLVQRRPVSDAFQNGKAKETQNQAAPRTMDALFAQMKAQRMRTVPQQQANPATGHQFSQQRRVQQQQRRGRGYGGRNVGNQ

SEQ ID NO: 9591 - protein, 196 aa, Zea mays
MESPPLTAEAIAYTEKKMDMALEDIIKMSKKKNPGGKKPPRQPIKKHPFQNGNSNKGNGKVQSFMESRSTIRQGVLAQRRSNLGGNQFPATKQAAKKAAVMPMHKGAIRWNKPSASTLVQRRPVGGAFQNAKVKESNQAAPRTMDALFAQMKAQRLRTVPQQQANSSPWSHFNQHRRVQQQQRRGRGYGGRNVGNQ

SEQ ID NO: 9592 - protein, 197 aa, Setaria italica
MESLPLTAEAIAFTEKKMDMTLEDIIKMSKKKNPGGKKPPRQPIKKHPFQSGNSNQGNAKVQRFMESRSAIRQGFLAQRRSNLGGNQFPVTKQAAKKAAAMPMRNKAVRWNKPSASTLVQRQPVGDAFQNGKAKETQNQGAPRTMDALFAQMKAQRMRTVPQQQANPAPGCQFNQQRRVQQQQRRGRGYGGRNVGNQ

SEQ ID NO: 9593 - protein, 200 aa, Panicum virgatum
MESLPLTAEAIAFTEKKMDMTLEDIIKMSKKKNAGGKKPPRQPIKKRPFQNGNSTQGNAKVQRFMESRSTIRQGVLAQRRSNLGGNQFPVTKQAAKKAAAMPMRNKAGRWNKPSTSTLVQRRPVGDAFQNGKAKEMQNQAAPRTMDALFAQMKAQRMRTVPQQQANPAPGHQFNPQRRVQQQQQQQKRGRGYGGLNVGNQ

SEQ ID NO: 9594 - protein, 197 aa, Pennisetum glaucum
MESLPLTAEAIASTEKKMDMTLEDIIKMSKKKNPGGKKPPRQPIKKRPFQNGDSNQGNAKVQRFMESRSAIRQGALAQRRSNLGGNQFPVTKQAAKKAAAMPMRDKAIRWNKPSVNTLVQRRPVGDAFQNGKAKETQNQGAPRTMDALFAQMKAQRMRTVLQQQENPAPGRQFNQQRRVQQQQRRGRGYGGRNVGNQ

SEQ ID NO: 9595 - protein, 191 aa, Setaria italica
TAEAIAFTEKKMDMTLEDIIKMSKKKNPGGKKPPRQPIKKHPFQSGNSNQGNAKVQRFMESRSAIRQGFLAQRRSNLGGNQFPVTKQAAKKAAAMPMRNKAVRWNKPSASTLVQRRPVGDAFQNGKAKETQNQGAPRTMDALFAQMKAQRMRTVPQQQANPAPGCQFNQQRRVQQQQRRGRGYGGRNVGNQ

SEQ ID NO: 9596 - protein, 224 aa, Zea mays
MGLEMVEVMSETVPTVVPAAARENGVDIYPLSRYYFGARDAAGVPRGLETAADRALRLKANFAAHGLRTSVHGVLLVELFDHPHVLLLQVRNSSFLLPGGRLRPGEEEVRGLKRKLSSKLSVVDDVEAVEEEDWQIGQCIGMWWRSEFEAIPFPYMPPRFRAAKECMKLFLIRLPMSRQFIVPRNMKLLAVPLSQIHGNAQVYGPIIAAIPSLLSKFSFNVISD

SEQ ID NO: 9597 - protein, 223 aa, Setaria italica
MGLEMEAAAAPAPAAAGEQGLEIYPLSRYYFGAKDAAGAPRGVETAADRALRLKANFAAHGLRTSVHGVLLVELFGHPHVLLLQVRNSSFVLPGGRLRPGEEELQGLKRKLSSKLSILDESEGDAEDEDEDDWQVGECIGMWWRSEFEAIPFPYMPPNFRMPKECIKLFLIRLPMSRQFIVPRNMKLLAVPLSQIHNNAQVYGPVISGIPNLLSKFALNVISD

SEQ ID NO: 9598 - protein, 544 aa, Saccharum officinarum
SWLRAERRSRRRLAVANCYAASPQDAVDRFPAVRAVEVKGKPHFADFGLVPPAWGAAAAPWVAAAADGWPLLEEISFKRMVVTDDCLEMIAASFRNFQVLRLVSCEGFSTAGLAAIAAGCRNLRELDLQENEIEDCSIHWLSLFPESFTSLVTLNFSCLEGDVNITVLEQLVTRCRNLKTLKLNNAIPLDKLANLLRKAPQIVELGTGRFSADYHPDLFSKLEAAFAGCKSLRRLSGAWDAVPEYLPAFYCVCEGLTSLNLSYATVRGPELIKFISRCKNLQLLWVMDLIEDHGLAVVASSCNKLQELRVFPSAPFDAVEQVSLTERGLVDVSASCPMLESVLYFCRRMTNEALITIAKNRPNFTCFRLCIIDPHTPDYTTHQPLDAGFSAIVESCKGLRRLSVSGLLTDSVFKSIGAHADRLEMLSIAFAGNSDLGLHYILSGCKSLKKLEIRDCPFGDKPLLANAAKLETMRSLWMSTCSLTLGACRQLARKMPRLSVEVMNDPRRGCPLDSLTDESPVETLYVYRTIAGPRSDTPACVQIV

SEQ ID NO: 9599 - protein, 116 aa, Glycine max
MTFEEKTIYQTSLASIPNYTLLECVLGLCFKVITILLQLPYEYIDNNPIPTIVFKGRPRTFHAFITCIIFAFSGATNALVAFNKSRFSRLCGYYAMASMASALAILLWAVCCTGIN

SEQ ID NO: 9600 - protein, 135 aa, Cajanus cajan
AIHYGLIDLFKLVALLLTAMTFEEKTIYETSLASIPHFTVLECVLGLCFTVITILLQLPYEYIDNNPVPTVIFKGHPRIFHAFIICIIFAFSGSTNALVAFNKSTFSKFCGYYAMASMASAMAILLWAVYCTCIT

SEQ ID NO: 9601 - protein, 143 aa, Glycine max
MPWARLSGSPRLDVAIDMGNPFLNLTVDGFLKIGAVAATRSAAEDTYHIIQKGNISSHDFEKTLKKMCKEGVYWGTIAGVYVGMEYGVERIRGTRDWKNAMIGGAVTGALVSAASNNKKDKIAIDAITGAAIATAAEFINYLT

SEQ ID NO: 9602 - protein, 143 aa, Glycine max
MPWVRLSESPRLDVAIDMGNPFLNLTVDGFLKIGAVAATRSAAEDTYHIIQKGNISSRDFEKTLKKMCKEGVYWGTIAGVYVGMEYGVERIRGTRDWKNAMIGGAVTGALVSAASNNKKDKIAIDAITGAAIATAAEFINYLT

SEQ ID NO: 9603 - protein, 143 aa, Cajanus cajan
MPWARLSGSPRVDVAIDMGNPFLNLTVDGFLKIGTVAATRAAAEDTYHIIQKRNISSHDFEKTLKKMCKEGVYWGTVAGVYVGMEYGVERIRGTRDWKNAMIGGALTGALVSAVSNNKKDKVAIDAITGAAIATAAEFINYLT

SEQ ID NO: 9604 - protein, 146 aa, Pisum sativum
MPRSSFSGSLSSPKLDVVIDMGNPFLNLTVDGFLKIGAVAATRSVAEDTFHIIRKGSISSNDFEKSLKKMCKEGAYWGAIAGVYVGMEYGVERIRGTRDWKNAMFGGAVTGALVSAASNNKKDKIAVDAITGAAIATAAEFINYLT

SEQ ID NO: 9605 - protein, 824 aa, Glycine max
MSGPVATVDNLDGALSCAERTKSLDAISEIDHLSIFTNGEAGHSSEVAGFRVGELSLPNGESYSGSLLGNIPEGQGKYVWPDGCVYEGEWRRGMRNGYGKIQWPSGVMYDGEFSGGYIHGTGTYIGPDNLTYKGRWRLNVKHGLGYQVYPNGDIFEGSWIQGTPEGPGKYTWANGNVYLGNMKGGRMSGKGTLTWVSGDSFEGSWLNGMMHGLGAYTWSDGGCYVGTWTRGLKDGKGTFYPRGSCLPSAQEIYLNALRKRGLLPDLRKQKQIHIHHAASVDMGDVKVGESQRSNRVSSDKLAKGNLLNLEQSRSKNISLERRWSLEVSIEKVIGHDSRLGSTDSVAENGDKVPILEREYMQGVLISELVLNNSFSSMSRRAKQLQKKLAKEIKRPGEAIIKGHRSYDLMLSLQLGIRYTVGKITPIQRREVRASDFGPRASFWMNFPKEGSQLTPPHQSEGFKWKDYCPMVFRNLRELFKIDAADYMMSICGNDALRELSSPGKSGSVFFLSQDDRFMIKTLRRSEVKVLLRMLPDYHHHVKTYDNTLITKFFGLHRIIPSSGQKFRFVVMGNMFCTELRIHRRYDLKGSSLGRSSDKIEIDENTTLKDLDLNYCFYLEPSWQESLLKQIEIDSKFLELQQIMDYSLLLGVHYRAPQQLHPYNQNRTADGLPILAEEDPLEDEGSNYPQGLVLVPRGTDDDSVVVGSHIRGSRLRASAAGDEEVDLLLPGTARLQIQLGVNMPARAEQIPGKEEMQMFHEAYDVVLYLGIIDILQEYNMTKKIEHAYKSIQFDSLSISAVDPTFYSRRFLDFIQKVFPPHEMAG

SEQ ID NO: 9606 - protein, 822 aa, Glycine max
MSGPVATVDNLDGALSCAERTKSLDAISEIDCLSIFTIGEAAHSSEVAGFRVGELSLPNGESYSGSFLGNIPEGQGKYVWSDGCVYEGEWRRGMRNGYGKIQWPSGVMYEGEFSGGYIHGTGAYIGPDSLTYKGRWRLNLKHGLGYQVYPNGDIFEGSWIQGAPEGPGKYTWANGNVYLGNMKGGRMSGKGTLTWISGDSFEGSWLNGMMHGLGVYTWSDGGCYVGTWTRGLKDGKGTFYPRGSCLPSAQEIYLNALRKRGLLPDLRKQKQVHIHHAASVDMGDVKVGESQRSNRVSSDKLAKGNLLNLEQSRSKNISLERRWSLEVSIEKLIGHDSKLGSTDSVAENGDKVPILEREYMQGVLISELVLNNSFSSMSRRAKQLQKKIAKEIKRPGEAIIKGHRSYDLMLSLQLGIRYTVGKITPIQRREVRASDFGPRASFWMNFPKEGSQLTPPHQSEGFKWKDYCPMVFRNLRELFKIDAADYMMSICGNDALRELSSPGKSGSVFFLSQDDRFMIKTLRRSEVKVLLRMLPDYHHHVKTYDNTLITKFFGLHRIIPSSGQKFRFVVMGNMFCTELRIHRRYDLKGSSLGRSSDKIEIDENTTLKDLDLNYCFYLEPSWRESLLKQIEIDSKFLELQQIMDYSLLLGVHYRAPQQLHPYNQSRNADGLAILAEEDPLEDEGSNYPQGLVLVPRGGDDDSVVVGSHIRGSRLRAAGDEEVDLLLPGTARLQIQLGVNMPARAEQIPGKEEVQMFHEAYDVVLYLGIIDILQEYNMTKKIEHAYKSIQFDSLSISAVDPTFYSRRFLDFIQKMFPPHEMAR

SEQ ID NO: 9607 - protein, 346 aa, Cajanus cajan
MAAIESARVKLGTQGFEVSKLGFGCLGLTGAYNDPLPEQDAVSIINYAFTKGITFFDTSDVYGATANEVLLGKALKQLPREQVQLATKFGIARLDFSNMHIKGSPEYVRSCCEASLKRLGVEYIDLYYQHRVDTSIPIEETVGELKKLVEEGKVRYIGLSEASPDTISRAHAVHPITAVQIEWSLWTRDIEEEVVPLCRELGIGIVPYSPLGRGFFGGKGVVENVPATSSLKVHPRFQAENMNKNKNIYDRIETLAKKHKATPAQLALAWVLQQGEDVVPIPGTTKIKNLDQNLGALAVKLSERDLREVSEAVPIDDVAGGIHYFGLEHFTWKFANTPQKDSRVST

SEQ ID NO: 9608 - protein, 343 aa, Cajanus cajan
MAQQRTQLGTHGFEVSKLGFGCMGLSGAYNDPLPEEDAISIINYAFSKGITFFDTADVYGDTANEVLLGKALKQLPREKIQLATKFGIARISFTDMRINGSPEYVRSCCEASLKRLDVDYIDLYYQHRVDTSVPIEETVGELKKLVEEGKVRYIGLSEASPDTIRRAHAVHPITAVQMEWSLWTHDIEEGIVPLCRELGIGIVPYSPLGRGFFGGRGVVDNVPASSPLKGHPRFQAENLDKNKSIYDRIESLAQKHQATPAQLALAWVLHQGEDVVPIPGTTKIKNLDQNLGALAVKLSERDLREISEAVPIDDVAGGRYYNGLEHISWKFANTPPKDSRISI

SEQ ID NO: 9609 - protein, 346 aa, Phaseolus coccineus
MEEVQHIQRVKLGTQGFEVSKLGFGCMGLTGAYNDPLPEEDGISIINYAFSKGITFFDTADVYGANANELLVGKALKQLPREKIQIATKFGIMGRDSNVQIKGSPEYVRSCCEASLKRLDVEYIDLYYQHRVDQSIPIEETVGELKRLVEEGKVKYIGLSEASPDTIRRAHAVHPITAVQIEWSLWTRDVEEEIIPLCRELGIGIVPYSPLGRGFFGGKGVLENVPAISNLKRHPRFQAENLEKNKNIYERIEILAKKHQATPAQLALAWVLQQGEDVIPIPGTTKIKNLDQNLGALAVKLSEQDLREISEAVPTGDVAGTRFYNGMDQLSWKFANTPSKDSRVST

SEQ ID NO: 9610 - protein, 240 aa, Glycine max
MDRYQRVEKPKAETPINENEIRVTTQGRMRNYITYATTLLQEKGSSEIVLKAMGRAINKTVMIAELIKRRIVGLHQNTQIGSTDITDTWEPLEEGLLPLETTRHVSMITITLSKKELDTSSAGYQHPLPVDQVKPLNEYEEEGGSPRMRGRGRGRGRGRGRGFYNGGMEYGDDWDGGRGYGGRGRGRARGRAFRGRGRGYGVQPVGYYDYGEYDAQPPPRGRGRGRGRGRGRGRDRGPPA

SEQ ID NO: 9611 - protein, 241 aa, Phaseolus coccineus
MDRYQRVEKPKAETPINENEIRVTTQGRMRNYITYATTLLQEKGSDEIVLKAMGRAINKTVMIAELIKRRIIGLHQNTVIGSTDITDTWEPLEEGLLPLETTRHVSMITITLSKKELDTSSTGYQTPLPVDQVKPLNEYEEEGEPSPSMRGRGRGRGRGRGRGFYNGGMEYGDGWDGGRGYGGRGRGRARGRAFRGRGRGYGAQPVGYYDYGEYDAPPAPRGRGRGRGRGRGRGRDREPTA

SEQ ID NO: 9612 - protein, 245 aa, Vigna unguiculata
MDRYQRVEKPKAETPINENEIRVTTQGRMRNYITYATTLFQEKESNEIVLKAMGRAINKTVMIAELIKRRIIGLHQNTVIGSTDITDTWEPLEEGLLPLETTRHVSMITITLSKKELDTSSTGYQPPLPVDQVKPLNEYEEEGEASPRMRGRGRGRGRGRGRGIYNGGMEYGDGWDGGRGYGGGYGGRGRGRARGRAFRGRGRGYGAQPVGYYDYGEYDAPPAPRGRGRGRGRGRGRGRDRGVAA

SEQ ID NO: 9613 - protein, 243 aa, Medicago truncatula
MDRYQRVEKPKADSPINENEIRITTQGRMRNYITYATTLFQEKGSDEIVVKAMGRAINKTVMITELIKRRIVGLHQNTQIGSTDITDTWEPLEEGLLPLETTRHVSMITITLSKKELDTSSTGYQPPLPADQVKPLNEYEDEGEGSPRMRGRGRGRGRGRGRGMYNGGMEYGDGWDGGRGYGGRGRGRAWGHAFRGRGRGYGAQPVGQYDYGEYDAPPAPRGRGRGRGRGRGRGRDAGRGAAV

SEQ ID NO: 9614 - protein, 248 aa, Arachis hypogaea
MDRYQRVEKPKADSPINENEIRITTQGRMRNYITYATTLLQEKGSEEIVLKAMGRAINKTVMIAELIKRRIVGLHQNTQIGSTDITDTWEPLEEGLLPLETTRHVSMITITLSKKELDTSSTGYQIPLPADQVKPLNEYEEEGEGSPRMRGRGRGRGRGRGRGMYNGGMEYGDGWDGGRGYGGRGRGRGRGRSFRGRGRGYGAQPVGYYDYGEYDAPPPAPRGRGRGRGRGRGRGRNIRDGAGRGAAA

SEQ ID NO: 9615 - protein, 245 aa, Trigonella foenum-graecum
MDRYQRVEKPKADSPINENEIRITTQGRMRNYITYATTLFQEKGSDEIVVKAMGRAINKTVMITELIKRRIVGLHQNTQIGSTDITDTWEPLEEGLLPLETTRHVSMITITLSKKELDTSSTGYQPPLPADQVKPLNEYEDEGEGSPRMRGRGRGRGRGRGRGRGRGMYNGGMEYGDGWDGGRGYGGRGRGRAWGHAFRGRGRGYGAQPVGQYDYGEYDAPPVPRGRGRGRGRGRGRDAGRGAPA

SEQ ID NO: 9616 - protein, 250 aa, Lotus japonicus
MDRYQRVEKPKADSPINENEIRITSQGRMRNYITYATTLLQEKGSDEIVLKAMGRAINKTVMITELIKRRIVGLHQNTLIGSTDITDTWEPLEEGLLPLETTRHVSMITINLSKKELDTSSTGYQPPLPADQVKPLNEYEEDGEGSPRMPGRGRGRGRGRGRGFYNNGGMEYGGGDGWDGGRGYGGRGRGFGRGRGRGFRGRGRGGYGAQPVGYYDYGEYDAPPAPRGRGRGRGGRGRGRGRNASWGVAA

SEQ ID NO: 9617 - protein, 245 aa, Trigonella foenum-graecum
MDRYQRVEKPKADSPINENEIRITTQGRMRNYITYATTLFQEKGTEEIVLKAMGRAINKTVTITELIKRRIVGLHQNTIIGSTDITDTWEPLEEGLLPLETTRHVSMITITLSKKELDTSSTGYQPPLPADQVKPLNEYEEEGEGSPRMRGRGRGRGRGRGRGRGMYNGGMEYGDGWEGGRGYGGRGRGRAWGRAFRGRGRGYGAQPVGYYDNGEYDAPLAPRGQGRGRGRGRGRGRDAGRGAAV

SEQ ID NO: 9618 - protein, 248 aa, Trifolium pratense
MDRYQRVEKPKADGPINENEIRITTQGRMRNYITYATTLFQEKGTDEIVLKAMGRAINKTVTITELIKRRIVGLHQNTVIGSTDITDTWEPLEEGLLPLETTRHVSMITITLSKKELDTSSTGYQPPLPADQVKPLNEYEEDGEGSPRMRGRGRGRGRGRGRGRGMYNNGGMEYGGDGWDGGRGYGGRGRGRAWGRAFRGRGRGYGAQPAGYYDNGEYDAPPPAPRGQGRGRGRGRGRGRDAGRGAAA

SEQ ID NO: 9619 - protein, 257 aa, Manihot esculenta
MDRYQRIEKPKAETPINENEIRITTQGRMRNYITYATTLLQEKGSNEIILKAMGRAINKTVMIAELIKRRIVGLHQNTAIESTDITDMWEPLEEGLLPLETTRHVSMITITFSKKELDTSSTGYQPPLPVDQVKPLNEFEDEGEGSPIIRGRGRGSWGRGRGRGNYNVGDYNGDGWDGGRGYGGRGRGRGRGRFFRGRGRGRGRGFGGQSSGYYDYGEFDALPAPGRGFAGRGRGRGRGRGRGRTFRSEGPDQAGAA

SEQ ID NO: 9620 - protein, 251 aa, Unknown
  Sequence found in Organisms: Citrus sinensis, Citrus clementina, Citrus sinensis
MDRYQRVEKPKAEAPINENEIRITTQGRMRNYITYATTLLQEKGSNEIVLKAMGRAINKTVMIAELIKRRIAGLHQNTSIGSTDITDMWEPLEEGLLPLETTRHVSMITITLSKKDLDTSSTGYQPPLPADQVKPWNEFEDEGEGSPRGRGRGRGGRGRGRGRGGFYNGAGDYNVDGWDGGRGFGGRGRGRGRGRSFRGRGWGYGSQSGGYYDYGELEAPPVGRGRGRGRARGRGRGRNPRSGGPFQAVGA

SEQ ID NO: 9621 - protein, 251 aa, Cucumis sativus
MDRYQRVEKPKSENTPINENEIRITTQGRMRNYITYATTLLQEKGSNEIVVKGMGRAINKTVMIAELIKRRIVGLHQNTAIGSTDITDMWEPLEEGLLPLETTRHVSMVSITLSKKELDTSSTGYQSPLPVDQVKPWNEFEDEGDGSPRIRGRGRGRGRGRGRGNYNGPSEYQGDGWDGGRGFGPRGRGRGRGRAFRGRGRGYGRQSGGYYDYGEPMAPPVPGRGRGRGRGRARGRGGYYRSDGPVQAAAA

SEQ ID NO: 9622 - protein, 254 aa, Cucumis melo
MDRYQRVEKPKSENTPINENEIRITTQGRMRNYITYATTILQEKGSNEIVVKGMGRAINKTVMIAELIKRRIVGLHQNTAIGSTDITDMWEPLEEGLLPLETTRHVSMVSITLSKKELDTSSTGYQSPLPVDQVKPWNEFEDEGDGSPRIRGRGRGRGRGRGRGNYNGPSEYQGDGWDGGRGFGPRGRGRGRGRAFRGRGRGYGRQSGGYYDYGEPMAPPVPGRGFAGRGRGRGRARGRGGYYRSDGPVQAAAA

SEQ ID NO: 9623 - protein, 254 aa, Citrullus lanatus
MDRYQRVEKPKSENTPINENEIRITTQGRMRNYITYATTLLQEKGSNEIVVKGMGRAINKTVMIAELIKRRIVGLHQNTAIGSTDITDMWEPLEEGLLPLETTRHVSMVSITLSKKELDTSSTGYQSPLPIDQVKPWNEFEDEGEGSPRIRGRGRGRGRGRGRGNYNGPSEYQGDGWDGGRGFGPRGRGRGRGRAFRGRGRGYGRQSGGYYDYGEPMAPPVPGRGFAGRGRGRGRARGRGGYYRSDGPVQAAAA

SEQ ID NO: 9624 - protein, 228 aa, Glycine max
MPLSTVVSPFCSSSATFLSTVIARSSLPPKRNVSPSPFSTLSRRGIALLSFLSLSLSAPASAIEIGMSGPKNWLKDQKKKASKYLLAPIDASRQILRSAYLTLTETDAAYTDEDLEKIQQLFISAARDCVPQDRNSFVTFQANTGVEVCTFRLIVKNAASLLGNKDPVKLKAEALLDNLIRSFTSVSGMASKTNIQLASDRKKIADAVSDTISDLDKFELGIRDCLET

SEQ ID NO: 9625 - protein, 251 aa, Vigna unguiculata
DYERRNDSTLKNRAKVTSEQKQAFAMPLPTVVSTTSSFSAILLSTITARSTLPPKRTVSPSPLSVLSRRDIALLSFLALSPPASAIEFGISGPKNWLKEQKRNASKFLLAPVDASRQILRSAYLTLTKTDATYTDEDLEQIQQLFISAARDCVPQDRNSFVTFQAKSGVEVCTFRLIVKNAASLLGNKDPVKLKAEALLDNLIRSFTTVSGMASETNIQLASDREKIADAVSDTISDLDKFEQGIRDCLES

SEQ ID NO: 9626 - protein, 226 aa, Phaseolus coccineus
MPLPTVVSTISSFSAIFLSTDTARSSLPAKRTVSSSPYSVLSRRDIALLSFLALSPPASAIDIGISGPKNWLKEQKRKASKFLLDPVDASRQILRSAYLTLTKTDATYTDEDLEKIRQLFISAARDCVPQDRSSFVSFQAKSGVEVCTFRLIVKNAASLLGNKDPVKLKAEALLDNLTRSFSTISGMASETNIQLASHREKIADAVSDTISDLDKFEQGIRDCLES

SEQ ID NO: 9627 - protein, 127 aa, Cajanus cajan
MLTESDATYTDEDLEKIQQLFVSAARDCVPQDRNSFVTFQANTGVEVCTFRLVVKNAASLLGDKDPVKLKAEALLDNLIRSFTSISGLANKTDIRLASDRTKIADAVSNTISSLDKFEQGIRDCLEI

SEQ ID NO: 9628 - protein, 415 aa, Vigna unguiculata
MVTMEESPRSPEAKVGLRVEDLWDVQEPQLSPDEKLNACFESIPVSAFPLPPSNQEVEIKSDTSLAEAVKLLAQHNILSAPVVDVDAPEDASWIDRYIGIVEFAGIVVWILHQSDPTSPRSPSSGSAISAAVNGITSAFEHEASGLESAMTTSGNFFEDLTSSQLYKDTKVRDISGSFRWAPFLALERSNSFLTMLLLLSKYKMKSVPVVDLGAGRIQNIITQSSVIHMLAECVGLQWFESWGTKKLSQVGLPMVTPNHIIKVYEDEPVLQAFKLMRKKRIGGLPVMERGGSRAIGNISLQDVQFLLTAPEIYHDYRSITAKDFLTAVRSYLEKHEGTFPMSGELITCNKDCTIKELIQLLDHEKIHRVYVADSDGNLEGLITLRDIISRLVHEPRGYFGDFFDGVLPMPPNSRV

SEQ ID NO: 9629 - protein, 414 aa, Arachis hypogaea
MEDSPRSPEAKLGMRVEDLWDVQEPQLSPNEKLNACFESIPVSAFPPPPSNQEIEIKSDATLAEAVEILAEHNILSAPVVDVDAPEDASWIDRYIGIVEFAGIVVWILHQSDPTSPKSPSSRSNRTAIEAATNGMASLQLEGKDLGSSTTTSGNFFEDLTSSELYKNTKVRDISGSFRWAPFLALERSNSFLTMLLLLSKYKMKSIPVVDLGAGRIDQIITQSAVIHMLGECAGLQWFESWGTKKISEVGLPLVTPNHIIKVYEDEPVLQAFRLMRKKRIGGVPVVERGGNNPVGNISLHDVQFLLTAPEIYHDYRAITAKDFLTAVKSYLKKHEKVVSMSRGLITCKKDCTIKELIQLLDHEKIHRVYVVDDDGNLEGLVTLRDIISRLVHEPRGYFGDFFDGVLPMPPNSRV

SEQ ID NO: 9630 - protein, 1755 aa, Glycine max
MESVLSPIVERTFNFAVDPIIRQLAYILRCRQNVDELLTSFESLELEKESIDRRCDQAQNNLQNIEAKVKEWSRKVDEFKTELEKFRNDEGHRKTGLSNVLFLFPYFWNRHRLGRQAKKMAEIVKNLIDESAKFNDVSYTDNLTSNDFTLSNPGYMGFASRHSTVEKIIAKLEDSSVRMIGLHGSGGMGKTTLIKAIAKKAMEKKLFNVVAISEITANPNPQKIQEDIASALRLRLEGEGENSRAHRLMTRLKQEKENTLIILDDLWDRLDLNKLGIPLDGDVDDNDLNTKTSNAKQGPKEATKEKSLGDYMGCKILLTSRDKNVLTDKMEVKSTFYVEELDDDDALRLFRKEARIQGEMSEWKQEIVKKYCAGLPMAIVTVGRALREKSDSEWEKLKNQDLVGVQNSMEISVKMSYDRLENEELKSIFFLVLKWVINPLIMDLVKYCFGLGILKGVYSLGEARGRISTSIQQLKNSGLVLDGSSSIHFNMHDLVRDAALSIAQKEQNVFTLRDGKLDDWPELERCTSISICNSDIIDELPEEINCPQLKFFQIDSDASSLKIPDSFFKGMKKLKVLMLTGIQLSSLPSSIESLSDLRLLCLERCTLDHNLSIIGKLKKLRILSFSGSRIENLPAELKDLDKLQLLDISNCSVVKRIPPKFMSRLTSLEELYVRKSFIEVSVEGERNHCQISFLSQLKHLHQLHVVDLSIPCAQFFPKELFFDKLNDYKIEIGNFKTLSVGDFRMPNKYEKFKSLALELKDDTDNIHSQKGIKLLFKRVENLLLGELNGVQDVINELNLDGFPHLKHLSIINNPSIKYIINSKDLFYPQDVFPKLESLCLYELRKIEMIYFSSGTEMICFSPFTDCSFTKLKTIKVEKCDQLKNLFSFCMVKLLASLETIGVSNCGSLEEIIKIPDNSDKIEFLKLMSLSLESLSSFTSFYTTVEGSSTNRDQIQITVMTPPLFGELVEIPNLENLNLISMNKIQKIWSDQPPSNFCFQNLIKLVVKDCHNLRYLCSLSVASNLRKLKGLFVSKCKMMEKIFSTEGNSADKVYVFPKLEEIHLNEMDELTDIWQAEVSADSFSSVTSVNIDSCNKLDKIFPSHMEGWFASLNSLKVYSCESVEVIFEIKDSQQVDASGGIDTNLQVVDVRRLPKLEQVWSRDPGGILNFKKLQSIEMDDCKRLRNVFPASVAKDVPKLEYMSVESCDGIVEIVASEDGSETNTEQLVFPELTYMYLGYLSSIQHFYRGRHPIECPKLKKLAVEKCNKKLKTFGTGERSNEEDEAVMSAEKIFPNLEYLHIDFDEAQKWLLSNTVKHPMHRLKVLSLCKVNDGERLCQILYRMPNLEKLRLTEAEHLLQESSESRLGTVLQLKELYLWLSKIKGIGFERESVLQRLELLSLSECHILRNLAPPSVSLAYLTNLKVEDCKGLRNLMASSTAKSLVQLKSMKISECHELEEIVSNEGNEEAEQIVFGKLITIELEGLKKLKSFCSYKNYEFKFPSLEVLIVRECPLMQRFTEGGARAAKLQNIVTADEEGKEEAKWQCEGDLNATIQEGFNKRLQSASTESSLSLRDSPLQVIWLDSRWIPKSCFSNLNSLTVDGCQFLTDVVIPFYLLPLLTNLEELKVRKCGSVKSIFDVKTTTGLGAAAFPRPLPFSLKKLTLERLPKLENVWNEDPHGILTMQLLQHVIVAEDNADPREANLELTFPCPCVSSLKLQGLPKFKYFYYCSLQCHMFQTPTEDEMVLLCYNFVLTA

SEQ ID NO: 9631 - protein, 370 aa, Lotus japonicus
MELDAGYDSRKAKVQAFDDSKVGVKGLLDSGVTKIPPMFYSPKLDPIETETSLSDSNFSIPIIDLQDRHVEVVDQIQSACKKWGFFQVINHGIPADVLDEMISGIRRFHEQDAEARKLFYSRDSNKKVRYFSNGKLFRDFAASWRDTIAFVANPDPPNPQDLPAVCRDIVAEYSKQVKALGMTIFGLLSEALGLNPSYLNEMDCAEALYIMGQYYPECPEPELTMGIPKHTDCDFMTILVQDQKGGLQVLHENQWVNVPPVHGALVVNIGDILQLMTNDMFISVYHRVLLRNIGPRVSVASFFMNFTISECTSKIYGPIKELLSEENPPVYRDVTMKEILTNYYAKGIDGNLLATFKVVKENIRYWIGSP

SEQ ID NO: 9632 - protein, 377 aa, Glycine max
MATTSSSSEEAPNTKKNKKECLGWIEWLRGWFYVVYEMLFQRIMASHLHNPMPLPPVNDLTCIVTGSTSGIGLEIARQLAQSGAHVVMAVRNTKAAQELIQKWQVDSEGLSIPLNVEVMQVDLLSLDSVTRFAEAWNARSAPLHVLINNAGIFSIGEPQKFSKDGYEQHLQVNHLAPALLSILLLPSLIRGSPSRIVNVNSIMHHVGFVDTEDMNLTSGKRKFSSMVGYSSSKLAEIMFSSTINKRLPAESGISVLCVSPGIVQTNVARDLPKLVQAAYHLIPYFIFSAQEGARSALFAATDPQVPEYCEMLKADEWPVCAFISQDCRPANPSEEAHNVQTSYEVWEKTLEMIGLPSDAVERLLDGEEVKCRYGQEQ

SEQ ID NO: 9633 - protein, 225 aa, Vigna unguiculata
  misc_feature (9)..(9): Xaa can be any naturally occurring amino acid
MATTTSSSXNEAPETKNKKKECLGWIEWLRGWFYLIYEMLFQRIMASHLHNPMPLPPVNDLTCIVTGSTSGIGLEIARQLAQSGAHVVMAVRNTKAAQELIQKWQIDSSGLSIPLNVEVMQVDLLSLDSVVRFAEAWNARSAPLHVLINNAGIFSIGEPQKFSKDGYEQHLQVNHLAPALLSILLLPSLIRGSPSRIVNVNSIMHHVGFVDTEEHECHIWKKEIF

SEQ ID NO: 9634 - protein, 382 aa, Medicago truncatula
MATATTTSSSSNEPLLKKKKKQSLGWIEWLRGWFNLFYEFLFQRITASHLHNPMPLPPINDLTCIVTGSTSGIGLEIARQLAESGAHVVMAVRNTKRANDLIQKWQIESDGLGLGMALNVEVMEVDLLSLDSVARFAEAWNARATPLHALINNAGIFSIGEPQKFSKDGYEDHLQVNHLAPALLSILLLPSLIRGSPSRIVNVNSIMHHVGFVDTEDMNLTSGKRKFSSLVGYSSSKLAQVMFSSVLFKRLPAEAGISVLCVSPGIVQTNVARDLPKSVQTGYHLIPYFIFNAQEGSRSTLFAATDPQVSEYCELLKSDEWPVCPYISHDCRPANASEEAHNLQTSHEVWEKTLEMIGLPSDAVEKFLEGEEVKCRYGQEQQ

SEQ ID NO: 9635 - protein, 377 aa, Prunus persica
MATTSSHPKEEVKKKKKKEGLGWIEWARGWLYLVYEMLFQRITASHLQNPMPLPPVNDLTCIVTGSTSGIGREIARQLAEAGAHVVMAVRNTKAANELIQKWQNEWTGMGLPPNIEVMELDLLSLDSVVRFAEAWNARLGPLHVLINNAGIFSIGEPQKLSKDGYEEHLQVNHLAPALLSVLLLPSLIRGSPSRIINLNSVMHYVGFVDTEDMNVVSGKRKYTSLVGYSSSKLAQIMFSSVLHKRLPAESGITVACVSPGIVQTNVARDLPKIVQAAYHLIPYFIFSAQEGSRSALFAATDPQVPEYCELLKADDWPVCAFISQDCRPTNPSEEAHNVETSHEVWEKTFEMIGLPSDAVERLIEGEEVACRYGGHKG

SEQ ID NO: 9636 - protein, 379 aa, Malus domestica
MAAAVASSNPKEEVKTKNKKEGLGWIEWMRGWLYVVYEMLFQRITASHLQNPMPLPPVNDLTCIVTGSTSGIGREIARQLAESGAHVIMAVRNTKAANELIQKWQNEWSGMGLPLNIEVMELDLLSLDSVVRFAEAWNARLGPLHVLINNAGIFSIGEPQKFSKDGYEEHLQVNHLAPALLSVLLLPSLIRGSPSRIVNVNSVMHYVGFVDTEDMNVVSGKRKFTSLVGYTSSKLAQIMFSSVLHKRLPAESGISVVCVSPGIVQTNVARDLPKIVQAAYHLVPYFMFSAQEGSRSALFAATDPQVPEYCELLKTDDFPVCAFISQDCRPTNPSEESHNVETSHEVWEKTFEMIGLPSDAVDRLIEGEEVASRYGAHGE

SEQ ID NO: 9637 - protein, 378 aa, Arachis hypogaea
MGTEDEAAPPSSSSSVKKKKQGLGWIEWIRGWMVVVQEMLFQRIMASHLHNPMPLPPINDLTCIVTGSTSGIGCEIARQLAQAGAHVVMAVRNTKAAQELIQKWQIDSEGFCIALNVEVMQVDLLSLDSVARFAEAWNARSVPVNALINNAGIFSIGEPQKFSKDGYEEHLQVNHLAPALLSVLLLPSLMRGSPSRIVNVNSVMHYVGFVDPEDMNVTSGKRKYSSFIGYTSSKLAEVMFSSVLHKRIPAEAGIGVVCVSPGIVQTNVARDLPKIVQAAYRLIPYFIFNAQEGSRSALFAATDPSVSEYCEMLRSDEWPVCAFISQDCRPANPSEESHEVQTQYEVWEKTLEMIGLPSDAVERLIEGQEVKCRYGQQQ

SEQ ID NO: 9638 - protein, 378 aa, Euonymus alatus
MEKTTSSSSEKENMKVKKKEALGWMEWLRGWMNIAQEMLLQRIMASHLENPLPLPPINDLTCIVTGSTSGIGLEIGRQLAQAGAHVVMAVRNRKAAQELIQKWQNEWSGMGLPLNIEVMELDLLSLESVVRFAEAWNARLGPLHVLINNAGIFSIGEPQKFSKDGYEAHMQVNHLAPALLSILLLPSLIRGSPSRIVNVNSVMHYVGFVDPEDMNVVSEKRKYTSLVGYTSSKLAQVMYSSVLHKRLPAESGICVLCVSPGIVQTNVARDLPKIVQAAYHLIPYFTFSPQEGSRSALFASTDPQIPEYCELLKSDEWPVCAFISQDCRPTNPSEEAHNIKTSYEVWEKTLEMVGLPLDAVERLLEGEEVKCRYGASQE

SEQ ID NO: 9639 - protein, 373 aa, Fragaria vesca
MATTLSDLKEEVKKKKEGLGWIEWLRGWFYVVYEMLFQRITASHLQNPMPLPPVNDLTCIVTGSTSGIGREIARQLAEAGAHVVMAVRNTKAAEELIQKWQNEWSGMGLPLNIEVMELDLLSLDSVVRFCEAWNARLGSLHVLINNAGIFSIGEPQKFSKDGYEEHLQVNHLAPALLSVLLLPSLIRGSPSRIVNVNSVMHYVGFVDTDDMNVVSGKRKYTSLVGYSSSKLAQIMFSSVLHKRLPAEAGISVACVSPGVVQTNVARDLPSIVQAGYRLIPYFIFSPQEGSRSALFAATDPQVPEYCQLLKSDDFPVCAFISQDCNPTNPSEEAHDVETSHKVWEKTFEMIGLPSDAVERLIEGEEVACRYGGS

SEQ ID NO: 9640 - protein, 85 aa, Cynodon dactylon
MGKVHGSLARAGKVRGQTPKVAKQDKKKKPRGRAHKRMQYNRRFVTAVVGFGKKRGPNSSEKYIYTARRPGSNKWLPVPFSFLCS

SEQ ID NO: 9641 - protein, 79 aa, Zingiber officinale
ALCFVAAAAASSSPHAAMGKVHGSLARAGKVRGQTPKVAKQDKKKKPRGRAHKRMQYNRRFVTAVVGFGKKRGPNSSEK

SEQ ID NO: 9642 - protein, 78 aa, Zingiber officinale
  misc_feature (2)..(2): Xaa can be any naturally occurring amino acid
TXRARLLCRSCLPHDAMGKVHGSLARAGKVRGQTPKVAKQDKKKKPRGRAHKRMQYNRRFVTAVVGFGKKRGPNSSEK

SEQ ID NO: 9643 - protein, 82 aa, Vitis vinifera
CIVLIVAGDQSSNHHHPQSQMGKVHGSLARAGKVRGQTPKVAKQDKKKKPRGRAHKRMQYNRRFVTAVVGFGKKRGPNSSEK

SEQ ID NO: 9644 - protein, 896 aa, Pennisetum glaucum
SGHDSKYFSTTKKGEIPELKEELNSQYKDKRKDAVKKVIAAMTVGKDVSSLFTDVVNCMQTENLELKKLVYLYLINYAKSQPDLAILAVNTFVKDSQDPNPLIRALAVRTMGCIRVDKITEYLCDPLQRCLKDDDPYVRKTAAICVAKLYDINAELVEDRGFLEALKDLISDNNPMVVANAVAALAEIQDNSVRPIFEITSHTLSKLLTALNECTEWGQVFILDSLSRYKAADAREAENIVERVTPRLQHANCAVVLSAVKIILLQMELITSTDVVRNLCKKMAPPLVTLLSAEPEIQYVALRNINLIVQKRPTILAHEIKVFFCKYNDPIYVKMEKLEIMIKLASDRNIDQVLLEFKEYATEVDVDFVRKAVRAIGRCAIKLERATERCISVLLELIKIKVNYVVQEAIIVIKDIFRRYPNTYESIIATLCESLDTLDEPEAKASMIWIIGEYAERIDNADELLESFLETFPEEPALVQLQLLTATVKLFLKKPTEGPQQMIQAVLNNATVETDNPDLRDRAYIYWRLLSTDPEAAKDVVLAEKPVISDDSNQLDSSLLDELLANISTLSSVYHKPPESFVSRVKAAPRADDEEFADTAEAGYSESPSQGVEGASPSSSVGTSSNVPVKQPGAGSPPAAAMPDLLGDLMGMDNAIVPVDEPAAPSGPPLPVLLPSTTGQGLQISAQLTRRDGQIYYDISFENGTQGVLDGFMIQFNKNTFGLAAGEALKVPPLQPGASARTLLQMVPFQNIAPGAPNSMLQVAVKNNQQPVWYFNDKIPLHVFFVEDGKMERASFLEGWKSLPDDHEFTKEFPGSVISSIDATVERLAASNVFFIAKRKNANMDVLYLSAKMPRGIPFLIEITAAVGVPGVKCAVKTANKDMVPLFFEAMEALTK

SEQ ID NO: 9645 - protein, 89 aa, Nicotiana benthamiana
AWARLLFVTFAAPNTQFLRRPATSKSAMGKVHGSLARAGKVRGQTPKVAKQDKKKKPRGRAHKRMQYNRRFVTAVVGFGKKRGPNSSEK

SEQ ID NO: 9646 - protein, 170 aa, Solanum tuberosum
MASASPSQASLLLQKQLKDLCKKPVDGFSAGLVDESNLFEWSVTIIGPPETLYEGGFFNAIMSFPQNYPNSPPTVKFTSEVWHPNVYSDGKVCISILHPPGDDPNGYELASERWSPVHTVESIMLSIISMLSSPNDESPANVEAAKEWRDNRDEFKKKVSRCVRRSQEMT

SEQ ID NO: 9647 - protein, 84 aa, Nicotiana tabacum
ISNFRSSRQPQFLRRPATSKSAMGKVHGSLARAGKVRGQTPKVAKQDKKKKPRGRAHKRMQYNRRFVTAVVGFGKKRGPNSSEK

SEQ ID NO: 9648 - protein, 91 aa, Nicotiana tabacum
LRPGNPSISNLCSSKHSQFLRRPATPKSAMGKVHGSLARAGKVRGQTPKVAKQDKKKKPRGRAHKRMQYNRRFVTAVVGFGKKRGPNSSEK

SEQ ID NO: 9649 - protein, 62 aa, Unknown
  Sequence found in Organisms: Gossypium hirsutum, Zea mays, Amorphophallus konjac, Musa acuminata, Bruguiera gymnorhiza, Theobroma cacao, Coffea canephora, Setaria italica and additional organisms as disclosed in Tables 53 and 54
MGKVHGSLARAGKVRGQTPKVAKQDKKKKPRGRAYKRMQYNRRFVTAVVGFGKKRGPNSSEK

SEQ ID NO: 9650 - protein, 62 aa, Unknown
  Sequence found in Organisms: Pennisetum glaucum, Malus domestica, Silene vulgaris
MGKVHGSLARAGKVRGQTPKVAKQDKKKKPRGRAHKRLQYNRRFVTAVVGFGKKRGPNSSEK

SEQ ID NO: 9651 - protein, 62 aa, Unknown
  Sequence found in Organisms: Ocimum basilicum, Chelidonium majus, Medicago truncatula, Orobanche aegyptiaca, Tabernaemontana elegans, Trigonella foenum-graecum
MGKVHGSLARAGKVRGQTPKVAKQDKKKQPRGRAHKRMQYNRRFVTAVVGFGKKRGPNSSEK

SEQ ID NO: 9652 - protein, 62 aa, Euphorbia peplus
MGKVHGSLARAGKVRGQTPKVAKQDKKKKPRGRAHKRMQYNRRLVTAVVGFGKKRGPNSSEK

SEQ ID NO: 9653 - protein, 62 aa, Humulus lupulus
MGKVHGSLARAGKVRGQTPKVAKQDKKKKPRGRAHKRMQYNRRFVTAVIGFGKKRGPNSSEK

SEQ ID NO: 9654 - protein, 62 aa, Sarracenia psittacina
MGKVHGSLARAGKARGQTPKVAKQDKKKKPRGRAHKRMQYNRRFVTAVVGFGKKRGPNSSEK

SEQ ID NO: 9655 - protein, 62 aa, Unknown
  Sequence found in Organisms: Actinidia deliciosa, Thellungiella halophila, Eutrema halophilum
MGKVHGSLARAGKVRGQTPKVAKQDKKKKPRGRAHKRMQHNRRFVTAVVGFGKKRGPNSSEK

SEQ ID NO: 9656 - protein, 62 aa, Unknown
  Sequence found in Organisms: Antirrhinum majus, Capsicum annuum
MGKVHGSLARAGKVRGQTPKVAKQDKKKKPRGRAHKRMQYTRRFVTAVVGFGKKRGPNSSEK

SEQ ID NO: 9657 - protein, 62 aa, Persea americana
MGKVHGSLARAGKVRGQTPKVAKQDKKKKPRGRAHKRMQYNRRFVTAVVGFGKRRGPNSSEK

SEQ ID NO: 9658 - protein, 62 aa, Beta vulgaris
MGKVHGSLARAGKVRGQTPKVASQDKKKKPRGRAHKRMQYNRRFVTAVVGFGKKRGPNSSEK

SEQ ID NO: 9659 - protein, 62 aa, Ipomoea batatas
MGKVHGSLARAGKVRGQTPKVAEQDKKKKPRGRAHKRMQYNRRFVTAVVGFGKKRGPNSSEK

SEQ ID NO: 9660 - protein, 62 aa, Ipomoea nil
MGKVHGSLARAGKVRGQTPKVAKQDKKKKPRGRAHKRMQYNRRFVTAVVCFGKKRGPNSSEK

SEQ ID NO: 9661 - protein, 62 aa, Tropaeolum majus
MGKVHGSLARAGKVRGQTPKVAAQDKKKKPRGRAHKRMQYNRRFVTAVVGFGKKRGPNSSEK

SEQ ID NO: 9662 - protein, 62 aa, Orobanche aegyptiaca
MGKVHGSLARAGKVRGQTPKVTKQDKKKKPRGRAHKRMQYNRRFVTAVVGFGKKRGPNSSEK

SEQ ID NO: 9663 - protein, 62 aa, Sequoia sempervirens
MSKVHGSLARAGKVRGQTPKVAKQDKKKKPRGRAHKRMQYNRRFVTAVVGFGKKRGPNSSEK

SEQ ID NO: 9664 - protein, 62 aa, Tamarix hispida
  misc_feature (28)..(28): Xaa can be any naturally occurring amino acid
MGKVHGSLARAGKVRGQTPKVAKQDKKXKPRGRAHKRMQYNRRFVTAVVGFGKKRGPNSSEK

SEQ ID NO: 9665 - protein, 138 aa, Setaria italica
MAAAARRMHAAARHRARRSRRRRRRISQHPRPRLRRRRRAAASQPWVTTFASFHLSSLVATSSPTDALIGVFVSLRAGKVHGSLARAGKVRGQTPKVAKQDKKKKPRGRAHKRMQYNRRFVTAVVGFGKKRGPNSSEK

SEQ ID NO: 9666 - protein, 80 aa, Tabernaemontana elegans
PHSKWKRHLTEDLGNLQPVGKVHGSLARAGKVRGQTPKVAKQDKKKKPRGRAHKRMQYNRRFVTAVVGFGKKRGPNSSEK

SEQ ID NO: 9667 - protein, 80 aa, Euphorbia esula
  misc_feature (2)..(3): Xaa can be any naturally occurring amino acid
DXXFAEHPEEEKSLIRFAMGKVHGSLARAGKVRGQTPKVAKQDKKKKPRGRAHKRMQYNRRLVTAVVGFGKKRGPNSSEK

SEQ ID NO: 9668 - protein, 80 aa, Nicotiana tabacum
EQLQTLLTSPANGDSDITMGKVHGSLARAGKVRGQTPKVTKQDKKKKPRGRAHKRMQYNRRFVTAVVGFGKKRGPNSSEK

SEQ ID NO: 9669 - protein, 85 aa, Juglans hindsii x Juglans regia
MGKVHGSLARVRKGAGSDSKGGQAGQEEEAARPRPQAYAVQSPLRHRRSWIWEEAWTQFFREVSSLLFEEFGYGEAVVDHEALVS

SEQ ID NO: 9670 - protein, 62 aa, Unknown
  Sequence found in Organisms: Abies balsamea, Pinus pinaster, Picea glauca
MSKVHGSLARAGKVRGQTPKVAKQDKKKKPRGRAHKRMQYNRRFVTAVVTFGKKRGPNSSEK

SEQ ID NO: 9671 - protein, 62 aa, Unknown
  Sequence found in Organisms: Ambrosia trifida, Artemisia annua, Hordeum vulgare, Brachypodium distachyon, Cichorium intybus, Cirsium arvense, Taraxacum officinale, Flaveria ramosissima and additional organisms as disclosed in Tables 53 and 54
MGKVHGSLARAGKVRGQTPKVAKQDKKKQPRGRAHKRIQYNRRFVTAVVGFGKKRGPNSSEK

SEQ ID NO: 9672 - protein, 62 aa, Unknown [sequence omitted]

SEQ ID NO: 9673 - protein, 62 aa, Unknown
  Sequence found in Organisms: Cephalotaxus harringtonia, Distylium racemosum, Podocarpus macrophillus, Taxus baccata
MSKVHGSLARAGKVRGQTPKVAKQDKKKKPRGRAHKRMQYNRRFVTAVLGFGKKRGPNSSEK

SEQ ID NO: 9674 - protein, 62 aa, Primula obconica
MGKVHGSLARAGKVRGQTPKVAKQDKKKKPRGRAHKRLQYTRRFVTAVVGFGKKRGPNSSEK

SEQ ID NO: 9675 - protein, 61 aa, Eutrema halophilum
GKVHGSLARAGKVRGQTPKVAKQDKKKKPRGRAHKRMQHNRRFVTAVVGFGKKRGPNSSEK

SEQ ID NO: 9676 - protein, 62 aa, Manihot esculenta
MGKVHGSLARAGKVRGQTPKVAKQDKKKRPRGRAYKRMQYNRRFVTAVVGFGKKRGPNSSEK

SEQ ID NO: 9677 - protein, 62 aa, Unknown
  Sequence found in Organisms: Ceratodon purpureus, Physcomitrella patens
MSKVHGSLARAGKVRGQTPKVAKQDKKKKPKGRAHKRMQYNRRFVTAVVGFGKKRGPNSSEK

SEQ ID NO: 9678 - protein, 62 aa, Cryptomeria japonica
MSKVHGSLARAGKVRGQTPKVAKQDKKKKPRGRAHKRMQYNRRFVTAVAGFGKKRGPNSSEK

SEQ ID NO: 9679 - protein, 62 aa, Eucalyptus grandis
  misc_feature (36)..(36): Xaa can be any naturally occurring amino acid
  misc_feature (48)..(48): Xaa can be any naturally occurring amino acid
MGKVHGSLARAGKVRGQTPKVAKQDKKKKPRGRAHXRMQYNRRFVTAXVGFGKKRGPNSSEK

SEQ ID NO: 9680 - protein, 62 aa, Orobanche aegyptiaca
MGKVHGSLARAGKVRGQTPKVVKQDKKKKPRGRAHKRMQYNRRFITAVVGFGKKRGPNSSEK

SEQ ID NO: 9681 - protein, 62 aa, Sciadopitys verticillata
MSKVHGSLARAGKVRGQTPKVAKQDKKKQPRGRAHKRMQYNRRFVTAVVGFGKKRGPNSSEK

SEQ ID NO: 9682 - protein, 62 aa, Saccharum officinarum
MGKVHGSLARAGKVRGQTPTVAKQDKKKKPRGRAYKRMQYNRRFVTAVVGFGKKRGPNSSEK

SEQ ID NO: 9683 - protein, 62 aa, Zamia vazquezii
MSKVHGSLARAGKVRGQTPKVAKQDKKKKPRGRAYKRMQYNRRFVTAVVGFGKKRGPNSSEK

SEQ ID NO: 9684 - protein, 63 aa, Cirsium arvense
SYKVTFGVLFHDDRCANIFEALVGTLRAAKRRKFLTYDGELLLQGVHDNVEIILKPTPPAAAA

SEQ ID NO: 9685 - protein, 85 aa, Utricularia gibba
RFTVRWRVLEKLEVRRRRWQSKTKRRSLEAVRTSECSTIAASSPPLLALGKREDRIRLRSKGNEALSCMCLPTCYNDLEHSLSEI

SEQ ID NO: 9686 - protein, 76 aa, Amaranthus tuberculatus
VRFTDLWLVPEKLEVKPLKLLSKTKRRSLVVALISVCNTTAVSSPLLLDSARREDQTLQRSKIASGCSNNVISQIS

SEQ ID NO: 9687 - protein, 86 aa, Brassica oleracea
ELRDYALLSANHSRRKKKERSKSAMGKVHGSLARAGKVRGQTPKVAKQDKKKKPRGRAHKRLQHNRRFVTAVVGFGKKRGPNSSEK

SEQ ID NO: 9688 - protein, 81 aa, Brassica rapa
ALVSANCSRRKRKQRSKSTMGKVHGSLARAGKVRGQTPKVAKQDKKKKPRGRAHKRLQHNRRFVTAVVGFGKKRGPNSSEK

SEQ ID NO: 9689 - protein, 85 aa, Brassica rapa
ESIKSCRRHTFAGGSADPFVKTTMGKVHGSLARAGKVRGQTPKVAKQDKKKKPRGRAHKRLQHNRRFVTAVVGFGKKRGPNSSEK

SEQ ID NO: 9690 - protein, 95 aa, Brassica rapa
KQWYQPRVAITAGDALVSGYCSRRKRKQRSKSAMGKVHGSLARAGKVRGQTPKVAKQDKKKKPRGRAHKRLQHNRRFVTAVVGFGKKRGPNSSEK

SEQ ID NO: 9691 - protein, 89 aa, Elaeis guineensis
SPLAFSVSSFPSLTRSLAANPTNQSAAMGKVHGSLARAGKVRGQTPKVAKQDKKKKPRGRAYKRMQYNRRFVTAVVGFGRKRGPNSSEK

SEQ ID NO: 9692 - protein, 87 aa, Raphanus sativus
KNPSLTKSCRHTFAGGSADSVVRTTMGKVHGSLARAGKVRGQTPKVAKQDKKKKPRGRAHKRLQHNRRFVTAVVGFGKKRGPNSSEK

SEQ ID NO: 9693 - protein, 77 aa, Raphanus sativus
RLRSRRKKKQRSKSAMGKVHGSLARAGKVRGQTPKVAKQDKKKKPRGRAHKRLQHNRRFVTAVVGFGKKRGPNSSEK

SEQ ID NO: 9694 - protein, 89 aa, Carthamus tinctorius
  misc_feature (19)..(19): Xaa can be any naturally occurring amino acid
AGNLTFPISSDSAAQNPHXEAENSKFAMGKVHGSLARAGKVRGQTPKVAKQDKKKQPRGRAHKRIQYNRRFVTAVVGFGKKRGPNSSEK

SEQ ID NO: 9695 - protein, 75 aa, Sequoia sempervirens
MSKVHGSLARAGKVRGQTPKVAKQDKRKSPEAALTSACNIIGALLLPWLVSARKEGPTHQRSDEENYKIKLAFCC

SEQ ID NO: 9696 - protein, 478 aa, Zostera marina
CFPPTIIGLAVSFCIFFLAAGSRLDPILRLPSEKDSLGTRWAVLIAGSSGYGNYRHQADVCHAYQIMRKGGLKDENIVVFMYDDIANNRYNPRPGIIINHPKGEDVYAGVPKDYVGMDVNVNNFFAVLLGNKARLSGNGSGKVVDSGPDDHIFIFYSDHGGPGVLGMPSYPYLYANDLIDVLKEKHALKSYKSMVFYLEACESGSIFEGLLPEDIDIYATTASNAVENSWGTYCPEQLISPPDEYSTCLGDLYSISWMEDSDIHNLHTETLKQQYHVVKDRTSVQKTYDSGSHVMEYGDLDLSLSDLFTYIGTNPANDNSSFVDINSLPQLPSSNRVNQRDADLVFYWNKIRKASEGPEKREAETELINVMTHRVHIDRSIELIGKILFGLDASKDKLNEVRPSNKPLVDDWKCLKSMVRTFETYCGSLSQYGMKHMRSLANICNADVTLDKMEESAAQACEKIPSNSWSSIDQGFSA

SEQ ID NO: 9697 - protein, 62 aa, Unknown
  Sequence found in Organisms: Cedrus atlantica, Pseudotsuga menziesii
MSKVHGSLARAGKVRGQTPKVAKQDKKKKPRGRAHKRMQYNRRFVTAVLTFGKKRGPNSSEK

SEQ ID NO: 9698 - protein, 62 aa, Cedrus atlantica
MSKVHGSLARAGKVRGQTPKVAKQDKKKKPRGRAHKRMQYNRRFVTAVATFGKKRGPNSSEK

SEQ ID NO: 9699 - protein, 62 aa, Unknown
  Sequence found in Organisms: Citrus sinensis, Citrus clementina, Citrus sinensis
MGKVHGSLARAGKVRGQTPKVAKQDKKKRPRGRAYKRMQYNRRFVTAVVGFGKKRGPNSSQK

SEQ ID NO: 9700 - protein, 62 aa, Linum usitatissimum
MGKVHGSLARAGKVRGQTPKVAKQEKKKRPRGRAHKREQYNRRFVTAVVGFGKKRGPNSSEK

SEQ ID NO: 9701 - protein, 62 aa, Fraxinus spp
MGKVHGSLARAGKVRGQTPKVAKQDKKKKPRGRAHKRMQYNRRFVTAVVGFGKKKSPNSSSK

SEQ ID NO: 9702 - protein, 62 aa, Brassica napus
MGKVHGSLARAGKVRGQTPKVAKQDKKKKPRGRAHKRLQHNRRFVTVVVGFGKKRGPNSSEK

SEQ ID NO: 9703 - protein, 61 aa, Manihot esculenta
GKVHGSLARAGKVRGQTPKVAKQDKKKRPRGRAYKRMQYNRRFVTAVVGFGKKRGPNSSEK

SEQ ID NO: 9704 - protein, 62 aa, Gerbera hybrid cultivar
MGKVHGSLARAGKVRGQTPKVAKQDKKKQPRGRAHKRIPYNRRFVTAVVGFGKKRGPNSSEK

SEQ ID NO: 9705 - protein, 62 aa, Marchantia polymorpha
MSKVHGSLARAGKVRGQTPKVQKQDKKKKPKGRAHKRMQYNRRFVTAVVGFGKKRGPNSSEK

SEQ ID NO: 9706 - protein, 62 aa, Pinus taeda
MSKVHGSLARAGKVRGQTPKVAKQDKKKKPRGRAHKRMQYNRRFVTAVVTFGKKKGPNSSEK

SEQ ID NO: 9707 - protein, 62 aa, Sciadopitys verticillata
MSKVHGSLARAGKVRGQTPKVAKQDNKKKPRGRAHKRMQYNRRFVTAVLGFGKKRGPNSSEK

SEQ ID NO: 9708 - protein, 62 aa, Thellungiella halophila
MGKVHGSLARAGKVRGQTPKVAKQDKKKQPRGRAHKRIQHNRRFVTAVVGFGKKRGPNSSEK

SEQ ID NO: 9709 - protein, 70 aa, Ambrosia trifida
MGKVHGSLARAGKVRGQTPKVAKQDKKKQPRGRAHKRIQYNRRFVTAVVGFGKKRGQTHLRSKAWDSPQS

SEQ ID NO: 9710 - protein, 70 aa, Cirsium arvense
MGKVHGSLARAGKVRGQTPKVAKQDKKKQPRGRAHKRIQYNRRFVTAVVGLERRGGQTHLRSKLWEYVIL

SEQ ID NO: 9711 - protein, 66 aa, Flaveria ramosissima
MGKVHGSLARAGKVRGQTPKVAKQDKKKQPRGRAHKRIQYNRRFVTAVVGFGKKEDQTHQRSKMKD

SEQ ID NO: 9712 - protein, 86 aa, Flaveria ramosissima
LYHIIMFVIQTDRFNSMIAQLNHRKGSRIIGSSRKSERSNPKGRKARQEEAAARTCSQADSVQPPIRHSRCWFWEEEGTKLIREVR

SEQ ID NO: 9713 - protein, 65 aa, Phalaenopsis aphrodite
EIRRRGTARKKVLLFLTDKSAMGKVHGSLARAGKVRGQTPKVSKQDKKKKPRGGLTSGCSTIAAL

SEQ ID NO: 9714 - protein, 82 aa, Raphanus sativus
  misc_feature (18)..(18): Xaa can be any naturally occurring amino acid
  misc_feature (22)..(22): Xaa can be any naturally occurring amino acid
KVNLPSSPPAEKPEEYPXSTMXKVHGSLARAGKVRGQTPKVAKQDKKKKPRGRAHKRLQHNRRFVTAVVGFGKKRGPNSSEK

SEQ ID NO: 9715 - protein, 93 aa, Carthamus tinctorius
GNLNTIVSALLGNPTNRSKRNQKAANNSKFQMGKVHGSLARAGKVRGQTPKVAKQDKKKQPRGRAHKRIQYNRRFITAVVGFGKKRGPNSSEK

SEQ ID NO: 9716 - protein, 63 aa, Gnetum gnemon
MSKVHGSLARAGKVRGQTPKVAKQDKKKKPRGRAHKRMQYNRRFVTAVVTFGKKRGPNSSENK

SEQ ID NO: 9717 - protein, 63 aa, Brassica oleracea
  misc_feature (36)..(36): Xaa can be any naturally occurring amino acid
MGKVHGSLARAGKVRGQTPKVAKQDKKKKPRGRATXVFSTIAVSSPPLLDLARREDPTLLRNR

SEQ ID NO: 9718 - protein, 105 aa, Mesembryanthemum crystallinum
  misc_feature (65)..(65): Xaa can be any naturally occurring amino acid
  misc_feature (93)..(93): Xaa can be any naturally occurring amino acid
  misc_feature (102)..(102): Xaa can be any naturally occurring amino acid
YSLHTPVDHRLRTSRPRRPISHHTFRSRGEREETARRTAMGKVHGSLARAGKVRGQTPKVASQDXKKKPRGRAHKRLQYNRRFVTAVVGFGKXRGPNSSEKXGLS

SEQ ID NO: 9719 - protein, 78 aa, Triticum aestivum
MGKVHGSLARAGKVPGQTPKVAKQDKKKKPRGRAYKRMQYNRRFVTAVVGFGKKRGPTPRRIRYTMSLCFGPPLFSLY

SEQ ID NO: 9720 - protein, 62 aa, Pinus taeda
MSKVHGSLARAGKVRGQTPKVPKQDKKKKPRGRAHKRMQYNRRFVTAVLTFGKKRGPNSSEK

SEQ ID NO: 9721 - protein, 62 aa, Pinus taeda
MSKVHGSLARAGKVRGQTPKVAKQDKKKKPRGRAHKRMQYNRRFVTAVLTFGKKKGPNSSEK

SEQ ID NO: 9722 - protein, 62 aa, Tragopogon dubius
MGKVHGSLARAGKVRGQTPKAAKRDKKKQPRGRAHKRIQYNRRFVTAVVGFGKKRGPNSSEK

SEQ ID NO: 9723 - protein, 93 aa, Sarracenia psittacina
MGKVHGSLARAGKVRGQTPKVAKQDKKKQPRGRAHKRIQYNRRFVTAVVGFGRRGAKLIREVRHGIMLNLICFFDHCYVFVLMLQKFVKHYEV

SEQ ID NO: 9724 - protein, 139 aa, Secale cereale
  misc_feature (54)..(54): Xaa can be any naturally occurring amino acid
PPPPPPPERPPFSSPKRRRSTAAEAMGKVHGSLLAPGRCGARRPRWRSRTRRSXPAGARTSASSTTAASSPPSSASARSAAPTRPRSRSRSSRPWPSPLDRPPFFRVSVYPVCMLRRRPDLVSVIDCDVGNGNLTALSS

SEQ ID NO: 9725 - protein, 59 aa, Brassica juncea
VHGSLARAGKVRGQTPKVAKQDKKKKPRGRAHKRLQHNRRFVTAVVGFGKKRGPNSSEK

SEQ ID NO: 9726 - protein, 62 aa, Marchantia polymorpha
MSKVHGSLARAGKVRGQTPKVQKQDKKKQPKGRAHKRIQYNRRFVTAVVGFGKKRGPNSSEK

SEQ ID NO: 9727 - protein, 62 aa, Pinus taeda
MSKVHGSLARAGKVRGQTPKVPKQDKKKKPRGRAYKRMQYNRRFVTAVVTFGKKKGPNSSEK

SEQ ID NO: 9728 - protein, 59 aa, Triphysaria pusilla
VHGSLARAGKVRGQTPKVAKQDKKKNPRGRAHKRVQYNRRFVTAVVGFGKKRGPNSSEK

SEQ ID NO: 9729 - protein, 83 aa, Fagopyrum esculentum
HQRLITNNHKRENQQFSAYLRRSIMGKVSRIFWLVLVRLEARHQRWPSRARRRSPAVALTSVCNTIAVSSPPLLDSARREALN

SEQ ID NO: 9730 - protein, 71 aa, Thalictrum flavum
YYKQILPNRVKVTMESLARAGKVRGQTPKVAKQDKKKKPRGRAHKRMQYNRRFVTAVVGFGKKRGPNSSEK

SEQ ID NO: 9731 - protein, 79 aa, Pinus taeda
MVPLPEQGKLEGRRPRWLNKTSLEAAPTSECNTTAGLLPQCLLLERREGQTPLRSKWLEVKSSSFESNIFFGMSSLIFG

SEQ ID NO: 9732 - protein, 62 aa, Musa acuminata
MGKVHGSQARAGKVRGQTPKQAKTDKPKKPRGRAYKRMQHNRRFVTAVVGFGKKRGPNSSEK

SEQ ID NO: 9733 - protein, 62 aa, Adiantum capillus-veneris
MSKVHGSLARAGKVRGQTPKVAKQEKKKRPKGRAYKRIQYNRRFVTAVVGFGKKRGPNSSEK

SEQ ID NO: 9734 - protein, 69 aa, Zingiber officinale
ARGLHVDMGKVHGSLARAGKVRGQTPKVAKQDKKKKPRGRAHKRMQYNRRFVTAVVGFGKKRGPNSSEK

SEQ ID NO: 9735 - protein, 77 aa, Brassica rapa
IASSSPPVKPRRFTVINHGEGSLARAGKVRGQTPKVAKQDKKKKPRGRAHKRLQHNRRFVTAVVGFGKKRGPNSSEK

SEQ ID NO: 9736 - protein, 86 aa, Beta vulgaris
HEGAFEDTESANNQPTSEQHHSPAMGKVFPRRARAGKVRGQTPKGAAQDKKKKPRGRAHKRMQYNRRFVTAVDGFGKKRGPNSSEK

SEQ ID NO: 9737 - protein, 63 aa, Cleome spinosa
MGKVHGSLARAGKVRGQTPKVAKQDKKKKPRGRAHKRMQYNRRFVTAVVGFGKKRDQTLLRSR

SEQ ID NO: 9738 - protein, 67 aa, Eutrema halophilum
LSLNHTGKVHGSLARAGKVRGQTPKVAKQDKKKQPRGRAHKRIQHNRRFVTAVVGFGKKRGPNSSEK

SEQ ID NO: 9739 - protein, 67 aa, Eutrema parvulum
ECVSIPGKVHGSLARAGKVRGQTPKVAKQDKKKQPRGRAHKRLQHNRRFVTAVVGFGKKRGPNSSEK

SEQ ID NO: 9740 - protein, 67 aa, Eutrema parvulum
FVGNVLGKVHGSLARAGKVRGQTPKVAKQDKKKQPRGRAHKRLQHNRRFVTAVVGFGKKRGPNSSEK

SEQ ID NO: 9741 - protein, 62 aa, Brassica napus
MGKVHGFLARAGKVRGQTPKVANPAQKKNPRGRAPKGMQYNRRFVTAVVGFAKKRGPNSSEK

SEQ ID NO: 9742 - protein, 69 aa, Selaginella moellendorffii
SFACAKRMSKVHGSLARAGKVRGQTPKVQKQDKKKKPKGRAHKREQYNRRFVTAVVGFGKKRGPNSSEK

SEQ ID NO: 9743 - protein, 69 aa, Triphysaria pusilla
KNRRSSRGFRVHGSLARAGKVRGQTPKVAKQDKKKNPRGRAHKRVQYNRRFVTAVVGFGKKRGPNSSEK

SEQ ID NO: 9744 - protein, 59 aa, Orobanche aegyptiaca
MGKVHGSLARAGKVRGQTPKVAKQDKKKQPRGRAHKRMQYNRRFVTAVVGFGRERTKLI

SEQ ID NO: 9745 - protein, 62 aa, Volvox carteri
MGKVHGSLARAGKVRGQTPKVPKQEKKKRPRGRAMKRMKYNRRFVNVVVGFGKKRGPNSNPA

SEQ ID NO: 9746 - protein, 70 aa, Chlamydomonas reinhardtii
LSSSTRIKMGKVHGSLARAGKVRGQTPKVPKQEKKKRPRGRAMKRMKYNRRFVNVVVGFGKKRGPNSNPA

SEQ ID NO: 9747 - protein, 75 aa, Nicotiana tabacum
  misc_feature (8)..(8): Xaa can be any naturally occurring amino acid
TRDACSSXSEKSSMGKVHGSLARAGKVRGQTPKVAKQDKKKKPRGRAHKRMQYNRRFVTAVVGFGKKRGPNSSEK

SEQ ID NO: 9748 - protein, 62 aa, Mesostigma viride
MGKVHGSLARAGKVRGQTPKVAKQEKKAKPCGRARKRAQYNRRFVNVVVGFGKKRGPNAAPE

SEQ ID NO: 9749 - protein, 62 aa, Triticum aestivum
  misc_feature (7)..(7): Xaa can be any naturally occurring amino acid
  misc_feature (22)..(22): Xaa can be any naturally occurring amino acid
  misc_feature (29)..(29): Xaa can be any naturally occurring amino acid
  misc_feature (31)..(31): Xaa can be any naturally occurring amino acid
  misc_feature (37)..(38): Xaa can be any naturally occurring amino acid
  misc_feature (40)..(40): Xaa can be any naturally occurring amino acid
  misc_feature (55)..(55): Xaa can be any naturally occurring amino acid
  misc_feature (58)..(58): Xaa can be any naturally occurring amino acid
  misc_feature (60)..(60): Xaa can be any naturally occurring amino acid
  misc_feature (62)..(62): Xaa can be any naturally occurring amino acid
MGKVHGXLARAGKVRGQTPKVXKQDKKKXPXGRAHKXXQXNRRFVTAVVGFGKKXGPXSXEX

SEQ ID NO: 9750 - protein, 115 aa, Malus domestica
MKKEEGGEDEEGEPGIQMKEEGGEQLSTHGQQLGKVERVKSKLATGKVHGSLARAGKVRGQTAKVVEQDKKKQPRGRAHKRCNTTVDPSSPWLASERRGDPTRLRSRANIQALKG

SEQ ID NO: 9751 - protein, 75 aa, Nicotiana benthamiana
RHEALLLQSEKLTMGKVHGSLARAGKVRGQTPKVAKQDKKKKPRGRAHKRMQYNRRFVSAVVGFGKKRGPNSSEK

SEQ ID NO: 9752 - protein, 75 aa, Allium cepa
KARSEREITSNSQWGKVHGSLARAGKVRGQTPKVAKQDKKKKPRGRAHKRMQYNRRFVTAVVGFGKKRGPNSSEK

SEQ ID NO: 9753 - protein, 95 aa, Aquilegia formosa
MGKVHGSLARAGKVRGQTPKVAKQDKKKKPRGRAHKRMQYNRRFVTAGKLFRSNLLSHILFIQIELTLLIIRFVLINLLIEICLGLTQLSKHTFD

SEQ ID NO: 9754 - protein, 62 aa, Mesostigma viride
MGKVHGFLARAGKVRGQTPKVAKQEKKGKPFGRARKRAQYNRRFVNVVVGFGKKRGPNAAPE

SEQ ID NO: 9755 - protein, 60 aa, Picea glauca
MGKVHGSLARAGKVRGQTPKVPKQDKKKVPKGRALKRIKYNRRFVNIVVGFGKKKGPNSQ

SEQ ID NO: 9756 - protein, 76 aa, Citrullus lanatus
NLFVNCVYSCFDRFSGKVHGSLARAGKVRGQTPKVAKQDKKKKPRGRAHKRMQYNRRFVTAVVGFGKKRGPNSSEK

SEQ ID NO: 9757 - protein, 76 aa, Citrullus lanatus
MFHISLFLHPCNQLSGKVHGSLARAGKVRGQTPKVAKQDKKKKPRGRAHKRMQYNRRFVTAVVGFGKKRGPNSSEK

SEQ ID NO: 9758 - protein, 300 aa, Glycine max
MRNLAAPHSLGVFIFRPNKPPFLTLPSLSRRSLPSIQCGAVQFRPCIDIHKGKVKQIVGSTLQDLKGSDPVTNFESDKSAAEYATLYKQDGLTGGHVIMLGADPLSKAAALQALHAYPGGLQVGGGINSDNCLSYIEEGASHVIVTSYVFNNGQMDIGRLKDLVQIVGKERLVLDLSCRKKDGKYAIVTDRWQKFSDVFVDPDVMEFLANFADEFLVHGVDVEGKKLGIDEELVALLGKYSTIPVTYAGGVTEMADLERIRTAGMERVNVTVGSALDIFGGNLAYEDVVAWHAQQNASVV

SEQ ID NO: 9759 - protein, 306 aa, Cajanus cajan
MRNLAAPRSFRLCINSPISRGNKLPSVTLNPLWTPSRTSPPSIQCAVQFRPCIDIHKGKVKQIVGSTLQDLKGSDPVTNFESDKSAAEYAALYKRDGLTGGHVIMLGADPFSKAAALQALHAYPGGLQVGGGINSDNCLSYIEEGASHVIVTSYVFNNGQMDLGRLKDLVQIVGKERLVFGSQLQKKDGKYAIVTDRWQKFSDVFVEPDVMQFLANFADEFLVHGVDVEGKKLGIDEELVALLGKHSPIPVTYAGGVTGMADLERIKTAGMGRVDVTVGSALDIFGGNLAYEEVVAWHTQQKASVV

SEQ ID NO: 9760 - protein, 308 aa, Vigna unguiculata
MMRNLSASHSFGLFVTSPIFCPNNLPAITLSSRSSRRSSPSIQCAVQFRPCIDIHKGKVKQIVGSTLQDLKGGDGSDPVTNFESDKSAAEYATLYRGDGLTGGHVIMLGADPLSKASALEALHAYPGGLQVGGGINADNCLSYIEEGASHVIVTSYVFNDGQMDIGRLKDLVQIVGKERLVLDLSCRKKDGKYAIVTDRWQKFSDVFVDPGVMEFLANFADEFLVHGVDVEGKKLGIDEELVALLGKHSPIPVTYAGGVTGMADLERIKSAGVGRVDVTVGSALDIFGGNLSYEEVVAWHVQQKAYVV

SEQ ID NO: 9761 - protein, 312 aa, Medicago truncatula
MRSPASTPSIRGGAFASSPILRHNHLPFLRLNPPSSSPTRSSPPSIQCSVQFRPCIDIHKGKVKQIVGSTLKDLKDDDGSDPITNFESDKSAAEYATLYKQDGLKGGHVIMLGADPFSKAASLEALHAYPGGLQVGGGINSDNCLSYIEEGASHVIVTSYVFNNGQMDLERLKDLVRIVGKERLVLDLSCRKKEGKYAIVTDRWQKFSDVSLDAKVMEFLANFADEFLVHGVDVEGKKLGIDEELVALLGKHSPIPVTYAGGVTVMDDLERIRTAGMDNVDVTVGSALDIFGGNLAYKDVVAWHNQQKVSVA

SEQ ID NO: 9762 - protein, 254 aa, Trigonella foenum-graecum
MFNSTSTPSIPGFPSSPILRPNHLPFLSLNLPSSSPRKKSSLSIQCSVQFRPCIDIHKGKVKQIVGSTLKDLKGDDGSDPITNFESDKSAAEYATLYKQDGLKGGHVIMLGADPLSKAASLEALHAYPGGLQVGGGINSDNCLSYIEEGASHVIVTSYVFNNGQMDLERLKDLVRIVGKERLVLDLSCRKKEGKYAIVTDRWQKFSDVSLDAEVMQFLANFADEFLVHGVDVEGRSWELMKSSWLCLASIHRFL

SEQ ID NO: 9763 - protein, 172 aa, Glycine max
MAQQPSPSSSPPRRKTPPPPQYVEVNCRSSGKTRRFAAGTDAGFAVALINRKLKGTLVAASHIEAVKDEEEPIAFGPTSLLSNFGEGWKLQTVTLTDLSSEVGDGQFQQMAMHTPGLVSGVPSPASRISNPISFVYLVKIMFAFILIFVLGAIFTLFLDNLPAFILFLKSIT

SEQ ID NO: 9764 - protein, 383 aa, Phaseolus coccineus
  misc_feature (122)..(122): Xaa can be any naturally occurring amino acid
MGIIRSMRSRSHRVVQEQEECVGDSMRQSCWANMPQELLREVLLRIEASEDMWPPRKSVVACAGVCRSWRQITKDIVKTPELSSKITFPISVKQPGPRENLLRCFIKRNRSTQTYYLFLSLXNTLAEDGKFLLAARKCRRPTCTDYIISLDADDMSKGSNSYVGKLRSNFLGTKFTIYDSQPPHSGARIMKSRSTRLVNLKQVSPKVPTGNYPVAHISYELNVLGSRGPRRMHCVMDSIPATAIEAGGVAPTQTEFSLNNIDMFPSFPFFRSKSNRVENSMSGPLVDQRDGMLVLKNKAPRWHEQLQCWCLNFHGRVTIASVKNFQLVASAENGPAGPEHDKIILQFGKVGKDLFTMDYRYPISAFQAFAMCLSSFDTKIACE

SEQ ID NO: 9765 - protein, 286 aa, Vigna unguiculata
  misc_feature (194)..(195): Xaa can be any naturally occurring amino acid
MGIIRSMRSRSHRVVQEQEECVGDSMRQSCWANMPQELLREVLLRIEASEDTWPPRKSVVACAGVCRSWRQITKDIVKTPELSSKITFPISVKQPGPRENLLRCFIKRNRSTQTYYLFLSLTNTLAEDGKFLLAARKCRRPTCTDYIISLDADDMSKGSNSYVGKLRSNFLGTKFTIYDSQPPHSGARIMKSRXXRLVNLKQVSPKVPTGNYPVAHISYELNVLGSRGPRRMHCVMDSIPATAIEAGGVAPTQTEFSLNNIDMFPSFPFFRSKSNRVENTMSGTPG

SEQ ID NO: 9766 - protein, 385 aa, Glycine max
MCLIRSMRSQSQRVVQEQEEAECVGDSMRQSCWANMPQELLREVLFRIEASEDAWPPRKSVVACAGVCRSWRQITIDIVKTPELSSKITFPISVKQPGPRENLLRCFIKRNRSSQTYYLYLSLTNTLAEDGKFLLAARKCRRPTCTDYIISLDADDMSKGSNSYVGKLRSNFLGTKFTIYDGQPPHAGAKIMKSRSTRLVNLKQVSPKVPTGNYPVAHISYELNVLGSRGPRRMHCVMDSIPAAAIEPGGVAPVQTEFSLNNIDMFPSFPFFRSKSNRVENSVSGPLVDQKDGMLVLKNKAPRWHEQLQCWCLNFHGRVTIASVKNFQLVASAENRPAGPEHDKIILQFGKVGKDLFTMDYRFPISAFQAFAICLSSFDTKIACE

SEQ ID NO: 9767 - protein, 393 aa, Medicago truncatula
MAIIRNIIEDMRSRSQRVVVAAEKEEKVAVGDSLRQSCWANMPQELLREVLLRIEASEDTWPPRKNVVACAGVCRSWRVITKEIVKKPEISAMITFPISVKQPGPRENLLQCFIKRNRSTQTYYLFLSLTSSLGDDGKFLLAARKCRRPTCTDYIISLDADDMSRGSNNYVGKLRSNFLGTKFTIYDGQPPHAGAKFTKSRSTRLVNLKQVSPKVPTGNYPVAHISYELNVLGSRGPRRMHCVMDSIPSSSIEPGGVAPTQTEFSLNNIEMFPLFPFFRSKSNRVVENSLSGPLVGDKKDGMLVLKNKAPRWHEQLQCWCLNFHGRVTIASVKNFQLVASAENGTAGPEHDKIILQFGKVGKDLFTMDFRYPISAFQAFAICLSSFDTKIACE

SEQ ID NO: 9768 - protein, 391 aa, Lotus japonicus
MAIIRSLIQDMRSRSQRVVVEEDAAAAVVVGDGLRQSCWANMPQELLREVLLRIEASEEKWPARKSVVACAGVCRSWREITKDIVKKPEFSSKLTFPISVKQPGPRENLLQCFISRNRTTQTYYLYLNLTSALCDDGKFLLAARKCRRPTCTDYIISLHADDMSRGSNAYVGKLRSNFLGTKFTIYDGQPPHAGAKITKSRSTRLVNLKQVSPKVPTGNYPIAHISYELNVLGSRGPRRMHCVMDSIPTSAIEPGGVAPTQTEFSLNNVDMFPSFPFFRSKSSRAENSLSGPLADKKDGTLVLKNKSPRWHEQLQCWCLNFHGRVTVASVKNFQLVASAENGPAGPEHDKIILQFGKIGKDLFTMDYRYPISAFQAFAICLSSFDTKIACE

SEQ ID NO: 9769 - protein, 388 aa, Manihot esculenta
MSAIRSMIIRSRSHRVVRDGPASEPEDWHGGDTSCWANMPQELLREVLLRIEASESSWPSRKSVVACAGVCRTWRHITKDLVKVPEFSGRLTFPISVKQPGPRDFLLQCFIRRCRSTQMYYLYLSLTNALTDDGKFLLAARKCRRPTFTDYIISLDADNMSKGSSTYVGKLRSNFLGTKFTVFDGQLPHAGAKMAKSRSTRLVNTKQVSPRVPAGNYPVAHISYELNVLGSRGPRKMQCTMDAIPATSIEPGGVAPTQTEFSHHSVDFFPSLPFFLSKSNRAEKFLSGPLSSQKDGALVLKNKAPRWHEQLQCWCLNFHGRVTVASVKNFQLVASPENGPAGPEHEKIILQFGKVGKDLFTMDYRYPISAFQAFAICLSSFDTKIACE

SEQ ID NO: 9770 - protein, 652 aa, Glycine max
MFDWNDEELANIVWGEAGESDDHIVPYPEASEDLNDKKEWNQEASATKLIEQRRIEAKTDFHQGKLGSSSKLDIIEGSSASESGTKSWPDLSLSNAAKTDQGSLGAEVSKNLEETTQLEKDVEKQGDFVNYAWDNIGSFDDLDRIFSNDDPIFGHVSLENSDELWSSKDVSNSAVPILLEAPNPTSALSNRSEPLEIKAEYVQQNDQSFSPRFKKIGNSSSHDIANAPANTFNVGYDRDRIAPADKEQQDFGQNNQLKARKKSQGKQEVKALQEFYGSWSPSSTTCGQFQNQQSSVIQSSPSSILGKRNQLQGPETLYQDIRNTYVTSSAYENLTNTYSSMSTLPQAQSGVLMRQPLLSGYEASLGVMNPVSKSVDLVKPLTMTPQEKIEKLRRRQQMQAMLAIQKQQQEFSHQVPSSNKSMNEKCAIEMHSQLCDGADPEIEDLRTTLDPPTEQDDSNTISLAIDDLFVEDTILYMLQDVISKLDVNIRLCIRDSLFRLAQSAMQRNYASDTSSTNNSSREELKVAAREERSSQNRYARIADVETKTNPIDRTVAHLLFHRPLDLTGNYPDKLESPISAKIQYESKEANLEKFPMGCLPDEDMKSNQQISPQVLEAQPQDQFKNSHCRDSSENASNNDLADAGDQVLEASQ

SEQ ID NO: 9771 - protein, 802 aa, Glycine max
VTRIRSSNLLLRPPPISIKPLYSPNFLILHRHRLRCVAESSNNHHHNHHHDHDHGHNHHHHHHHHHSHGIHGADLTGPQKAVIAFAKATRWMDLADILREHLHLCCFSTALFVAAAICPHTLPKPLIKPLQNSLIFVAFPLVGVSASLDALLEISSGKVNIHVLMAMAAFASIFMGNSLEGGLLLAMFNLAHIAEEYFTSRSMVDVRELKENNPDFALVLDTNDDKLPNTFDLAYKRVPVHDVTVGSYILVGAGESVPVDCEVFQGSATITTEHLTGEVKPLEAKVGDRIPGGARNLDGRIIVEVTKTWKESTLSRIVQLTEEAQSNKPKLQRWLDEFGERYSKVVVVLSIAIAVIGPFLFKWPFISTSACRGSIYRALGLMVAASPCALAVAPLAYAIAISSCARKGILLKGGHVLDALATCHTVAFDKTGTLTTGGLVFKAIEPIYGHHVRNNKSNVPSCCIPTCEKEALAVAAAMEKGTTHPIGRAVVDHSEGKDLPSISVESFEYFPGRGLTATVNSIESGTGGAKLLKASLGSIDFITSFCQSEVESEKIKEAVNTSSYGSEYVHAALSVNQKLVTLIHLEDRPRPGVSNVIQELQDEAKFRVMMLTGDHESSARRVASAVGINEFHCNLKPEDKLSHVKDISRDMGGGLIMVGEGINDAPALAAATVGIVLAHRASATAIAVADVLLLRENISAVPFCIAKSRQTTSLIKQNVALALTSIVMASLPSVLGFLPLWLTVLLHEGGTLLVCLNSVRALNEPSWSWKHDISHLISEIKSRLLSLKTNITGSNSIMTANL

SEQ ID NO: 9772 - protein, 120 aa, Cyamopsis tetragonoloba
MVQRLTYRKRHSYATKSNQHRVVKTPGGKLVYQSTKKRASGPKCPVTGKRIQGIPHLRPAEYKRSRLPRNRRTVNRAYGGVLSGGAVRERIIRAFLVEEQKIVKKVLKIQKAKEKQASKS

SEQ ID NO: 9773 - protein, 120 aa, Glycyrrhiza uralensis
MVQRLTYRKRHSYATKSNQHRVVKTPGGKLVYQTTKKRASGPKCPVTGKRIQGIPHLRPAEYKRSRLPRNRRTVNRAYGGVLSGGAVRERIIRAFLVEEQKIVKKVLKIQKAKEKQASKA

SEQ ID NO: 9774 - protein, 120 aa, Quercus alba
MVQRLTYRKRHSYATKSNQHRVVKTPGGKLVYQTTKKRASGPKCPVTGKRIQGIPHLRPAEYKRSRLPRNRRTVNRAYGGVLSGGAVRERIIRAFLVEEQKIVKKVLKIQKAKEKIASKS

SEQ ID NO: 9775 - protein, 120 aa, Cajanus cajan
MVQRLTYRKRHSYATKSNQHRVVKTPGGKLVYQTTKKRASGPKCPVTGKRIQGIPHLRPAEYKRSRLPRNRRTVNRAYGGVLSGGAVRERIIRAFLVEEQKIVKKVLKIQKAKDKQASKS

SEQ ID NO: 9776 - protein, 120 aa, Unknown
  Sequence found in Organisms: Cucumis sativus, Cucurbita pepo, Momordica charantia
MVQRLTYRKRHSYATKSNQHRVVKTPGGKLVYQTTKKRASGPKCPVTGKRIQGIPHLRPAEYKRSRLARNRRTVNRAYGGVLSGGAVRERIIRAFLVEEQKIVKKVLKIQKAKEKLASKS

SEQ ID NO: 9777 - protein, 120 aa, Eucalyptus grandis
MVQRLTYRKRHSYATKSNQHRVVKTPGGKLVYQTTKKRASGPKCPVTGKRIQGIPHLRPAEYKRSRLSRNRRTVNRAYGGVLSGGAVRERIIRAFLVEEQKIVKKVLKIQKAKEKLASKS

SEQ ID NO: 9778 - protein, 120 aa, Theobroma cacao
MVQRLTYRTRHSYATKSNQHRVVKTPGGKLVYQTTKKRASGPKCPVTGKRIQGIPHLRPAEYKRSRLPRNRRTVNRAYGGVLSGGAVRERIIRAFLVEEQKIVKKVLKIQKTKEKQASKS

SEQ ID NO: 9779 - protein, 120 aa, Castanea mollissima
MVQRLTYRKRHSYATKSNQHRVVKTPGGKLVYQTTKKRASGPKCPVTGKRIQGIPHLRPAEYKRSRLPRNRRTVNRAYGGVLSGSAVRERIIRAFLVEEQKIVKKVLKIQKAKEKIASKS

SEQ ID NO: 9780 - protein, 120 aa, Unknown
  Sequence found in Organisms: Castanea mollissima, Quercus alba
MVQRLTYRKRHSYATKSNQHRVVKTPGGKLVYQTTKKRASGPKCPVTGKRIQGIPHLRPAEYKRSRLPRNRRTVNRAYGGVLSGSAVRERIIRAFLVEEQKIVKKVLKIQKTKEKQASKS

SEQ ID NO: 9781 - protein, 120 aa, Vitis vinifera
MVQRLTYRKRHSYATKSNQHRVVKTPGGKLVYQSTKKRANGPKCPVTGKRIQGIPHLRPAEYKRSRLPRNRRTVNRAYGGVLSGGAVRERIIRAFLVEEQKIVKKVLKIQKAKEKQASKS

SEQ ID NO: 9782 - protein, 120 aa, Hevea brasiliensis
MVQRLTYRKRHSYATKSNQHRVVKTPGGKLVYQTTKKRASGPKCPVTGKRIQGIPHLRPAEYKRSRLARNRRTVNRAYGGVLSGGAVRERIIRAFLVEEQKIVKKVLKIQKAKEKQASRS

SEQ ID NO: 9783 - protein, 120 aa, Lotus japonicus
MVQRLTYRKRHSYATKSNQHRVVKTPGGKLVYQTTKKRASGPKCPVTGKRIQGIPHLRPTEYKRSRLPRNRRTVNRAYGGVLSGGAVRERIIRAFLVEEQKIVKKVLKIQKAKEKQASKA

SEQ ID NO: 9784 - protein, 120 aa, Arachis hypogaea
MVQRLTYRKRHSYATKSNQHRVVKTPGGKLVYQSTKKRASGPKCPVTGKRIQGIPHLRPAEYKRSRLPRNRRTVNRAYGGVLSGGAVRERIIRAFLVEEQKIVKKVLKIQKAKEKQASRS

SEQ ID NO: 9785 - protein, 120 aa, Populus trichocarpa
MVQRLTYRKRHSYATKSNQHRVVKTPGGKLVYQTTKKRASGPKCPVTGKRIQGIPHLRPAEYKRSRLSRNRRTVNRAYGGVLSGSAVRERIIRAFLVEEQKIVKKVLKIQKAKEKQASKS

SEQ ID NO: 9786 - protein, 120 aa, Glycine max
MVQRLTYRKRHSYATKSNQHRVVKTPGGKLVYQTTKKRASGPKCPVTGKRIQGIPHLRPAEYKRSRLPRNRRTVNRAYGGVLSGSAVRERIIRAFLVEEQKIVKKVLKIQKAKEKQASKA

SEQ ID NO: 9787 - protein, 120 aa, Unknown
  Sequence found in Organisms: Citrus sinensis, Citrus clementina, Citrus sinensis
MVQRLTYRKRHSYATKSNQHRVVKTPGGKLVYQSTKKRASGPKCPVTGKRIQGIPHLRPAEYKRSRLPRNRRTVNRAYGGVLSGAAVRERIIRAFLVEEQKIVKKVLKIQKAKEKQAAKS

SEQ ID NO: 9788 - protein, 120 aa, Unknown
  Sequence found in Organisms: Euphorbia peplus, Citrullus lanatus
MVQRLTYRKRHSYATKSNQHRVVKTPGGKLVYQTTKKRASGPKCPVTGKRIQGIPHLRPAEYKRSRLARNRRTVNRAYGGVLSGGAVRERIIRAFLVEEQKIVKKVLKIQKAKEKLAAKS

SEQ ID NO: 9789 - protein, 120 aa, Flaveria ramosissima
MVQRLTYRKRHSYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKIQKAKEKQAGKS

SEQ ID NO: 9790 - protein, 120 aa, Flaveria ramosissima
MVQRLTYRKRHSYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKIQKAKEKTASKS

SEQ ID NO: 9791 - protein, 120 aa, Lippia dulcis
MVQRLTYRTRHSYATKSNQHRVVKTPGGKLVYQTTKKRASGPKCPVTGKRIQGIPHLRPAEYKRSRLPRNRRTVNRPYGGVLSGGAVRERIIRAFLVEEQKIVKKVLKIQKAKEKLASKS

SEQ ID NO: 9792 - protein, 120 aa, Lippia dulcis
MVQRLTYRKRHSYATKSNQHRVVKTPGGKLVYQTTKKRASGPKCPVTGKRIQGIPHLRPAEYKRSRLSRNRRTVNRAYGGVLSGGAVRERIIRAFLVEEQKIVKKVLKIQKAKEKVAGKS

SEQ ID NO: 9793 - protein, 120 aa, Bruguiera gymnorhiza
  misc_feature (71)..(71): Xaa can be any naturally occurring amino acid
MVQRLTYRKRHSYATKSNQHRVVKTPGGKLVYQTTKKRASGPKCPVTGKRIQGIPHLRPAEYKRSRLPRNXRTVNRAYGGVLSGGAVRERIIRAFLVEEQKIVKKVLKIQKAKEKQALKG

SEQ ID NO: 9794 - protein, 120 aa, Theobroma cacao
MVQRLTYRTRHSYATKSNQHRIVKTPGGKLVYQTTKKRASGPKCPVTGKRIQGIPHLRPAEYKRSRLPRNRRTVNRAYGGVLSGGAVRERIIRAFLVEEQKIVKKVLKIQKAKEKQSSKS

SEQ ID NO: 9795 - protein, 120 aa, Theobroma cacao
MVQRLTYRTRHSYATKSNQHRVVKTPGGKLVYQTTKKRASGPKCPVTGKRIQGIPHLRPAEYKRSRLPRNRRTVNRAYGGVLSGSAVRERIIRAFLVEEQKIVKKVLKIQKTKEKQASKS

SEQ ID NO: 9796 - protein, 120 aa, Manihot esculenta
MVQRLTYRKRHSYATKSNQHRVVKTPGGKLVYQTTKKRASGPKCPVTGKRIQGIPHLRPAEYKRSRLARNRRTVNRAYGGVLSGSAVRERIIRAFLVEEQKIVKKVLKIQKAKEKQASRS

SEQ ID NO: 9797 - protein, 120 aa, Manihot esculenta
MVQRLTYRKRHSYATKSNQHRIVKTPGGKLVYQTTKKRASGPKCPVTGKRIQGIPHLRPAEYKRSRLARNRRTVNRAYGGVLSGGAVRERIIRAFLVEEQKIVKKVLKIQKAKEKQASRS

SEQ ID NO: 9798 - protein, 120 aa, Vigna unguiculata
MVQRLTYRKRHSYATKSNQHRVVKTPGGKLVYQSTKKRASGPKCPVTGKRIQGIPHLRPAEYKRSRLSRNRRTVNRAYGGVLSGGAVRERIIRAFLVEEQKIVKKVLKIQKAKEKQAAKS

SEQ ID NO: 9799 - protein, 120 aa, Unknown
  Sequence found in Organisms: Cucumis sativus, Cucumis melo
MVQRLTYRKRHSYATKSNQHRVVKTPGGKLVYQTTKKRASGPKCPVTGKRIQGIPHLRPAEYKRSRLARNRRTVNRAYGGVLSGSAVRERIIRAFLVEEQKIVKKVLKIQKAKEKLASKS

SEQ ID NO: 9800 - protein, 120 aa, Cyamopsis tetragonoloba
MVQRLTYRKRHSYATKSNQHRVVKTPGGKLVYQSTKKRASGPKCPVTGKRIQGIPHLRPAEYKRSRLPRNRRTVNRAYGGVLSGGAVRERIIRAFLVEEQKIVKKVLKIQKAKEKLASKA

SEQ ID NO: 9801 - protein, 120 aa, Panax ginseng
MAQRLTYRKRHSYATKSNQHRVVKTPGGKLVYQTTKKRASGPKCPVTGKRIQGIPHLRPAEYKRSRLSRNRRTVNRAYGGVLSGGAVRERIIRAFLVEEQKIVKKVLKIQKSKEKQASKS

SEQ ID NO: 9802 - protein, 120 aa, Heritiera littoralis
MVQRLTYRTRHSYATKSNQHRVLKTPGGKLVYQTTKKRASGPKCPVTGKRIQGIPHLRPAEYKRSRLPRNRRTVNRAYGGVLSGSAVRERIIRAFLVEEQKIVKKVLKIQKAKEKQASKS

SEQ ID NO: 9803 - protein, 120 aa, Ipomoea nil
MVQRLTYRKRHSYATKSNQHRVVKTPGGKLVYQTTKKRASGPKCPVTGKRIQGIPHLRPAEYKRSRLPRNRRTVNRPYGGVLSGGAVRERIIRAFLVEEQKIVKKVLKIQKAKEKQAGKN

SEQ ID NO: 9804 - protein, 120 aa, Ipomoea nil
MVQRLTYRKRHSYATKSNQHRVVKTPGGKLVYQTTKKRASGPKCPVTGKRIQGIPHLRPAEYKRSRLSRNRRTVNRPYGGVLSGGAVRERIIRAFLVEEQKIVKKVLKIQKAKEKQAGKS

SEQ ID NO: 9805 - protein, 120 aa, Jatropha curcas
MVQRLTYRKRHSYATKSNQHRVVKTPGGKLVYQTTKKRASGPKCPVTGKRIQGVPHLRPAEYKRSRLSRNRRTVNRAYGGVLSGGAVRERIIRAFLVEEQKIVKKVLKIQKAKEKQASRS

SEQ ID NO: 9806 - protein, 119 aa, Populus trichocarpa
MVQRLTYRKRHSYATKSNQHRVVKTPGGKLVYQTTKKRASGPKCPVTGKRIQGIPHLRPAEYKRSRLSRNRRTVNRAYGGVLSGSAVRERIIRAFLVEEQKIVKKVLKIQKAKEKQASK

SEQ ID NO: 9807 - protein, 120 aa, Prunus persica
MVQRLTYRTRHSYATKSNQHRIVKTPGGKLVYQTTKKRASGPKCPVTGKRIQGIPHLRPAEYKRSRLSRNRRTVNRAYGGVLSGGAVRERIIRAFLVEEQKIVKKVLKIQKAKEKQASKS

SEQ ID NO: 9808 - protein, 120 aa, Salvia sclarea
MVQRLTYRKRHSYATKSNQHRVVKTPGGKLVYQTTKKRASGPKCPVTGKRIQGIPHLRPAEYKRSRLSRNRRTVNRAYGGVLSGGAVRERIIRAFLVEEQKIVKKVLKIQKAKEKAAGKS

SEQ ID NO: 9809 - protein, 120 aa, Eucalyptus grandis
MVQRLTYRKRHSYATKSNQHRVVKTPGGKLVYQTTKKRASGPKCPVTGKRIQGIPHLRPAEYKRSRLSRNRRTVNRAYGGVLSGGAVRERIIRAFLVEEQKIVKKVLKIQKAKEKLASKN

SEQ ID NO: 9810 - protein, 120 aa, Unknown
  Sequence found in Organisms: Ambrosia trifida, Flaveria ramosissima, Helianthus annuus
MVQRLTYRKRHSYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKIQKAKEKTASKA

SEQ ID NO: 9811 - protein, 120 aa, Ambrosia trifida
MVQRLTYRKCHSYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKIQKAKEKTASKS

SEQ ID NO: 9812 - protein, 120 aa, Amsonia hubrichtii
MVQRLTYRKRHSYATKSNQHRVVKTPGGKLVYQSTKKRASGPKCPVTGKRIQGIPHLRPAEYKRSRLSRNRRTVNRAYGGVLSGGAVRERIIRAFLVEEQKIVKKVLKIQKAKEKLAAKS

SEQ ID NO: 9813 - protein, 120 aa, Cirsium arvense
MVQRLTYRKRHSYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKIQKLKEKTASKS

SEQ ID NO: 9814 - protein, 120 aa, Unknown
  Sequence found in Organisms: Cirsium arvense, Tragopogon dubius
MVQRLTYRKRHSYATKSNQHRVVKTPGGKLVYQTTKKRASGPKCPITGKRIQGIPHLRPAEYKRSRLSRNRRTVNRAYGGVLSAGAVRERIIRAFLVEEQKIVKKVLKIQKAKEKTASKS

SEQ ID NO: 9815 - protein, 120 aa, Unknown
  Sequence found in Organisms: Citrus sinensis, Citrus clementina, Citrus sinensis
MVQRLTYRTRHSYATKSNQHRVVKTPGGKLVYQSTKKRASGPKCPVTGKRIQGIPHLRPAEYKRSRLSRNRRTVNRAYGGVLSGGAVRERIIRAFLVEEQKIVKKVLKIQKAKEKLASKS

SEQ ID NO: 9816 - protein, 120 aa, Cucurbita pepo
MVQRLTYRKRHSYATKSNQHRVVKTPGGKLVYQTTKKRASGPKCPVTGKRIQGIPHLRPAEYKRSRLARNRRTVNRAYGGVLSGGAVRERIIRAFWLEEQKIVKKVLKIQKAKEKLASKS

SEQ ID NO: 9817 - protein, 120 aa, Unknown
  Sequence found in Organisms: Flaveria ramosissima, Helianthus annuus, Tragopogon dubius
MVQRLTYRKRHSYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKIQKTKEKQAGKS

SEQ ID NO: 9818 - protein, 120 aa, Lippia dulcis
MVQRLTYRKRHSYATKSNQHRVVKTPGGKLVYQTSKKRASGPKCPVTGKRIQGIPHLRPAEYKRSRLPRNRRTVNRPYGGVLSGKAVRERIIRAFLVEEQKIVKKVLKIQKAKEKQASKI

SEQ ID NO: 9819 - protein, 120 aa, Platanus occidentalis
MVQRLTYRKRHSYATKSNQTRVVKTPGGKLVYQTTKKRASGPKCPVTGKRIQGIPHLRPAEYKRSRLSRNRRTVNRAYGGVLSGSAVRERIIRAFLVEEQKIVKKVLKIQKAKEKQTSKS

SEQ ID NO: 9820 - protein, 120 aa, Platanus occidentalis
MVQRLTYRKRHSYATKSNQTRVVKTPGGKLVYQTTKKRASGPKCPVTGKRIQGIPHLRPAEYKRSRLARNRRTVNRAYGGVLSGSAVRERIIRAFLVEEQKIVKKVLKIQKAKEKQTSKS

SEQ ID NO: 9821 - protein, 120 aa, Sarracenia psittacina
MVQRLTYRKRHSYATKSNQNRVVKTPGGRLVYQSTKKRASGPKCPVTGKRIQGIPHLRPAEYKRSRLSRNRRTVNRAYGGVLSGGAVRERIIRAFLVEEQKIVKKVLKIQKAKEKQASKS

SEQ ID NO: 9822 - protein, 120 aa, Tabernaemontana elegans
MAQRLTYRKRHSYATKSNQHRVVKTPGGKLVYQSTKKRASGPKCPVTGKRIQGIPHLRPAEYKRSRLPRNRRTVNRAYGGVLSGSAVRERIIRAFLVEEQKIVKKVLKIQKAKEKLASKS

SEQ ID NO: 9823 - protein, 120 aa, Thalictrum flavum
MVQRLTYRKRHSYATKSNQNRVVKTPGGKLVYQTTKKRASGPKCPVTGKRIQGIPHLRPAEYKRSRLSRNRRTVNRAYGGVLSGGAVRERIIRAFLVEEQKIVKKVLKIQKAKEKTAPKS

SEQ ID NO: 9824 - protein, 120 aa, Unknown
  Sequence found in Organisms: Solanum lycopersicum, Solanum melongena
MVQRLTYRKRHSYATKSNQHRIVKTPGGKLIYQTTKKRASGPKCPVTGKRIQGIPHLRPAEYKRSRLPRNRRTVNRAYGGVLSGSAVRERIIRAFLVEEQKIVKKVLKIQKAKEKLASKS

SEQ ID NO: 9825 - protein, 120 aa, Trigonella foenum-graecum
MVQRLTYRRRHSYATKSNQHRVVKTPGGKLVYQTTKKRASGPKCPVTGKRIQGIPHLRPTEYKRSRLPRNRRTVNRAYGGVLSGGAVRERIIRAFLVEEQKIVKKVLKIQKTKEKQASKA

SEQ ID NO: 9826 - protein, 120 aa, Tripterygium wilfordii
MVQRLTYRKRHSYATKSNQHRVVKTPGGKLVYQSTKKRASGPKCPVTGKRIQGIPHLRPAEYKRSRLSRNRRTVNRAYGGVLSGSAVRERIIRAFLVEEQKIVKKVLKIQKAKEKIASKS

SEQ ID NO: 9827 - protein, 120 aa, Citrullus lanatus
MVQRLTYRKRHSYATKSNKHRVVKTPGGKLVYQTTKKTASGPKCPVTGKRIQGIPHLRPAEYKRSRLARNRRTVNRAYGGVLSGGAVRERIIRAFLVEEQKIVKKVLKIQKAKEKLASKS

SEQ ID NO: 9828 - protein, 120 aa, Citrullus lanatus
MVQRLTYRKRHSYATKSNQHRVVKTPGGKLIYQTTKKRASGPKCPVTGKRIQGIPHLRPAEYKRSRLARNRRTVNRAYGGVLSGSAVRERIIRAFLVEEQKIVKKVLKIQKAKEKLASKS

SEQ ID NO: 9829 - protein, 120 aa, Phaseolus coccineus
MVQRLTYRKRHSYATKSNQHRVVKTPGGKLVYQTTKKRASGPKCPVTGKRIQGIPHLRPAEYKRSRLPRNRRTVNRAYGGVLSGSAVRERIIRAFLVEEQKIVKKVLKIQKTKEKQALKG

SEQ ID NO: 9830 - protein, 120 aa, Manihot esculenta
MVQRLTYRKRHSYATKSNQHRIVKTPGGKLVYQTTKKRASGPKCPVTGKRIQGIPHLRPAEYKRSRLSRNRRTVNRAYGGVLSGSAVRERIIRAFLVEEQKIVKKVLKIQKAKEKQASRS

SEQ ID NO: 9831 - protein, 120 aa, Ricinus communis
MVQRLTYRKRHSYATKSNQHRIVKTPGGKLVYQTTKKRASGPKCPVTGKRIQGIPHLRPAEYKRSRLSRNRRTVNRAYGGVLSGGAVRERIIRAFLVEEQKIVKKVLKIQKAKEKQSSRS

SEQ ID NO: 9832 - protein, 120 aa, Cichorium intybus
MVQRLTYRKRHSYATKSNQHRVVKTPGGKLVYQTTKKRASGPKCPVTGKRIQGIPHLRPTEYKRSRLSRNRRTVNRAYGGVLSAGAVRERIIRAFLVEEQKIVKKVLKIQKAKEKTASKS

SEQ ID NO: 9833 - protein, 120 aa, Coffea canephora
MVQRLTYRKRHSYATKSNQHRVVKTPGGKLVYQTTKKRASGPKCPVTGKRIQGIPHLRPAEYKRSRLARNRRTVNRAYGGVLSGSAVRERIIRAFLVEEQKIVKKVLKIQKAKEKLAAKS

SEQ ID NO: 9834 - protein, 120 aa, Gossypium hirsutum
MVQRLTYRTRHSYATKSNQHRVVKTPGGKLVYQTTKKRASGPKCPVTGKRIQGIPHLRPAEYKRSRLPRNRRTVNRAYGGVLSGSAVRERIIRAFLVEEQKIVKKVLKIQKAKEKVSSKS

SEQ ID NO: 9835 - protein, 120 aa, Gossypium hirsutum
MVQRLTYRTRHSYATKSNQHRVVKTPGGKLVYQTTKKRASGPKCPVTGKRIQGIPHLRPAEYKRSRLPRNRRTVNRAYGGVLSCSAVRERIIRAFLVEEQKIVKKVLKIQKSKEKQASKS

SEQ ID NO: 9836 - protein, 120 aa, Vigna unguiculata
MVQRLTYRKRHSYATKSNQHRVVKTPGGKLVYQSTKKRASGPKCPVTGKRIQGIPHLRPAEYKRSRLPRNRRTVNRAYGGVLSGSAVRERIIRAFLVEEQKIVKKVLKIQKAKEKQALKG

SEQ ID NO: 9837 - protein, 120 aa, Cynara scolymus
MVQRLTYRKRHSYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKIQKAKEKTASRS

SEQ ID NO: 9838 - protein, 120 aa, Eucalyptus grandis
MVQRLTYKKRHSYATKSNQHRVVKTPGGKLVYQTTKKRASGPKCPVTGKRIQGIPHLRPAEYKRSRLSRNRRTVNRAYGGVLSGGAVRERIIRAFLVEEQKIVKKVLKIQKAKEKLASKN

SEQ ID NO: 9839 - protein, 120 aa, Hevea brasiliensis
MVQRLTYRKRHSYATKSNQHRVVKTPGGKLVYQTTKKRASGPKCPVTGKRIQGIPHLRPAEYKRSRLSRNRRTVNRAYGGVLSGGAVRERIIRAFLVEEQKIVKKVLKIQKAKEKQSSRT

SEQ ID NO: 9840 - protein, 120 aa, Ipomoea batatas
MVQRLTYRKRHSYATKSNQHRIVKTPGGKLVYQTTKKRASGPKCPVTGKRIQGIPHLRPAEYKRSRLSRNRRTVNRPYGGVLSGGAVRERIIRAFLVEEQKIVKKVLKIQKAKEKQAGKS

SEQ ID NO: 9841 - protein, 120 aa, Ipomoea nil
MVQRLTYRKRHSYATKSNQHRVVKTPGGKLVYQTTKKRASGPKCPVTGKRIQGIPHLRPAEYKRSRLPRCRRTVNRPYGGVLSGSAVRERIIRAFLVEEQKIVKKVLKIQKAKEKQASKA

SEQ ID NO: 9842 - protein, 120 aa, Actinidia deliciosa
MVQRLTYRKRHSYATKSNQHRIVKTPGGKLVYQSTKKRASGPKCPVTGKRIQGIPHLRPTEYKRSRLSRNRRTVNRAYGGVLSGGAVRERIIRAFLVEEQKIVKKVLKIQKAKEKQASKS

SEQ ID NO: 9843 - protein, 120 aa, Liriodendron tulipifera
MVQRLTYRKRHSYATKSNQTRVVKTPGGKLVYQTTKKRASGPKCPVTGKRIQGIPHLRPAEYKRSRLSRNRRTVNRAYGGVLSGGAVRERIIRAFLVEEQKIVKKVLKIQKAKEKLSSKS

SEQ ID NO: 9844 - protein, 120 aa, Medicago truncatula
MVQRLTYRRRHSYATKSNQHRVVKTPGGKLVYQTTKKRASGPKCPVTGKRIQGIPHLRPTEYKRSRLPRNRRTVNRAYGGVLSGGAVRERIIRAFLVEEQKIVKKVLKIQKTKEKQAAKS

SEQ ID NO: 9845 - protein, 120 aa, Medicago truncatula
MVQRLTYRRRHSYATKSNQHRVVKTPGGKLVYQTTKKRASGPKCPVTGKRIQGIPHLRPTEYKRSRLPRNRRTVNRAYGGVLSGGAVRERIIRAFLVEEQKIVKKVLKIQKAKEKVASKA

SEQ ID NO: 9846 - protein, 120 aa, Elaeis guineensis
MVQRLTYRKRHSYATKSNQTRVVKTPGGRLVYQYTKKRASGPKCPVTGKRIQGIPHLRPAEYKRSRLPRNRRTVNRAYGGVLSGSAVRERIIRAFLVEEQKIVKKVLKIQKAKEKQASKS

SEQ ID NO: 9847 - protein, 120 aa, Arachis hypogaea
MVQRLTYRKRHSYATKSNQHRVVKTPGGKLVYQTTKKRASGPKCPVTGKRIQGIPHLRPAEYKRSRLPRNRRTVNRAYGGVLSGSAVRERIIRAFLVEEQKIVKKVLKIQKAKEKQSLKG

SEQ ID NO: 9848 - protein, 120 aa, Capsicum annuum
MVQRLTYRKRHSYATKSNQHRVVKTPGGKLIYQTTKKRASGPKCPVTGKRIQGIPHLRPAEYKRSRLPRNRRTVNRAYGGVLSGSAVRERIIRAFLVEEQKIVKKVLKIQKAKEKLAAKS

SEQ ID NO: 9849 - protein, 120 aa, Capsicum annuum
MVQRLTYRKRHSYATKSNQHRVVKTPGGKLIYQATKKRASGPKCPVTGKRIQGIPHLRPAEYKRSRLPRNRRTVNRAYGGVLSGSAVRERIIRAFLVEEQKIVKKVLKIQKAKEKLASKS

SEQ ID NO: 9850 - protein, 120 aa, Cajanus cajan
MVQRLTYRKRHSYATKSNQHRVVKTPGGKLVYQTTKKRASGPKCPVTGKRIQGIPHLRPAEYKRSRLPRNRRTVNRAYGGVLSGSAVRERIIRAFLVEEQKIVKKVLKIQKAKEKQTLKA

SEQ ID NO: 9851 - protein, 120 aa, Cajanus cajan
MVQRLTYRKRHSYATKSNQHRVVKTPGGKLVYQTTKKRASGPKCPVTGKRIQGIPHLRPAEYKRSRLPRNRRTVNRAYGGVLSGSAVRERIIRAFLVEEQKIVKKVLKIQKSKEKQALKG

SEQ ID NO: 9852 - protein, 120 aa, Populus trichocarpa
MVQRLTYRKRHSYATKSNQHRVVKTPGGKLIYQTTKKRASGPKCPVTGKRIQGIPHLRPAEYKRSRLSRNRRTVNRAYGGVLSGSAVRERIIRAFLVEEQKIVKKVLKIQKSKEKQASKS

SEQ ID NO: 9853 - protein, 120 aa, Salvia sclarea
MVQRLTYRKRHSYATKSNQHRVVKTPGGKLVYQTTKKRASGPKCPVTGKRIQGIPHLRPAEYKRSRLSRNRRTVNRAYGGVLSGSAVRERIIRAFLVEEQKIVKKVLKIQKAKEKTAAKS

SEQ ID NO: 9854 - protein, 120 aa, Salvia sclarea
MVQRLTYRKRHSYATKSNQHRVVKTPGGKLVYQTTKKRASGPKCPVTGKRIQGIPHLRPAEYKRSRLSRNRRTVNRAYGGVLSGSAVRERIIRAFLVEEQKIVKKVLKIQKAKEKAAGKS

SEQ ID NO: 9855 - protein, 120 aa, Fragaria vesca
MVQRLTYRSRHSYATKSNQHRVVKTPGGKLVYQTTKKRASGPKCPVTGKRIQGIPHLRPAEYKRSRLSRNRRTVNRAYGGVLSGGAVRERIIRAFLVEEQKIVKKVLKIQKAKERQAAKS

SEQ ID NO: 9856 - protein, 120 aa, Eucalyptus grandis
MVQRLTYRKRHSYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKIQKAKDKLASKS

SEQ ID NO: 9857 - protein, 106 aa, Ambrosia trifida
MVQRLTYRKRHSYATKSNQHRVVKTPGGKLVYQTTKKRASGPKCPVTGKRIQGIPHLRPAEYKRSRLSRNRRTVNRAYGGVLSAGAVRERIIRAFLVKNKRLLRRF

SEQ ID NO: 9858 - protein, 61 aa, Flaveria ramosissima
PPIDNRFNVSRIANAIAMPPNQTSIGSSKPLVVSLFIRPLRRGLADPNAPSPAKESKGFLI

SEQ ID NO: 9859 - protein, 121 aa, Malus domestica
MVQRLTYRTRHSYATKSNQHRIVKTPGGKLVYQTSKKRASGPKCPVTGKRIQGIPHLRPAEYKRSRLSRNRRTVNRAYGGVLSGGAVRERIIRAFLVEEQKIVKKVLKIQKAKEKQASKSK

SEQ ID NO: 9860 - protein, 102 aa, Flaveria ramosissima
MVQRLTYRKRHSYATKSNQHRVVKTPGGKLVYQTTKKRASGPKCPVTGKRIQGIPHLRPAEYKRSRLSRTGEQLTVPMVACYLLVLCVRGSSEPSWLKSKRL

SEQ ID NO: 9861 - protein, 108 aa, Fraxinus spp
MPLNPTNTGSSKTPGGKLVYQSTKKRASGPKCPVTGKRIQGIPHLRPAEYKRSRLSRNRRTVNRAYGGVLSGGAVRERIIRAFLVEEQKIVKKVLKIQKAKEKLSSKS

SEQ ID NO: 9862 - protein, 102 aa, Lippia dulcis
MVQRLTYRKRHSYATKSNQHRVVKTPGGKLVYQTTKKRASGPKCPVTGKRIQGIPHLRPAEYKRSRLSRNRRTVNRAYGGVLSGGAVRERIIRASWWKNKRS

SEQ ID NO: 9863 - protein, 108 aa, Lactuca sativa
MPPSRINIGVVKTPGGKLVYQTTKKRASGPKCPVTGKRIQGIPHLRPTEYKRSRLSRNRRTVNRAYGGVLSAGAVRERIIRAFLVEEQKIVKKVLKIQKAKEKTAGKS

SEQ ID NO: 9864 - protein, 120 aa, Unknown
  Sequence found in Organisms: Ambrosia trifida, Arnica chamissonis
MVQRLTYRKRHSYATKSNQHRVVKTPGGKLVYQTTKKRASGPKCPVTGKRIQGIPHLRPTEYKRSRLSRNRRTVNRAYGGVLSAGAVRERIIRAFLVEEQKIVKKVLKIQKAKEKTASKA

SEQ ID NO: 9865 - protein, 120 aa, Unknown
  Sequence found in Organisms: Ambrosia trifida, Taraxacum officinale, Lactuca sativa
MVQRLTYRKRHSYATKSNQHRVVKTPGGKLVYQTTKKRASGPKCPVTGKRIQGIPHLRPTEYKRSRLSRNRRTVNRAYGGVLSAGAVRERIIRAFLVEEQKIVKKVLKIQKTKEKQAGKS

SEQ ID NO: 9866 - protein, 120 aa, Amsonia hubrichtii
MVQRLTYRKRHSYATKSNQHRIVKTPGGKLVYQSTKKRASGPKCPVTGKRIQGIPHLRPAEYKRSRLSRNRRTVNRAYGGVLSGSAVRERIIRAFLVEEQKIVKKVLKIQKAKEKLASKS

SEQ ID NO: 9867 - protein, 120 aa, Amsonia hubrichtii
MVQRLTYRKRHSYATKSNQHRVVKTPGGKLVYQSTKKRASGPKCPVTGKRIQGIPHLRPAEYKRSRLSRNRRTVNRAYGGVLSGGAVRERIVRAFLVEEQKIVKKVLKIQKAKEKLAAKS

SEQ ID NO: 9868 - protein, 120 aa, Catharanthus roseus
MVQRLTYRKRHSYATKSNQHRVVKTPGGKLVYQSTKKRASGPKCPVTGKRIQGIPHLRPAEYKRSRLSRNRRTVNRPYGGVLSGGAVRERIIRAFLVEEQKIVKKVLKIQKAKEKLAAKS

SEQ ID NO: 9869 - protein, 120 aa, Cirsium arvense
MVQRLTYRKRHSYATKSNQHRVVKTPGGRLVYQTTKKRASGPKCPVTGKRIQGIPHLRPAEYKRSRLSRNRRTVNRAYGGVLSAGAVRERIIRAFLVEEQKIVKKVLKIQKAKEKTANKS

SEQ ID NO: 9870 - protein, 120 aa, Cirsium arvense
MVQRLTYRKRHSYATKSNQHRVVKTPGGKLVYQTTKKRASGPKCPITGKRIQGIPHLRPAEYKRSRLSRNRRTVNRAYGGVLSAGAVRERIIRAFLVEEQKIVKKVLKIQKAKEKTANKS

SEQ ID NO: 9871 - protein, 120 aa, Citrus clementina
MVQRLTYRKRHSYATKSNQHRVVKTPGGKLVYQSTKKRASGPKCPVTGKRIQGIPHLRPAEYKRSRLSRNHRTVNRTYGGVLSGGAVRERIIRAFLVEEQKIVKKVLKIQKAKEKQALKS

SEQ ID NO: 9872 - protein, 120 aa, Euonymus alatus
MVQRLTYRKRHSYATKSNQHRVVKTPGGKLVYQGTKKRASGPKCPVTGKRIQGIPHLRPTEYKRSRLSRNRRTVNRAYGGVLSGGAVRERIIRAFLVEEQKIVKKVLKIQKSKEKLASKS

SEQ ID NO: 9873 - protein, 119 aa, Euphorbia peplus
MVQRLTYRSRHSYATKSNQHRIVKTPGGKLVYQTTKKRASGPKCPVTGKRIQGIPHLRPAEYKRSRLSRNRRTVNRAYGGVLSGGAVRERIIRAFLVEEQKIVKKVLKIQKAKEKVSKS

SEQ ID NO: 9874 - protein, 120 aa, Flaveria ramosissima
MVQRLTYCKRHSYATKSNQHRVVKTPGGKLVYQTTKKRASGPKCPVTGKRLQGIPHLRPAEYKRSRLSRNRRTVNRAYGGVLSAGAVRERIIRAFLVEEQKIVKKVLKIQKAKEKQAGKS

SEQ ID NO: 9875 - protein, 119 aa, Linum usitatissimum
MVQRLTYRKRHSYATKSNQHRIVKTPGGKLVYQTTKKRASGPKCPVTGKRIQGIPHLRPAEYKRSRLPRNRRTVNRAYGGVLSGGAVRERIIRAFLVEEQKIVKKVLKIQKSKEKVTKS

SEQ ID NO: 9876 - protein, 120 aa, Fraxinus spp
MVQRLTYRKRHSYATKSNQHRIVKTPGGKLVYQSTKKRASGPKCPVTGKRIQGIPHLRPAEYKRSRLSRNRRTVNRAYGGVLSGGAVRERIIRAFLVEEQKIVKKVLKIQKAKEKLATKS

SEQ ID NO: 9877 - protein, 120 aa, Fraxinus spp
MVQRLTYRKRHSYATKSNQHRIVKTPGGKLVYQSTKKRASGPKCPVTGKRIQGIPHLRPAEYKRSRLSRNRRTVNRAYGGVLSGGAVRERIIRAFLVEEQKIVKKVLKIQKAKEKLAGKS

SEQ ID NO: 9878 - protein, 120 aa, Olea europaea
MVQRLTYRKRHSYATKSNQHRIVKTPGGKLVYQSTKKRASGPKCPVTGKRIQGIPHLRPAEYKRSRLSRNRRTVNRAYGGVLSGGAVRERIIRAFLVEEQKIVKKVLKIQKAKEKLSSKS

SEQ ID NO: 9879 - protein, 120 aa, Platanus occidentalis
MVQRLTYRKRHSYATKSNQTRVVKTPGGRLVYQTTKKRASGPKCPVTGKRIQGFPHLRPAEYKRSRLSRNRRTVNRAYGGVLSGSAVRERIIRAFLVEEQKIVKKVLKIQKAKEKQASKS

SEQ ID NO: 9880 - protein, 120 aa, Scabiosa columbaria
MVQRLTYRKRHSYATKSNQNRVVKTPGGKLVYQTTKKRASGPKCPVTGKRIQGIPHLRPAEYKRSRLARNRRTVNRAYGGVLSGGAVRERIIRAFLVEEQKIVKKVLKIQKSKEKVAGKS

SEQ ID NO: 9881 - protein, 120 aa, Tabernaemontana elegans
MVQRLTYRKRHSYATKSNQHRVVKTPGGKLVYQSTKKRASGPKCPVTGKRIQGIPHLRPAEYKRSRLSRNRRTVNRAYGGVLSGSAVRERIIRAFLVEEQKIVKKVLKIQKAKEKLAAKS

SEQ ID NO: 9882 - protein, 120 aa, Solanum lycopersicum
MVQRLTYRKRHSYATKSNQHRVVKTPGGKLIYQTTKKRANGPKCPVTGKRIQGIPHLRPAEYKRSRLSRNRRTVNRAYGGVLSGSAVRERIIRAFLVEEQKIVKKVLKIQKAKEKLASKS

SEQ ID NO: 9883 - protein, 120 aa, Trigonella foenum-graecum
MVQRLTYRRRHSYATKSNQHRIVKTPGGKLVYQTTKKRASGPKCPVTGKRIQGIPHLRPTEYKRSRLPRNRRTVNRAYGGVLSGGAVRERIIRAFLVEEQKIVKKVLKIQKAKEKQATKA

SEQ ID NO: 9884 - protein, 120 aa, Trigonella foenum-graecum
MVQRLTYRRRHSYATKSNQHRIVKTPGGKLVYQTTKKRASGPKCPVTGKRIQGIPHLRPTEYKRSRLPRNRRTVNRAYGGVLSGGAVRERIIRAFLVEEQKIVKKVLKIQKTKEKQAAKS

SEQ ID NO: 9885 - protein, 120 aa, Tripterygium wilfordii
MVQRLTYRKRHSYATKSNQHRVVKTPGGKLVYQSTKKRASGPKCPVTGKRIQGIPHLRPAEYKRSRLSRNRRTVNRAYGGVLSGSAVRERIIRAFLVEEQKIVKKVLKIQKAKEKLSSKS

SEQ ID NO: 9886 - protein, 120 aa, Acacia harpophylla
MVQRLTYRKRHSYATKSNQHRVVKTPGGRLVYQSTKKRASGPKCPVTGKRIQGIPHLRPAEYKRSRLPRNRRTVNRAYGGVLSGGAVRERIIRAFLVEEQKIVKKVLKIQKAKEKQSLKG

SEQ ID NO: 9887 - protein, 120 aa, Aquilegia formosa
MVQRLTYRKRHSYATKSNQNRVVKTPGGKLVYQTTKKRASGPKCPVTGKRIQGIPHLRPAEYKRTRLSRNRRTVNRAYGGVLSGGAVRERIIRAFLVEEQKIVKKVLKIQKAKEKTVSKS

SEQ ID NO: 9888 - protein, 120 aa, Aristolochia fimbriata
MVQRLTYRKRHSYATKSNQNRVVKTPGGRLVYQTTKKRASGPKCPVTGKRIQGIPHLRPAEYKRSRLSRNRRTVNRAYGGVLSGSAVRERIIRAFLVEEQKIVKKVLKIQKAKEKQAAKS

SEQ ID NO: 9889 - protein, 120 aa, Phaseolus coccineus
MVQRLTYRKRHSYATKSNQHRVVKTPGGKLVYQTTKKRASGPKCPVTGKRIQGIPHLRPTEYKRSRLSRNRRTVNRAYGGVLSGGAVRERIIRAFLVEEQKIVKKVLKIQKTKEKQAAKN

SEQ ID NO: 9890 - protein, 120 aa, Centaurea maculosa
MVQRLTYRKRHGYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKIQKAKEKTANKS

SEQ ID NO: 9891 - protein, 120 aa, Unknown
  Sequence found in Organisms: Cicer arietinum, Pisum sativum
MVQRLTYRRRHSYATKSNQHRVVKTPGGKLVYQTTKKRASGPKCPVTGKRIQGIPHLRPTEYKRSRLSRNRRTVNRAYGGVLSGGAVRERIIRAFLVEEQKIVKKVLKIQKTKEKQASKA

SEQ ID NO: 9892 - protein, 120 aa, Cicer arietinum
MVQRLTYRRRHSYATKSNQHRVVKTPGGKLVYQTTKKRASGPKCPVTGKRIQGIPHLRPTEYKRSRLSRNRRTVNRAYGGVLSGGAVRERIIRAFLVEEQKIVKKVLKIQKTKEKQASKN

SEQ ID NO: 9893 - protein, 120 aa, Coffea canephora
MAQRLTYRKRHSYATKSNQHRVVKTPGGKLVYQTTKKRASGPKCPVTGKRIQGIPHLRPAEYKRSRLARNRRTVNRAYGGVLSGSAVRERIIRAFLVEEQKIVKKVLKIQKAKEKLAAKS

SEQ ID NO: 9894 - protein, 120 aa, Gossypium hirsutum
MVQRLTYRTRHSYATKSNQHRVVKTPGGKLIYQTTKKRASGPKCPVTGKRIQGIPHLRPAEYKRSRLPRNRRTVNRAYGGVLSGSAVRERIIRAFLVEEQKIVKKVLKIQKTKEKQSSKS

SEQ ID NO: 9895 - protein, 120 aa, Cynara scolymus
MVQRLTYRKRHSYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKIQKTKEKAAGKS

SEQ ID NO: 9896 - protein, 120 aa, Unknown
  Sequence found in Organisms: Taraxacum officinale, Lactuca sativa
MVQRLTYRKRHSYATKSNQHRVVKTPGGKLVYQTTKKRASGPKCPVTGKRIQGIPHLRPTEYKRSRLSRNRRTVNRAYGGVLSAGAVRERIIRAFLVEEQKIVKKVLKIQKAKEKTAGKS

SEQ ID NO: 9897 - protein, 120 aa, Gerbera hybrid cultivar
MVQRLTYRKRHSYATKSNQHRVVKTPGGKLVYQTTKKRASGPKCPVTGKRIQGIAHLRPAEYKRSRLSRNRRTVNRAYGGVLSAGAVRERIIRAFLVEEQKIVKKVLKIQKTKEKQAGKS

SEQ ID NO: 9898 - protein, 120 aa, Gerbera hybrid cultivar
MVQRLTYRRRHSYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKIQKAKEKTAAKS

SEQ ID NO: 9899 - protein, 120 aa, Guizotia abyssinica
MVQRLTYRKRHSYATKSNQHRVVKTPGGKLIYQTTKKRASGPKCPVTGKRIQGIPHLRPTEYKRSRLSRNRRTVNRAYGGVLSAGAVRERIIRAFLVEEQKIVKKVLKIQKAKEKTASKS

SEQ ID NO: 9900 - protein, 120 aa, Actinidia deliciosa
MVQRLTYRKRHSYATKSNQNRVVKTPGGRLVYQTTKKRASGPKCPVTGKRIQGIPHLRPAEYKRSRLSRNRRTVNRAYGGVLSGGAVRERIIRAFLVEEQKIVKKVLKIQKAKEKQSSKN

SEQ ID NO: 9901 - protein, 119 aa, Actinidia deliciosa
MVQRLTYRKRHSYATKSNQNRVVKTPGGRLVYQSTKKRASGPKCPVTGKRIQGIPHLRPAEYKRSRLSRNRRTVNRAYGGVLSGGAVRERIIRAFLVEEQKIVKKVLKIQKAKEKASKS

SEQ ID NO: 9902 - protein, 120 aa, Lotus japonicus
MVQRLTYRRRHSYATKSNQHRVVKTPGGKLVYQTTKKRASGPKCPVTGKRIQGIPHLRPTEYKRSRLSRNRRTVNRAYGGVLSGGAVRERIIRAFLVEEQKIVKKVLKIQKAKEKLASKA

SEQ ID NO: 9903 - protein, 120 aa, Medicago truncatula
MVQRLTYRRRHSYATKSNQHRVVKTPGGKLVYQTTKKRASGPKCPVTGKRIQGIPHLRPTEYKRSRLPRNRRTVNRAYGGVLSGGAVRERIIRAFLVEEQKIVKKVLKIQKTKEKQALKG

SEQ ID NO: 9904 - protein, 120 aa, Mimulus guttatus
MVQRLTYRKRHSYATKSNQHRIVKTPGGKLVYQTTKKRASGPKCPVTGKRIQGIPHLRPAEYKRSRLSRNRRTVNRPYGGVLSGGAVRERIIRAFLVEEQKIVKKVLKIQKTKEKVASKS

SEQ ID NO: 9905 - protein, 120 aa, Orobanche aegyptiaca
MVQRLTYRKRHSYATKSNQHRIVKTPGGKLIYQSTKKRASGPKCPVTGKRIQGIPHLRPAEYKRSRLPRNRRTVNRPYGGVLSGGAVRERIIRAFLVEEQKIVKKVLKIQKAKEKVASKS

SEQ ID NO: 9906 - protein, 119 aa, Carica papaya
MVQRLTYRKRHSYATKSNQHRVVKTPGGRLVYQGTKKRASGPKCPVTGKRIQGIPHLRPAEYKRSRLPRNRRTVNRAYGGVLSGGAVRERIIRAFLVEEQKIVKKVLKLQKTKEKQSKS

SEQ ID NO: 9907 - protein, 120 aa, Capsicum annuum
MVQRLTYRKRHSYATKSNQHRVVKTPGGKLIYQTTKKRASGPKCPVTGKRIQGIPHLRPAEYKRSRLSRNRRTVNRAYGGVLSGGAVRERIVRAFLVEEQKIVKKVLKIQKAKEKLAAKS

SEQ ID NO: 9908 - protein, 120 aa, Petunia hybrida
MVQRLTYRKRHSYATKSNQHRIVKTPGGKLIYQTTKKRASGPKCPVTGKRIQGIPHLRPAEYKRSRLSRNRRTVNRAYGGVLSGSAVRERIIRAFLVEEQKIVKKVLKIQKAKEKLASKS

SEQ ID NO: 9909 - protein, 120 aa, Unknown
  Sequence found in Organisms: Solanum tuberosum, Solanum phureja
MVQRLTYRKRHSYATKSNQHRVVKTPGGKLIYQTTKKRANGPKCPVTGKRIQGIPHLRPAEYKRSRLSRNRRTVNRAYGGVLSGGAVRERIVRAFLVEEQKIVKKVLKIQKAKEKLASKS

SEQ ID NO: 9910 - protein, 120 aa, Unknown
  Sequence found in Organisms: Solanum tuberosum, Solanum phureja
MVQRLTYRKRHSYATKSNQHRIVKTPGGKLIYQTTKKRASGPKCPVTGKRIQGIPHLRPAEYKRSRLPRNRRTVNRAYGGVLSGSAVRERIIRAFLVEEQKIVKKVLKIQKAKEKLASKN

SEQ ID NO: 9911 - protein, 120 aa, Prunus persica
MVQRLTYRTRHSYATKSNQHRIVKTPGGKLVYQTTKKRASGPKCPVTGKRIQGIPHLRPAEYKRSRLSRNRRTVNRAYGGVLSGGAVRERIIRAFLVEEQKIVKKVLKIQKAKEKQAGKN

SEQ ID NO: 9912 - protein, 120 aa, Rosa hybrid cultivar
MVQRLTYRSRHSYATKSNQHRVVKTPGGKLVYQTTKKRASGPKCPVTGKRIQGIPHLRPAEYKRSRLSRNRRTVNRAYGGVLSGGAVRERIIRAFLVEEQKIVKKVLKIQKAKERQAAQS

SEQ ID NO: 9913 - protein, 120 aa, Solanum phureja
MVQRLTYRKRHSYATKSNQHRVVKTPGGKLIYQTTKKRANGPKCPVTGKRIQGIPHLRPAEYKRSRLPRNRRTVNRAYGGVLSGSAVRERIIRAFLVEEQKIVKKVLKIQKAKEKLASKN

SEQ ID NO: 9914 - protein, 120 aa, Fragaria vesca
MVQRLTYRSRHSYATKSNQHRIVKTPGGKLVYQTTKKRASGPKCPVTGKRIQGIPHLRPAEYKRSRLSRNRRTVNRAYGGVLSGGAVRERIIRAFLVEEQKIVKKVLKIQKAKERAASKS

SEQ ID NO: 9915 - protein, 120 aa, Helianthus annuus
MVQRLTYRKRHSYATKSNQHRVVKTPGGKLIYQTTKKRASGPKCPVTGKRIQGIPHLRPAEYKRSRLSRNRRTVNRAYGGVLSAGAVRERIIRAFLVEEQKIVKKVLKIQKAKEKTASKA

SEQ ID NO: 9916 - protein, 120 aa, Helianthus annuus
MVQRLTYRKRHSYATKSNQHRVVKTPGGKLIYQTTKKRASGPKCPVTGKRIQGIPHLRPAEYKRSRLSRNRRTVNRAYGGVLSAGAVRERIIRAFLVEEQKIVKKVLKIQKAKEKTAAKS

SEQ ID NO: 9917 - protein, 120 aa, Nicotiana tabacum
MVQRLTYRKRHSYATKSNQHRVVKTPGGKLIYQSTKKRASGPKCPVTGKRIQGIPHLRPAEYKRSRLSRNRRTVNRAYGGVLSGSAVRERIIRAFLVEEQKIVKKVLKIQKAKEKLASKS

SEQ ID NO: 9918 - protein, 120 aa, Triphysaria pusilla
MVQRLTYRSRHSYATKSNQHRIVKTPGGKLVYQTTKKRASGPKCPVTGKRIQGIPHLRPAEYKRSRLPRNRRTVNRPYGGVLSGSAVRERIIRAFLVEEQKIVKKVLKIQKAKEKLASKS

SEQ ID NO: 9919 - protein, 122 aa, Solanum melongena
MVQRLTYRKRHSYATKSNQHRVVKTPGGKLIYQTTKKRASGPKCPVTGKRIQGIPHLRPAEYKRSRLPRNRRTVNRAYGGVLSGSAVRERIIRAFLVEEQKIVKKVLKIQKAKEKLASKGKV

SEQ ID NO: 9920 - protein, 118 aa, Ambrosia trifida
QRLTYRKRHSYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKIQKAKEKTASKA

SEQ ID NO: 9921 - protein, 120 aa, Unknown
  Sequence found in Organisms: Ambrosia trifida, Flaveria ramosissima, Helianthus annuus
MVQRLTYRKRHSYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKLQKTKEKQGGKS

SEQ ID NO: 9922 - protein, 108 aa, Arnica chamissonis
MLPNPISIGSLKPPVGKLVYQTTKKRASGPKCPVTGKRIQGIPHLRPTEYKRSRLSRNRRTVNRAYGGVLSAGAVRERIIRAFLVEEQKIVKKVLKIQKTKEKQGGKS

SEQ ID NO: 9923 - protein, 120 aa, Unknown
  Sequence found in Organisms: Catharanthus roseus, Vinca minor
MVQRLTYRKRHSYATKSNQHRIVKTPGGKLVYQSTKKRASGPKCPVTGKRIQGIPHLRPAEYKRSRLSRNRRTVNRPYGGVLSGSAVRERIIRAFLVEEQKIVKKVLKIQKAKEKLASKS

SEQ ID NO: 9924 - protein, 120 aa, Catharanthus roseus
MVQRLTYRKRHSYATKSNQHRVVKTPGGKLVYQSTKKRASGPKCPVTGKRIQGIPHLRPAEYKRSRLSRNRRTVNRPYGGVLSGSAVRERIIRAFLVEEQKIVKKVLKIQKAKEKLAAKS

SEQ ID NO: 9925 - protein, 120 aa, Cirsium arvense
MVQRLTYRKRHSYATKSNQHRVVKTPGGKLVYQTTKKRASGPKCPITGKRIQGIPHLRPAEYKRSRLSRNRRTVNRAYGGVLSAGAVRERIIRAFLVEEQKIVKKVLKIQKTKEKAAGKS

SEQ ID NO: 9926 - protein, 120 aa, Euonymus alatus
MVQRLTYRKRHSYATKSNQHRVVKTPGGKLVYQSTKKRASGPKCPVTGKRIQGIPHLRPTEYKRSRLSRNRRTVNRAYGGVLSGSAVRERIIRAFLVEEQKIVKKVLKIQKTKEKLASKS

SEQ ID NO: 9927 - protein, 120 aa, Euonymus alatus
MVQRLTYRKRHSYATKSNQHRVVKTPGGKLVYQGTKKRASGPKCPVTGKRIQGIPHLRPTEYKRSRLSRNRRTVNRAYGGVLSSGAVRERIIRAFLVEEQKIVKKVLKIQKSKEKLASKS

SEQ ID NO: 9928 - protein, 119 aa, Unknown
  Sequence found in Organisms: Euphorbia peplus, Euphorbia esula
MVQRLTYRSRHSYATKSNQHRIVKTPGGKLVYQTTKKRASGPKCPVTGKRIQGIPHLRPAEYKRSRLSRNRRTVNRAYGGVLSGGAVRERIIRAFLVEEQKIVKKVLKIQKAKEKVSKA

SEQ ID NO: 9929 - protein, 120 aa, Flaveria ramosissima
MVQRLTYRRRHSYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKIQKAKEKTAAKA

SEQ ID NO: 9930 - protein, 106 aa, Flaveria ramosissima
MVQRLTYRKRHSYATKSNQHRVVKTPGGKLVYQTTKKRASGPKCPVTGKRIQGIPHLRPAEYKRSRLSRNRRTVNRAYGGVLSAGAVRERIIRAFWLKNRRLLKRC

SEQ ID NO: 9931 - protein, 119 aa, Linum usitatissimum
MVQRLTYRKRHSYATKSNQHRIVKTPGGKLVYQTTKKRASGPKCPVTGKRIQGIPHLRPAEYKRSRLPRNRRTVNRAYGGVLSGGAVRERIIRAFLVEEQKIVKKVLKIQKSKEKTTKA

SEQ ID NO: 9932 - protein, 119 aa, Linum usitatissimum
MAQRLTYRKRHSYATKSNQHRIVKTPGGKLVYQTTKKRASGPKCPVTGKRIQGIPHLRPAEYKRSRLPRNRRTVNRAYGGVLSGGAVRERIIRAFLVEEQKIVKKVLKIQKSKEKVTKS

SEQ ID NO: 9933 - protein, 120 aa, Unknown
  Sequence found in Organisms: Fraxinus spp, Olea europaea
MVQRLTYRKRHSYATKSNQHRIVKTPGGKLVYQSTKKRASGPKCPVTGKRIQGIPHLRPAEYKRSRLSRNRRTVNRAYGGVLSGGAVRERIIRAFLVEEQKIVKKVLKIQKAKEKLSAKS

SEQ ID NO: 9934 - protein, 120 aa, Fraxinus spp
MVQRLTYRKRHSYATKSNQHRIVKTPGGKLVYQSTKKRASGPKCPVTGKRIQGIPHLRPAEYKRSRLSRNRRTVNRAYGGVLSGAAVRERIIRAFLVEEQKIVKKVLKIQKAKEKQAGKN

SEQ ID NO: 9935 - protein, 120 aa, Fraxinus spp
MVQRLTYRKRHSYATKSNQHRIVKTPGGKLVYQSTKKRASGPKCPVTGKRIQGIPHLRPAEYKRSRLSRNQRTVNRAYGGVLSGGAVRERIIRAFLVEEQKIVKKVLKIQKAKEKLSSKS

SEQ ID NO: 9936 - protein, 120 aa, Fraxinus spp
MVQRLTYRKRHSYATKSNRHRIVKTPGGKLVYQSTKKRASGPKCPVTGKRIQGIPHLRPAEYKRSRLSRNRRTVNRAYGGVLSGGAVRERIIRAFLVEEQKIVKKVLKIQKAKEKLATKS

SEQ ID NO: 9937 - protein, 120 aa, Pisum sativum
MVQRLTYRRRHSYATKSNQHRVVKTPGGKLVYQTTKKRASGPKCPVTGKRIQGIPHLRPTEYKRSRLSRNRRTVNRAYGGVLSGGAVRERIIRAFLVEEQKIVKKVLKIQKTKEKQAAKN

SEQ ID NO: 9938 - protein, 120 aa, Lippia dulcis
MVQRLTYRKRHSYATKSNQHRVVKTPGGKLIYQTTKKRASGPKCPVTGKRIQGIPHLRPAEYKRSRLPRNRRTVNRPYGGVLSGSAVRERIIRAFLVEEQKIVKKVLKIQKTKEKLAAKS

SEQ ID NO: 9939 - protein, 120 aa, Lippia dulcis
MVQRLTYSKRHSYATKSNQHRVVKTPGGKLVYQTTKKRASGPKCPVTGKRIQGIPHLRPAEYKRSRLSRNRRTVNRAYGGVLSGSAVRERIIRAFLVEEQKIVKKVLKLQKAKEKVASKN

SEQ ID NO: 9940 - protein, 120 aa, Plantago ovata
MVQRLTYRKRHSYATKSNQHRIVKTPGGKLVYQTTKKRASGPKCPVTGKRIQGIPHLRPTEYKRSRLPRSRRTVNRPYGGVLSGGAVRERIIRAFLVEEQKIVKKVLKIQKTKEKQAGKS

SEQ ID NO: 9941 - protein, 120 aa, Plantago ovata
MVQRLTYRKRHSYATKSNQHRIVKTPGGKLVYQTTKKRASGPKCPVTGKRIQGIPHLRPTEYKRSRLPRNRRTVNRPYGGVLSGGAVRERIIRAFLVEEQKIVKKVLKIQKSKEKLASKA

SEQ ID NO: 9942 - protein, 120 aa, Sarracenia psittacina
MVQRLTYRKRHSYATKSNQHRIVKTPGGRLVYQSTKKRASGPKCPVTGKRIQGIPHLRPAEYKRSRLSRNRRTVNRAYGGVLSGGAVRERIIRAFLVEEQKIVKKVLKIQKAKEKHAGKS

SEQ ID NO: 9943 - protein, 120 aa, Scabiosa columbaria
MVQRLTYRKRHSYATKSNQHRVVKTPGGKLVYQGTKKRASGPKCPVTGKRIQGIPHLRPTEYKRSRLARNRRTVNRAYGGVLSGGAVRERIIRAFLVEEQKIVKKVLKIQKTKEKTAGKS

SEQ ID NO: 9944 - protein, 119 aa, Thalictrum flavum
LQRLTYRKRHSYATKSNQNRVVKTPGGKLVYQTTKKRASGPKCPVTGKRIQGIPHLRPAEYKRSRLSRNRRTVNRAYGGVLSGGAVRERIIRAFLVEEQKIVKKVLKIQKAKEKTAPKS

SEQ ID NO: 9945 - protein, 120 aa, Solanum lycopersicum
MVQRLTYRKRHSYATKSNQHRVVKTPGGKLIYQTTKKRANGPKCPVTGKRIQGIPHLRPAEYKRSRLSRNRRTVNRAYGGVLSGGAVRERIVRAFLVEEQKIVKKVLKIQKAKEKLAAKS

SEQ ID NO: 9946 - protein, 120 aa, Tripterygium wilfordii
MVQRLTYRKRHSYATKSNQHWVVKTPGGKLVYQSTKKRASGPKCPVTGKRIQGIPHLRPAEYKRSRLSRNRRTVNRAYGGVLSGGAVRERIIRAFLVEEQKIVKKVLKIQNAKERLASKS

SEQ ID NO: 9947 - protein, 120 aa, Vinca minor
MVQRLTYRKRHSYATKSNQHRIVKTPGGKLVYQSTKKRASGPKCPVTGKRIQGIPHLRPAEYKRSRLPRNRRTVNRPYGGVLSGSAVRERIIRAFLVEEQKIVKKVLKIQKAKEKLAAKS

SEQ ID NO: 9948 - protein, 120 aa, Vinca minor
MVQRLTYRKRHSYATKSNQHRIVKTPGGKLVYQTTKKRASGPKCPVTGKRIQGIPHLRPAEYKRSRLSRNRRTVNRPYGGVLSGSAVRERIIRAFLVEEQKIVKKVLKIQKAKEKLATKS

SEQ ID NO: 9949 - protein, 120 aa, Antirrhinum majus
MVQRLTYRSRHSYATKSNQHRVVKTPGGKLVYQTTKKRASGPKCPVTGKRIQGIPHLRPTEYKRSRLSRNRRTVNRPYGGVLSGGAVRERIIRAFLVEEQKIVKKVLKIQKAKEKLATKS

SEQ ID NO: 9950 - protein, 120 aa, Antirrhinum majus
MVQRLTYRSRHSYATKSNQHRVVKTPGGKLVYQTTKKRASGPKCPVTGKRIQGIPHLRPTEYKRSRLSRNRRTVNRPYGGVLSGGAVRERIIRAFLVEEQKIVKKVLKIQKAKEKVAAKS

SEQ ID NO: 9951 - protein, 120 aa, Aquilegia formosa
MVQRLTYRKRHSYATKSNQNRVVKTPGGKLVYQTTKKRASGPKCPVTGKRIQGIPHLRPAEYKRTRLSRNRRTVNRAYGGVLSGGAVRERIIRAFLVEEQKIVKKVLKIQKAKEKTSSKN

SEQ ID NO: 9952 - protein, 120 aa, Artemisia annua
MVQRLTYRKRHSYATKSNQHRVVKTPGGKLVYQTTKKRASGPKCPVTGKRIQGIPHLRPTEYKRSRLSRNRRTVNRAYGGVLSAGAVRERIIRAFLVEEQKIVKKVLKIQKAKEKTAAKN

SEQ ID NO: 9953 - protein, 120 aa, Artemisia annua
MVQRLTYRKRHSYATKSNQHRVVKTPGGKLVYQTTKKRASGPKCPVTGKRIQGIPHLRPTEYKRSRLSRNRRTVNRAYGGVLSAGAVRERIIRAFLVEEQKIVKKVLKIQKTKEKAAGKS

SEQ ID NO: 9954 - protein, 120 aa, Musa acuminata
MVQRLTYRKRHSYATKSNQTRVVKTPGGRLVYQYTNKRASGPKCPVTGKRIQGIPHLRPAEYKRSRLSRNRRTVNRAYGGVLSGSAVRERIIRAFLVEEQKIVKKVLKIQKAKEKQASKS

SEQ ID NO: 9955 - protein, 120 aa, Ricinus communis
MVQRLTYRKRHSYATKSNQHRIVKTPGGKLVYQTTKKRASGPKCPVTGKRIQGIPHLRPSEYKRSRLSRNRRTVNRAYGGVLSGGAVRERIIRAFLVEEQKIVKKVLKIQKAKEKQSTRS

SEQ ID NO: 9956 - protein, 120 aa, Citrus sinensis
MVQRLTYRKRHSYATKSSQHRVVKTPGGKLVYQSTKKRASGPKCPVTGKRIQGIPHLRPAEYKRSRLSRNHRTVNRTYGGVLSGGAVRERIIRAFLVEEQKIVKKVLKIQKAKEKQALKS

SEQ ID NO: 9957 - protein, 120 aa, Coffea canephora
MAQRLTYRKRHSYATKSNQHRVVKTPGGRLVYQSTKKRASGPKCPVTGKRIQGIPHLRPAEYKRSRLSRNRRTVNRAYGGVLSGSAVRERIIRAFLVEEQKIVKKVLKIQKAKEKLASKS

SEQ ID NO: 9958 - protein, 119 aa, Gossypium hirsutum
MVQRLTYRTRHSYATKSNQHRVVKTPGGKLVYQTTKKRASGPKCPVTGKRIQGIPHLRPAEYKRSRLPRNRRSVNRAYGGVLSGSAVRERIIRAFLVEEQKIVKKVLKIQKTKEKQSSK

SEQ ID NO: 9959 - protein, 120 aa, Gossypium hirsutum
MVQRLTYRTRHSYATKSNQHRVVKTPGGKLVYQTTKKRASGPKCPVTGKRIQGIPHLRPAEYKRSRLPRNRRTVNRAYGGVLSGSAVRERIIRAFLVEEQKIVKKVLKIQKTKEKVSSKN

SEQ ID NO: 9960 - protein, 120 aa, Gossypium hirsutum
MVQRLTYRIRHSYATKSNQHRVVKTPGGKLVYQTTKKRASGPKCPVTGKRIQGIPHLRPAEYKRSRLPRNRRTVNRAYGGVLSGSAVRERIIRAFLVEEQKIVKKVLKIQKTKEKVSSKN

SEQ ID NO: 9961 - protein, 120 aa, Vigna unguiculata
MVQRLIYRKRHSYATKSNQHRVVKTPGGKLVYQSTKKRASGPKCPVTGKRIQGIPHLRPAEYKRSRLSRNRRTVNRAYGGVLSGSAVRERIIRAFLVEEQKIVKKVLKIQKAKEKQALKG

SEQ ID NO: 9962 - protein, 120 aa, Taraxacum officinale
MVQRLTYRKRHSYATKSNQHRVVKTPGGKLVYQTTKKRASGPKCPVTGKRIQGIPHLRPTEYKRSRLSRNRRTVNRAYGGVLSAGAVRERIIRAFLVEEQKIVKKVLKIQKTKEKTANKS

SEQ ID NO: 9963 - protein, 120 aa, Solanum melongena
MVQRLTYRKRHSYATKSNQHRVVKTPGGQLVYQTSKKRASGPKCPVTGKRIQGIPHLRPAEYKRSRLSRNRRTVNRAYGGVLSGGAVRERIVRAFLVEEQKIVKKVLKIQKAKEKLAAKS

SEQ ID NO: 9964 - protein, 68 aa, Eucalyptus grandis
MVQRLTYRKRHSYATESNQHRVVKTPGGKLVYQDHQEESERPQMPRHRQEDSGDSSLEASRIQEIKIV

SEQ ID NO: 9965 - protein, 120 aa, Gerbera hybrid cultivar
MVQRLTYRRRHSYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKIQKTKERQAGKS

SEQ ID NO: 9966 - protein, 120 aa, Guizotia abyssinica
MVQRLTYRKRHSYATKSNQHRVVKTPGGKLVYQTTKKRASGPKCPVTGKRIQGIPHLRPTEYKRSRLSRSRRTVNRAYGGVLSAGAVRERIIRAFLVEEQKIVKKVLKIQKAKEKTASKA

SEQ ID NO: 9967 - protein, 120 aa, Mesembryanthemum crystallinum
MVQRLTYRKRHSYATKSNQHRVVKTPGGKLVYQGTKKRASGPKCPVTGKRIQGIPHLRPAEYKRSRLSRNRRTVNRPYGGVLSSGAVRERIIRAFLVEEQKIVKKVLKIQKTKEKQAGKS

SEQ ID NO: 9968 - protein, 120 aa, Actinidia deliciosa
MVQRLTYRKRHSYATKSNQHRIVKTPGGKLVYQSTKKRASGPKCPVTGKRIQGIPHLRPTEYKRSRLSRNRRTVNRAYGGVLSGGAVRERIIRAFLVEEQKIVKKVLKIQKSKEKQATKS

SEQ ID NO: 9969 - protein, 120 aa, Lactuca sativa
MVQRLTYRRRHSYATKSNQHRVVKTPGGKLVYQTTKKRASGPKCPVTGKRIQGIPHLRPTEYKRSRLSRNRRTVNRAYGGVLSAGAVRERIIRAFLVEEQKIVKKVLKIQKTKEKTASKS

SEQ ID NO: 9970 - protein, 120 aa, Lactuca sativa
MVQRLTYRRRHSYATKSNQHRVVKTPGGKLVYQTTKKRASGPKCPVTGKRIQGIPHLRPTEYKRSRLSRNRRTVNRAYGGVLSAGAVRERIIRAFLVEEQKIVKKVLKIQKIKEKAASKS

SEQ ID NO: 9971 - protein, 120 aa, Mimulus guttatus
MVQRLTYRKRHSYATKSNQHRIVKTPGGKLVYQTTKKRASGPKCPVTGKRIQGIPHLRPAEYKRSRLSRNRRTVNRPYGGVLSGGAVRERIIRAFLVEEQKIVKKVLKIQKTKEKLASKA

SEQ ID NO: 9972 - protein, 120 aa, Mimulus guttatus
MVQRLTYRKRHSYATKSNQHRIVKTPGGKLVYQTTQKRASGPKCPVTGKRIQGIPHLRPAEYKRSRLSRNRRTVNRPYGGVLSGSAVRERIIRAFLVEEQKIVKKVLKIQKAKEKVASKS

SEQ ID NO: 9973 - protein, 120 aa, Tropaeolum majus
MVQRLTYRTRHSYATKSNQHRIVKTPGGKLVYQTTKKRASGPKCPVTGKRIQGIPHLRPTEYKRSRLPRNRRTVNRAYGGVLSGSAVRERIIRAFLVEEQKIVKKVLKIQKTKEKQASKN

SEQ ID NO: 9974 - protein, 120 aa, Nicotiana benthamiana
MVQRLTYRKRHSYATKSNQHRVVKTPGGKLIYQSTKKRASGPKCPVTGKRIQGIPHLRPTEYKRSRLSRNRRTVNRAYGGVLSGSAVRERIIRAFLVEEQKIVKKVLKIQKAKEKLASKS

SEQ ID NO: 9975 - protein, 120 aa, Petunia hybrida
MVQRLTYRKRHSYATKSNQHRIVKTPGGKLIYQTTKKRASGPKCPVTGKRIQGIPHLRPAEYKRSRLSRNRRTVNRAYGGVLSGSAVRERIIRAFLVEEQKIVKKVLKIQKAKEKLAAKS

SEQ ID NO: 9976 - protein, 120 aa, Petunia hybrida
MVQRLTYRKRHSYATKSNQHRIVKTPGGKLIYQTTKKRASGPKCPVTGKRIQGIPHLRPAEYKRSRLSRNRRTVNRAYGGVLSGGAVRERIVRAFLVEEQKIVKKVLKIQKAKEKLAAKS

SEQ ID NO: 9977 - protein, 120 aa, Prunus persica
MVQRLTYRTRHSYATKSNQHRIVKTPGGKLVYQTTKKRASGPKCPVTGKRIQGIPHLRPAEYKRSRLSRNRRTVNRAYGGVLSGAAVKERIIRAFLIEEQKIVKKVLKIQKAKEKQASKS

SEQ ID NO: 9978 - protein, 120 aa, Sesamum indicum
MVQRLTYRKRHSYATKSNQHRVVKTPGGKLVYQSTKKRASGPKCPVTGKRIQGIPHLRPAEYKRSRLSRNRRTVNRPYGGVLSGGAVRERIIRAFLVEEQQIVKKVLKIQKAKEKLAAKS

SEQ ID NO: 9979 - protein, 120 aa, Glycine max
MVQRLTYRKRHSYATKSNQHRVVKTPGGKLVYQTTKKRASGPKCPVTGKRIQGIPHLRPTEYKRSRLPKNRRTVNRAYGGVLSGSAVRERIIRAFLVEEQKIVKKVLKIQKTKEKQALKG

SEQ ID NO: 9980 - protein, 120 aa, Glycine max
MVQRLTYRKRHSYATKSNQHRVVKTPGGKLVYQTTKKRASGPKCPVTGKRIQGIPHLRPAEYNRSRLHRNRRTVNRAYGGVLSGSAVRERIIRAFLVEEQKIVKKVLKIQKTKEKQALKG

SEQ ID NO: 9981 - protein, 120 aa, Triphysaria pusilla
MVQRLTYRSRHSYATKSNQHRIVKTPGGKLVYQTTKKRASGPKCPVTGKRIQGIPHLRPAEYKRSRLSRNRRTVNRPYGGVLSGGAVRERIIRAFLVEEQKIVKKVLKIQKAKEKLASKN

SEQ ID NO: 9982 - protein, 120 aa, Triphysaria pusilla
MVQRLTYRSRHSYATKSNQHRIVKTPGGKLVYQTTKKRASGPKCPVTGKRIQGIPHLRPAEYKRSRLSRNRRTVNRPYGGVLSGGAVRERIIRAFLVEEQKIVKKVLKIQKAKEKLASKA

SEQ ID NO: 9983 - protein, 120 aa, Ambrosia trifida
MVQRLTYRKRHSYATKSNQHRVVKTPGGKLVYQTTKKRASGPKCPVTGKRIQGIPHLRPTEYKRSRLSRNRRTVNRAYGGVLSAGAVRERIIRAFLVEEQKIVKKVLKLQKTKEKQGGKS

SEQ ID NO: 9984 - protein, 120 aa, Amorphophallus konjac
MVQRLTYRKRHSYATKSNQHRVVKTPGGRLVYQSTKKRASGPKCPVTGKRIQGIPHLRPAEYKRSRLSRNRRTINRAYGGVLSGNAVRERIIRAFLVEEQKIVKKVLKIQKAKEKQAAKQ

SEQ ID NO: 9985 - protein, 120 aa, Amorphophallus konjac
MVQRLTYRKRHSYATKSNQHRVVKTPGGRLVYHTTKKRASGPKCPVTGKRIQGIPHLRPAEYKRSRLSRNRRTVNRAYGGVLSGSAVRERIIRAFLVEEQKIVKKVLKIQKAKEKLAAKQ

SEQ ID NO: 9986 - protein, 120 aa, Euonymus alatus
MVQRLTYRKRHSYATKSNQHRVVKTPGGKLVYQSTKKRASGPKCPVTGKRIQGIPHLRPTEYKRSRLSRNRRTVNRAYGGVLSGSAVRERIIRAFLVEEQKIVKKVLKIQKAKEKITAKS

SEQ ID NO: 9987 - protein, 120 aa, Flaveria ramosissima
MVQRLTYRKRHSYATKSNQHRVVKTPGGKLVYQTTKKRASGPKCPVTGRRIQGIPHLRPAEYKRSRLSRNRRTVNRAYGGVLSAGAVRERIIRAFLVEEQKIVKKVLKLQKTKEKQGGKS

SEQ ID NO: 9988 - protein, 118 aa, Linum usitatissimum
MVQRLTYRKRHSYATKSNQHRIVKTPGGKLVYQTTKKRASGPKCPVTGKRIQGIPHLRPAEYKRSRLPRNRRTVNRAYGGVLSGGAVRERIIRAFLVEEQKIVKKVLKIQKSKEKVTK

SEQ ID NO: 9989 - protein, 120 aa, Humulus lupulus
MVQRLTYRTRHSYATKSNQHRIVKTPGGKLVYQTTKKRASGPKCPITGKRIQGIPHLRPTEYKRSRLSRNRRTVNRAYGGVLSGGAVRERIIRAFLVEEQKIVKKVLKIQKAKEKLASKN

SEQ ID NO: 9990 - protein, 120 aa, Humulus lupulus
MVQRLTYRKRHSYATKSNQHRIVKTPGGKLVYQTAKKRASGPKCPVTGKRIQGIPHLRPTEYKRSRLSRNRRTVNRPYGGVLSGGAVRERIIRAFLVEEQKIVKKVLKIQKAKEKLASKN

SEQ ID NO: 9991 - protein, 120 aa, Plantago ovata
MVQRLTYRKRHSYATKSNQHRIVKTPGGKLVYQTTKKRASGPKCPVTGKRIQGIPHLRPSQYKRSRLPRNRRTVNRPYGGVLFGGAVRERIIRAFLVEEQKIVKKVLKIQKSKEKVASKS

SEQ ID NO: 9992 - protein, 120 aa, Silene vulgaris
MVQRLTYRRRHSYATKSNQHRIVKTPGGKLVYQTTKKRASGPKCPVTGKRIQGIPHLRPTEYKRSRLPRNRRTVNRPYGGVLSGGAVRERIIRAFLIEEQKIVKKVLKIQKTKEKQAGKS

SEQ ID NO: 9993 - protein, 120 aa, Vinca minor
MVQRLTYRKRHSYATKSNQHRIVKTPGGKLVYQTTKKRASGPKCPVTGKRIQGIPHLRPAEYKRSRLSRNRRTVNRPYGGVLSGSAVRERIVRAFLVEEQKIVKKVLKIQKAKEKLAAKS

SEQ ID NO: 9994 - protein, 120 aa, Amborella trichopoda
MVQRLTYRTRHSYATKSNQTRVVKTPGGKLVYQTAKKRASGPKCPVTGKRIQGIPHLRPTEYKRTRLSRNRRTVNRAYGGVLSGGAVRERIIRAFLVEEQKIVKKVLKIQKAKEKQAAKS

SEQ ID NO: 9995 - protein, 121 aa, Malus domestica
MVQRLTYRARHSYATKSNQHRIVKTPGGKLVYQTTKKRASGPKCPVTGKRIQGIPHLRPTEYKRSRLSRNRRTVNRAYGGVLSGGAVKERIIRAFLVEEQKIVKKVLKIQKAKEKQASKTK

SEQ ID NO: 9996 - protein, 120 aa, Persea americana
MVQRLTYRKRHSYATKSNQTRVVKTPGGKLVFQYTKKSASGPKCPVTGKRIQGIPHLRPAEYKRSRLSRNRRTVNRAYGGVLSGSAVRERIIRAFLVEEQKIVKKVLKIQKAKEKQAGKS

SEQ ID NO: 9997 - protein, 120 aa, Persea americana
MVHRLTYRKRHSYATKSNQTRVVKTPGGKLGYQNTKKRASGPKCPVTGKRIQGIPHLRPAEYKRSRLSRNRRTVNRTYGGVLSGGAVRERIIRAFLVEEQKIVKKVLKIQKAKEKQAAKS

SEQ ID NO: 9998 - protein, 120 aa, Musa acuminata
MVQRLTYRKRHSYATKSNQTRVVKTPGGSLVYQYTNKRASGPKCPVTGKRIQGIPHLRPAQYKRSRLSRNRRTVNRAYGGVLSGSAVRERIIRAFLVEEQKIVKKVLKIQKAKEKQASKS

SEQ ID NO: 9999 - protein, 120 aa, Beta vulgaris
MVQRLTYRRRHSYATKSNQHRIVKTPGGKLVYQTTKKRASGPKCPVTGKRIQGIPHLRPTEYKRSRLPRNRRTVNRPYGGVLSGSAVRERIIRAFLVEEQKIVKKVLKIQKTKEKQAGKS

SEQ ID NO: 10000 - protein, 120 aa, Beta vulgaris
MVQRLTYRKRHSYATKSNQHRIVKTPGGKLVYQTTKKRASGPKCPVTGKRIQGYPHLRPTEYKRSRLPRNRRTVNRPYGGVLSGSAVRERIIRAFLVEEQKIVKKVLKIQKTKEKQAGKS

SEQ ID NO: 10001 - protein, 120 aa, Centaurea maculosa
  misc_feature (16)..(16): Xaa can be any naturally occurring amino acid
  misc_feature (76)..(76): Xaa can be any naturally occurring amino acid
  misc_feature (112)..(112): Xaa can be any naturally occurring amino acid
  misc_feature (120)..(120): Xaa can be any naturally occurring amino acid
MVQRLTYRKRHSYATXSNQHRVVKTPGGKLVYQTTKKRASGPKCPVTGKRIQGIPHLRPAEYKRSRLSRNRRTVNXAYGGVLSAGAVRERIIRAFLVEEQKIVKKVLKIQKXKEKTASKX

SEQ ID NO: 10002 - protein, 120 aa, Centaurea maculosa
MVQRLAYRKRHSYATKSNQHRVVKTPGGKLVYQTTKKGASGPKCPVTGKRIQGIPHLRPAEYKRSRLSRNRRTVNRAYGGVLSAGAVRERIIRAFLVEEQKIVKKVLKIQKTKEKAAGKS

SEQ ID NO: 10003 - protein, 119 aa, Gossypium hirsutum
MVQRLTYRTRHSYATKSNQHHVVKTPGGKLVYQTTKKRASGPKCPVTGKRIQGIPHLRPAEYKRSRLPRNRRSVNRAYGGVLSGSAVRERIIRAFLVEEQKIVKKVLKIQKTKEKQSSK

SEQ ID NO: 10004 - protein, 120 aa, Curcuma longa
MVQRLTYRKRHSYATKSNQTRVVKTPGGKLVYQYTHKRASGPKCPVTGKRIQGIPHLRPTQYKRSRLSRNRRTVNRAYGGVLSGGAVRERIIRAFLVEEQKIVKKVLKIQKAKEKQTSKS

SEQ ID NO: 10005 - protein, 119 aa, Mesembryanthemum crystallinum
MVQRLTYRKRHSYATKSNQHRIVKTPGGKLVYQSTKKRASGPKCPVTGKRIQGIPHLRPAEYKRSRLPRNRRTVNRPYGGVLSGSAVRERIIRAFLVEEQKIVKKVLKIQKTKEKATKS

SEQ ID NO: 10006 - protein, 120 aa, Mimulus guttatus
MVQRLTYRKRHSYATKSNQHRIVKTPGGKLVYQTTKKRASGPKCPVTGKRIQGIPHLRPAEYKRSRLSRNRRTVNRPYGGVLSGGAVRERIIRAFLVEEQKIVKKVLKIQKTKEKLAAKP

SEQ ID NO: 10007 - protein, 120 aa, Nicotiana benthamiana
MVQRLTYRKWHSYATKSNQHRVVKTPGGKLIYQSTKKRASGPKCPVTGKRIQGIPHLRPTEYKRSRLSRNRRTVNRAYGGVLSGSAVRERIIRAFLVEEQKIVKKVLKIQKAKEKLASKS

SEQ ID NO: 10008 - protein, 120 aa, Nicotiana tabacum
MVQRLTYRKRHSYATKSNQHRVVKTPGGKLIYQSTKKRASGPKCPVTGKRIQGIPHLRPAEYKRSRLSRNRRTVNRPYGGVLSGSAVRERIIRAFLVEEQKIVKKVLKIQKAKEKLAAKS

SEQ ID NO: 10009 - protein, 120 aa, Nicotiana tabacum
MVQRLTYRKRHSYATKSNQHRVVKTPGGKLIYQSTKKRASGPKCPVTGKRIQGIPHLRPTEYKRSRLSRNRRTVNRAYGGVLSGSAVRERIIRAFLVEEQKIVKKVLKIQKAKEKLAAKS

SEQ ID NO: 10010 - protein, 120 aa, Triphysaria pusilla
MVQRLTYRSRHSYATKSNQHRIVKTPGGKLVYQTTKKRASGPKCPVTGKRIQGIPHLRPAEYKRSRLSRNRRTVNRPYGGVLSGGAVRERIIRAFLVEEQKIVKKVLKIQKAKEKLAGKA

SEQ ID NO: 10011 - protein, 120 aa, Triphysaria pusilla
MVQRLTYRSRHSYATKSNQHRIVKTPGGKLVYQTTKKRASGPKCPVTGKRIQGIPHLRPAEYKRSRLSRNRRTVNRPYGGVLSGGAVRERIIRAFLVEEQKIVKKVLKIQKTKEKLAAKS

SEQ ID NO: 10012 - protein, 120 aa, Triphysaria pusilla
MVQRLTYRSRHSYATKSNQHRIVKTPGGKLVYQTTKKRASGPKCPVTGKRIQGIPHLRPAEYKRSRLSRNRRTVNRPYGGVLSGSAVRERIIRAFLVEEQKIVKKVLKIQKAKEKLAGKS

SEQ ID NO: 10013 - protein, 77 aa, Pteridium aquilinum
MSCYWQVNSRNSSLEAAEYKRSRLPRNRRTVNRAYGGVLSGGAVRERIIRAFLVEEQKIVKKVLKIQKAKEKQSSKS

SEQ ID NO: 10014 - protein, 108 aa, Antirrhinum majus
MPPNRINTGVVKTPGGKLVYQTTKKRASGPKCPVTGKRIQGIPHLRPTEYKRSRLSRNRRTVNRPYGGVLSGGAVRERIIRAFLVEEQKIVKKVLKIQKAKEKVAAKS

SEQ ID NO: 10015 - protein, 173 aa, Zingiber officinale
  misc_feature (139)..(139): Xaa can be any naturally occurring amino acid
MQGKQVIPAEEHAAKIAAAREAIGDSDFFLIARTDARGTAGGLAEAIARANLYMEAGADACFVEAPRSDDEMREVCKKTSGFRAANMLEGGYTPLHTPQELKEMGFHLIVHSTTAVYASARALIDVLKALKDEGSSRGXFHKLTTFEEFNGLIGLKELNEIGARFEKFTVPKN

SEQ ID NO: 10016 - protein, 122 aa, Cucurbita pepo
MVQRLTYRKRHSYATKSNQHRVVKTPGGKLIYQTTKKRASGPKCPVTGKRIQGIPHLRPAEYKRSRLARNRRTVNRAYGGVLSGSAVRERIMRAFLVEEQKIVKKVLKIQKAKEKLAAKSSK

SEQ ID NO: 10017 - protein, 121 aa, Zingiber officinale
MVQRLTYRKRHSYATKSNQTRVVKTPGGKLVYQYTHKRASGPKCPVTGKRIQGIPHLRPTQYKRSRLSRNRRTVNRAYGGVLSGGAVRERIIRAFLVEEQKIVKKVLKIQKAKEKQTTSKS

SEQ ID NO: 10018 - protein, 121 aa, Orobanche aegyptiaca
MVQRLTYRKRHSYATKSNQHRIVKTPGGKLVYQSTKKRASGPKCPVTGKRIQGIPHLRPTEYKRSRLPRNRRTVNRPYGGVLSGGAVRERIIRAFLVEEQKIVKKVLKMQKAKEKVAAAKS

SEQ ID NO: 10019 - protein, 64 aa, Linum usitatissimum
MVQRLTYRKRHSYATKSNQHRIVKTPGGKLVYQTTKKRASGPKCPVTGKRIQGIPHLSPAEYKR

SEQ ID NO: 10020 - protein, 96 aa, Heritiera littoralis
MVQRLTYRTRHSYATKSNQHRVVKTPGGKLVYQTTRKRASGPKCPVTGKRIQGIPHLRPAEYKRTRLPRNRRTVNRAYGGVLSGGAARERIIRAFW

SEQ ID NO: 10021 - protein, 203 aa, Ipomoea nil
AYIEAHSAYHGIGVVKLMGRSSGFIAMHASLASGQIDVCLIPEVPFKLDGENGVLKHLEHLIETKGSAVVCVAEGAGQDLMEKSNLKDASGNPILSDVGVHIQHQIKKHFKKIEQLVDVKYIDPTYILRGCRASASDAIMCTVLGQNAVHGAFAGFTGITVGICNTHYIYLPIPEVIAASRHVDPNSRMWHRCLTSTGQPDFS

SEQ ID NO: 10022 - protein, 118 aa, Linum usitatissimum
MVQRLTYRKRHSYATKSNQHRIVKTPGGKLVYQTTKKRASGPKCPVTGKRIQGIPHLRPAESKRSRLPRNRRTVNRAYGGVLSGGAVRERIIRAFLVEEQKIVKKVLKIQKSKEKVTK

SEQ ID NO: 10023 - protein, 120 aa, Fraxinus spp
MVQRLTYRKRHSYATKSNQHRIVKTPGGKLVYQSSKKRASGPKCPVTGRRIQGIPHLRPAEYKRSRLSRNRRTVNRAYGGVLSGGAVRERIIRAFLVEEQKIVKKVLKIQKAKERLASKA

SEQ ID NO: 10024 - protein, 120 aa, Silene vulgaris
MVQRLTYRRRHSYATKSNQHRIVKTPGGRLVYQTTKKRASGPKCPVTGKRIQGIPHLRPTEYKRSRLPRNRRTVNRPYGGVLSGGAVRERIIRAFLIEEQKIVKKVLKIQKTKEKQAAKS

SEQ ID NO: 10025 - protein, 120 aa, Tripterygium wilfordii
MVQRLTFRTRHSYATKSNQNRVVKTPGGKLVYQSTKKRASGPKCPVTGKRIQGIPHLRPAEYKRSRLSRNRRTVNRSYGGVLSGGAVRERIIRAFLVEEQKIVKKVLKIQKAKEKLSSKS

SEQ ID NO: 10026 - protein, 120 aa, Valeriana officinalis
MVQRLTYRKRHSYATKSNQHRIVKTPGGKLVYQGTKKRASGPKCPVTGKRIQGIPHLRPTEYKRSRLSRNRRTVNRAYGGVLSGGAVRERIIRAFLVEEQKIVKKVLKIQKTKEKLSSKA

SEQ ID NO: 10027 - protein, 120 aa, Vinca minor
MVQRLTYRKRHSYATKSNQHRIVKTPGGKLVYQSTKKRASGPKCPVTGKRIQGIPHLRPAEYKRSRLSRNRRTVNRPYGGVLSGGAVRERIVRAFLVEEQKIVKKVLKIQKAKEKLAAKN

SEQ ID NO: 10028 - protein, 120 aa, Musa acuminata
MVQRLTYRKRHSYATKSNQTRVVKTPGGRLVYQYTNKRASGPKCPVTGKRIQGIPHLRPAEYKRSRLSRNQRTVNRAYGGVLSGSAVRERIIRAFLVEEQKIVKKVLKTQKAKEKQASKS

SEQ ID NO: 10029 - protein, 120 aa, Ocimum basilicum
MVQRLTYRTRHSYATKSNKHRIVKTPGGKLVYQTTKKRASGPKCPVTGKRIQGIPHLRPAEYKRSRLPRNERTVNRPYGGVLSGTAVRERIIRAFLVEEQKIVKKVLKIQKAKEKLASRS

SEQ ID NO: 10030 - protein, 120 aa, Beta vulgaris
MVQRLTYRRRHSYATKSNQHRIVKTPGGRLVYQTTKKRASGPKCPVTGKRIQGIPHLRPTEYKRSRLPRNRRTVNRPYGGVLSGSAVRERIIRAFLVEEQKIVKKVLKIQKTKEKQSSKS

SEQ ID NO: 10031 - protein, 119 aa, Pennisetum glaucum
MVQRLTYRKRHSYATKSNQTRVVKTPGGKLVYQYTKKRASGPKCPVTGKKIQGIPHLRPAEYKRSRLPRNRRTVNRPYGGVLSGTAVRERIIRAFLVEEQKIVKKVLKIQKTKDKASKS

SEQ ID NO: 10032 - protein, 120 aa, Tropaeolum majus
MVQRLTYRTRHSYATKSNQHRIVKTPGGKLVYQTTKKRASGPKCPVTGKRIQGIPHLRPTEYKRSRLPRNRRTVNRAYGGVLSAGAVRERIIRAFLVEEQKIVKKVLKLQKTKEKQSSKN

SEQ ID NO: 10033 - protein, 119 aa, Tropaeolum majus
MVQRLTYRTRHSYATKSNQHRIVKTPGGKLVYQTTKKRASGPKCPVTGKRIQGIPHLRPTEYKRSRLPRNRRTVNRAYGGVLSGSAVRERIIRAFLVEEQKIVKKVLKLQKAKEKVSKN

SEQ ID NO: 10034 - protein, 120 aa, Ananas comosus
MVQRLTYRKRHSYATKSNQTRVVKTPGGRLVYQYTNKRASGPKCPVTGKRIQGIPHLRPAEYKRSRLSRNRRTVNRAYGGVLSGGAVRERIIRAFLIEEQKIVKKVLKIQKAKDKQAPKS

SEQ ID NO: 10035 - protein, 120 aa, Tamarix hispida
MVQRLTYRTRHSYATKSNQHRIVKTPGGKLVYQTTKKRASGPKCPVTGKRIQGIPHLRPAEYRRTRLPRNRRTVNRAYGGVLSGSAVRERIIRAFLVEEQKIVKKVLKIQKAKEKLAARS

SEQ ID NO: 10036 - protein, 123 aa, Malus domestica
MVQRLTYRKRHSYATKSNQHRIVKTPGGKLIYQTTKKRASGPKCPVTGKRIQGIPHLRPAEYKRSRLSRNRRTVNRAYGGVLSGGAVRERIIRAFLVEEQKIVKKVLKIQKAKERQAEKGAKH

SEQ ID NO: 10037 - protein, 121 aa, Chelidonium majus
MVQRLTYRSRHSYATKSNQTRVVKTPGGKLVYQRTKKRASGPKCPVTGKRIQGIPHLRPTEYKRSRLSRNRRTVNRAYGGVLSGSAVRERIIRAFLVEEQKIVKKVLKIQKTKEKQAATKS

SEQ ID NO: 10038 - protein, 121 aa, Malus domestica
MVQRLTYRARHSYATKSNQHRIVKTPGGKLVYQTTKKRASGPKCPVTGKRIQGIPHLRPTEYKRSRLSRNRRTVNRAYGGVLSGGAVKERIIRAFLVEEQKIVKKVLKIQKTKEKQAAKTK

SEQ ID NO: 10039 - protein, 122 aa, Camellia sinensis
MVQRLTYRKRHSYATKSNQHRIVKTPGGKLVYQSTKKRASGPKCPVTGKRIQGIPHLRPAEYKRSRLSRNRRTVNRAYGGVLSGGAVRERIIRAFLVEEQKIVKKVLKIQKSKEKQAARAKL

SEQ ID NO: 10040 - protein, 119 aa, Cannabis sativa
MVQRLTYRSRHSYATKSNQHRIVKTPGGKLVYQTTKKRASGPKCPITGKRIQGIPHLRPTEYKRSRLSRNRRTVNRAYGGVLSGSAVRERIIRAFLVEEQKIVKKVLKIQKAKEKLAAK

SEQ ID NO: 10041 - protein, 120 aa, Chelidonium majus
MVQRLTYRSRHSYATKSNQNRVVKTPGGKLVYQRTKKRASGPKCPVTGKRIQGIPHLRPTEYKRSRLSRNRRTVNRAYGGVLSGSAVRERIIRAFLVEEQKIVKKVLKIQKTKEKIAAKS

SEQ ID NO: 10042 - protein, 120 aa, Fagopyrum esculentum
MVQRLTYRKRHSYATKSNQHRIVKTPGGKLVYQTTKKRASGPKCPVTGKRIQGIPHLRPTEYKRSRLARNRRTVNRPYGGVLSGSAVRERIIRAFLIEEQKIVKKVLKIQKAKDKQSSKA

SEQ ID NO: 10043 - protein, 120 aa, Fagopyrum esculentum
MVQRLTYRKRHSYATKSNQHRIVKTPGGKLVYQTTKKRASGPKCPVTGKRIQGIPHLRPTEYKRSRLARNRRTVNRPYGGVLSGSAVRERIIRAFLIEEQKIVKKVLKIQKTKEKQAAKN

SEQ ID NO: 10044 - protein, 118 aa, Linum usitatissimum
MVQRLTYRKRHSYAPKSNQHRIVKTPGGKLVYQTPKKRASGPKCPVTGKRIQGIPHLRPAEYKRSRLPRNRRTVNRAYGGVLSGGAVRERIIRAFLVEEQKIVKKVLKIQKSKEKVPK

SEQ ID NO: 10045 - protein, 120 aa, Fraxinus spp
MVQRLTYRERHSYATKSNQHRIIKTPGGKLVYQSTKKRASGPKCPVTGKRIQGIPHLRPAEYKRSRLSRNRRTVNRAYGGVLSGSAVRERIIRAFLVEEQKIVKKVLKIQKTKEKLATKS

SEQ ID NO: 10046 - protein, 120 aa, Phalaenopsis aphrodite
MVQRLTYRKRHSYATKSNQTRVVKTPGGKLVYQYTKKRASGPKCPVTGKRIIGIPRLRPAEYKRSRLQRNRRTVHRAYGGVLSGGAVRERIIRAFLVEEQKIVKKVLKIQKAKDKLAAKS

SEQ ID NO: 10047 - protein, 99 aa, Primula obconica
MYYVIFGFCVFYLYLFLEFAVNSNELSHVCFKLWICSSCGSGYCYFKVINVSCPHRVWNRPYGCDIFSGLLLNLLVCAFGITVLYSSSVSLYWTTGLNF

SEQ ID NO: 10048 - protein, 120 aa, Sarracenia psittacina
MVQRLTYRKRHGYATKSNQHRIVKTPGGRLVYQSTMKRASGPKCPVTGKRIQGIPHLRPAEYKRSRLSRNQRTVNRAYGGVLSGGTVRERIIRAFLVEEQKIVKKVLKIQKAKEKQAGKS

SEQ ID NO: 10049 - protein, 120 aa, Utricularia gibba
MVQRLTYRTRHSYATKSNQHRIVKTPGGKLVYQTTKKRASGPKCPVTGKRIQGIPHLRPTEYSKSRLSRNRRTVSRAYGGVLSGGAVRERIIRAFLIEEQKIVKKVLKIQKAKEKLASKS

SEQ ID NO: 10050 - protein, 117 aa, Valeriana officinalis
RLTYRKRHSYATKSNQNRVVKTPGGKLVYQTTKKRASGPKCPVTGKRIQGIPHLRPAEYKRSRLSRNRRTVNRAYGGVLSGSAVRERIIRAFLVEEQKIVKKVLKIQKTKEKAAGKS

SEQ ID NO: 10051 - protein, 120 aa, Artemisia annua
MVQRLTYRKRHSYATKSNQHRVLKTPGGKLVYQTTKKRASGPKCPVTGKRIQGIPHLRPTEYKRSRLSRNRRTVNRAYGGVLSAGAVRERIIRAFLVEEQKIVKKVLKIQKQKEKTSAKN

SEQ ID NO: 10052 - protein, 120 aa, Musa acuminata
MVQRLTYRKRHGYATKSNQTRVVKTPGGRLVYQYANKRASGPKCPVTGKRIQGIPHLRPAQYKRSRLSRNRRTVNRAYGGVLSGSAVRERIIRAFLVEEQKIVKKVLKIQKAKEKQASKS

SEQ ID NO: 10053 - protein, 120 aa, Cleome gynandra
MVQRLVYRSRHSYATKSNQHRVVKTPGGKLVYQTTKKRASGPKCPVTGKRIQGIPHLRPVEYKRSRLSRNRRTVNRAYGGVLSGSAVRERIIRAFLVEEQKIVKKVLKLQKAKEKLSAKS

SEQ ID NO: 10054 - protein, 120 aa, Cleome gynandra
MVQRLVYRSRHSYATKSNQHRIVKTPGGKLVYQTTKKRASGPKCPVTGKRIQGIPHLRPVEYKRSRLSRNRRTVNRAYGGVLSGSAVRERIIRAFLVEEQKIVKKVLKLQKAKEKLAGKS

SEQ ID NO: 10055 - protein, 120 aa, Cleome spinosa
MVQRLTYRGRHSYATKSNQHRVVKTPGGKLVYQTTKKRASGPKCPVTGKRIQGIPHMRPAEYKRSRLSRNRRTVNRPYGGVLSGSAVRERIIRAFLVEEQKIVKKVLKLQKAKEKLSAKS

SEQ ID NO: 10056 - protein, 119 aa, Eschscholzia californica
MVQRLTYRSRHSYATKSNQTRVVKTPGGKLVYQRTKKRASGPKCPVTGKRIQGIPHLRPAEYKRSRLSRNRRTVNRAYGGVLSGSAVRERIIRAFLVEEQKIVKKVLKIQKAKEKTTKA

SEQ ID NO: 10057 - protein, 116 aa, Actinidia deliciosa
RLTYRKRHSYATKSNQNRVVKTPGGRLVYQSTKKRASGPKCPVTGKRIQGIPHLRPTEYKRSRLSRNRRTVNRAYGGVLSGGAVRERIIRAFLVEEQKIVKKVLKIQKAKEKASKS

SEQ ID NO: 10058 - protein, 120 aa, Nicotiana benthamiana
  misc_feature (120)..(120): Xaa can be any naturally occurring amino acid
MVQRLTYRKRHSYATKSNQHRVVKTPGGKLIYQSTKKRASGPKCPVTGKRIQGIPHLRPTEYKRSRLSRNRRTVNRPYGGVLSGSAVRERIIRAFLVEEQKIVKKVLKIQKAKEKLAAKX

SEQ ID NO: 10059 - protein, 120 aa, Fragaria vesca
MVQRLVYRSRHSYATKSNQHRIVKTPGGKLVYQTTKKRASGPKCPVTGKRIQGIPHLRPAEYKRSRLSRNRRTVNRAYGGVLSGAAVKERIIRAFLVEEQKIVKKVLKIQKAKEKLAAKH

SEQ ID NO: 10060 - protein, 89 aa, Zinnia violacea
PATAKPVTTTFSAKWCNGSHTVTRHSYSTKSNQHRVVKTPGGKLVYQTTKKRASGPKCPVTGKRIQGIPHFDDLLNTSGRALSRNRSNC

SEQ ID NO: 10061 - protein, 123 aa, Malus domestica
MVQRLTYRKRHSYATKSNQHRIVKTPGGKLIYQTTKKRASGPKCPVTGKRIQGIPHLRPAEYKRSRLSRNRRTVNRAYGGVLSGGAVKERIIRAFLVEEQKIVKKVLKIQKAKERQAEKGARS

SEQ ID NO: 10062 - protein, 120 aa, Fagopyrum esculentum
MVQRLTYRKRHSYATKSNQHRIVKTPGGKLVYQTTKKRASGPKCPVTGKRIQGIPHLRPTEYKRSRLARNRRTVNRPYGGVLSGSAVRERIIRAFLIEEQKIVKKVLKIQKAKDKQSAKA

SEQ ID NO: 10063 - protein, 120 aa, Phalaenopsis aphrodite
MVQRLTYRKRHSYATKSNQTRVVKTPGGRLIYQYTKKRASGPKCPVTGKRIIGIPRLRPAEYKRSRLSRNRRTVHRAYGGVLSGGAVRERIIRAFLVEEQKIVKKVLKMQKAKEKQAAKS

SEQ ID NO: 10064 - protein, 120 aa, Silene vulgaris
MVQRLTYRRSHSYATKSNQHRIVKTPGGRLVYQTTKKRASGPKCPVTGKRIQGIPHLRPTEYKRSRLPRNRRTVNRPYGGVLSGGAVRERIIRAFLIEEQKIVKKVLKIQKTKEKQASRT

SEQ ID NO: 10065 - protein, 120 aa, Eutrema parvulum
MVQRLVYRSRHSYATKSNQHRIVKTPGGKLTYQTTKKRASGPKCPVTGKRIQGIPHLRPAEYKRSRLSRNRRTVNRAYGGVLSALAVRERIIRAFLVEEQKIVKKVLKLQKAKEKVAPKS

SEQ ID NO: 10066 - protein, 120 aa, Unknown [sequence omitted]

SEQ ID NO: 10067 - protein, 120 aa, Arabidopsis lyrata
MVQRLVYRSRHSYATKSNQHRIVKTPGGKLTYQTTKKRASGPKCPVTGKRIQGIPHLRPSEYKRSRLSRNRRTVNRAYGGVLSGSAVRERIIRAFLVEEQKIVKKVLKLQKAKEKVAPKS

SEQ ID NO: 10068 - protein, 120 aa, Musa acuminata
MVQRLTYRKRHGYATKSNQTRVVKTPGGKLVYQYTNKRASGPICPVTGKRIQGIPHLRPAEYKRSRLARSQRTVNRAYGGVLAGGAVKERIIRAFLVEEQKIVKKVLKIQKAKEKQASKS

SEQ ID NO: 10069 - protein, 110 aa, Bruguiera gymnorhiza
MVQRLTYRKRHSYATKSNQHRVVKTPGGKLVYQTTKKRASGPKCPVTGKRIQGIPHLRPAEYKRSRLPRNRRTVNRAYGGVLSGGAVRERIIRAFLVEEQKIVKKVLKIQ

SEQ ID NO: 10070 - protein, 120 aa, Eschscholzia californica
MVQRLTYRSRHSYATKSNQTRVVKTPGGKLVYQRTKKRASGPKCPVTGKRIQGIPHLRPAEYKRSRLSRNRRTVNRAYGGVLSGSAVRERIIRAFLVEEQKIVKKVLKIQKSKEKTSTKA

SEQ ID NO: 10071 - protein, 119 aa, Unknown
  Sequence found in Organisms: Sorghum bicolor, Setaria italica, Panicum virgatum
MVQRLTYRKRHSYATKSNQTRVVKTPGGRLVYQYTKKRASGPKCPVTGKKIQGIPHLRPAEYKRSRLSRNRRTVNRPYGGVLSGTAVRERIIRAFLVEEQKIVKKVLKIQKTKDKASKS

SEQ ID NO: 10072 - protein, 119 aa, Lolium multiflorum
MVQRLTYRKRHSYATKSNQTRVVKTPGGKLVYQYTKKRASGPKCPVTGKNIQGIPHLRPTEYKRSRLSRNRRTVNRPYGGVLSGPAVRERIIRAFLVEEQKIVKKVLKIQKTKEKQPSK

SEQ ID NO: 10073 - protein, 119 aa, Zea mays
MVQRLTYRKRHSYATKSNQTRVVKTPGGKLVYQYTKKRASGPKCPVTGKKIQGIPHLRPAEYKRSRLARNQRTVNRPYGGVLSGTAVRERIIRAFLVEEQKIVKKVLKIQKTKDKASKS

SEQ ID NO: 10074 - protein, 119 aa, Pennisetum glaucum
MVQRLTYRKRHSYATKSNQTRVVKTPGGKLVYQYTKKRASGPKCPVTGKKIQGIPHLRPAEYKRSRLPRNRRTVNRPYGGVLSGTAVRERIIRAFLVEEQKIVKKVLKIQKTKDKAATK

SEQ ID NO: 10075 - protein, 120 aa, Nuphar advena
  misc_feature (120)..(120): Xaa can be any naturally occurring amino acid
MVQRLTYRKRHSYATKSNQTRVVKTPGGKLVYQTSKKRAKGPRCPVTKKRIQGIPHLRPTEYKRSRLSRNRRTVNRAYGGVLSGSAVRERIIRAFLVEEQKIVKKVLKIQKAKEKQAAKX

SEQ ID NO: 10076 - protein, 120 aa, Elaeis guineensis
MVQRLTYRKRHSYATKSNQTRVVKTPGGKLVYQYTNKRASGPRCPVTGKRIQGIPHRRPAEYRRSRLSRNRRTVNRAYGGVLSGSAVRERIIRAFLVEEQKIVKKVLKIQKVKEKQAFKS

SEQ ID NO: 10077 - protein, 119 aa, Carica papaya
MVQRLTYRTRHGYATKSNQHRVVKTPGGRLVYQSTKKRASGPKCPVTGKRIQGIPHLRPAEYKRSRLPRNRRTVNRAYGGVLSGGAVRERIIRAFLVEEQKIVKKVLKLRKTKEKETSK

SEQ ID NO: 10078 - protein, 119 aa, Oryza sativa
MVQRLTYRKRHSYATKSNQTRVVKTPGGKLVYQYTKKRASGPKCPVTGKKIQGIPHLRPAEYKRSRLSRNRRTVNRPYGGVLSGTAVRERIIRAFLVEEQKIVKKVLKIQKTKDKSASK

SEQ ID NO: 10079 - protein, 119 aa, Panicum virgatum
MVQRLTYRKRHSYATKSNQTRVVKTPGGKLVYQYTKKRASGPKCPVTGKKIQGIPHLRPAEYKRSRLSRNRRTVNRPYGGVLSGTAVRERIIRAFLVEEQKIVKKVLKIQKTKDKTASK

SEQ ID NO: 10080 - protein, 120 aa, Tamarix hispida
MVQRLTYRSRHSYATKSNQHRIVKTPGGKLVYQTTKKRASGPKCPVTGKRIQGIPHLRPAEYRRTRLPRNRRTVNRAYGGVLAASAVRERIIRAFLVEEQKIVKKVLKIQKAKEKLAARS

SEQ ID NO: 10081 - protein, 120 aa, Zamia vazquezii
MVQRLTYRRRHSYATKSNKTRVVKTPGGKLIYQTAKKRASGPKCAVTGKRIQGIPHLRPAEYKRSRLPRNRRTVNRAYGGVLSGSAVRERIIRAFLVEEQKIVKKVLKIQKAKEKQTARS

SEQ ID NO: 10082 - protein, 74 aa, Humulus lupulus
GSPESQSSFIKQSKMVQRLTYRTRHSYATKSNQHRIVKTPGGKLVYQTTKKRASGPKCPITGKRIQGDSSLETN

SEQ ID NO: 10083 - protein, 151 aa, Lippia dulcis
MVQRLTYRKRHSYATKSNQHRVVKTPGGKLVYQTTKKRASGPKCPVTGKRIQGIPHLRPAEYKRSRLSRNRRTVNRAYGGILSGGAVRERIIRAFLVEEQKIVKKVLKLQKLKERLLARAKCDFCAELVFYHGTIVRVLSLISVFFFPSVC

SEQ ID NO: 10084 - protein, 52 aa, Curcuma longa
MDLFCSCVCGIVCGDVRIDVIHEVIGLQIFMCFFFIHVHVRNKPPAEFGTKR

SEQ ID NO: 10085 - protein, 61 aa, Mesembryanthemum crystallinum
SSRAFGTSGSRTESVTATPPSLTSTGLLKHLGAGWYIREPRRERAVRNALLQEREFKGFLT

SEQ ID NO: 10086 - protein, 61 aa, Actinidia deliciosa
  misc_feature (44)..(44): Xaa can be any naturally occurring amino acid
MVQRLTYCKRHSYATKSNQLRIVKTPGGKLVYQSTKKRASGPKXPVTGKRIQGIPHLRPAE

SEQ ID NO: 10087 - protein, 181 aa, Brassica napus
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIAGKA

SEQ ID NO: 10088 - protein, 119 aa, Unknown
  Sequence found in Organisms: Setaria italica, Panicum virgatum
MVQRLTYRKRHSYATKSNQTRVVKTPGGRLVYQYTKKRASGPKCPVTGKKIQGIPHLRPAEYKRSRLSRNRRTVNRPYGGVLSGQAVRERIIRAFLVEEQKIVKKVLKIQKTKEKTTSK

SEQ ID NO: 10089 - protein, 119 aa, Avena sativa
MVQRLTYRKRHSYATKSNQTRVVKTPGGKLVYQYTKKRASGPKCPVTGKKIQGIPHLRPTEYKRSRLSRNRRTVNRPYGGVLSGPAVRERIIRAFLVEEQKIVKKVLKIQKTKEKQPAK

SEQ ID NO: 10090 - protein, 119 aa, Unknown
  Sequence found in Organisms: Festuca arundinacea, Avena sativa, Triticum aestivum
MVQRLTYRKRHSYATKSNQTRVVKTPGGKLVYQYTKKRASGPKCPVTGKKIQGIPHLRPTEYKRSRLSRNRRTVNRPYGGVLSGPAVRERIIRAFLVEEQKIVKKVLKIQKTKEKTTKS

SEQ ID NO: 10091 - protein, 120 aa, Unknown
  Sequence found in Organisms: Thellungiella halophila, Eutrema halophilum
MVQRLVYRSRHSYATKSNQHRIVKTPGGKLTYQTTKKRASGPKCPVTGKRIQGIPHLRPSEYKRSRLSRNRRTVNRAYGGVLSASAVRERIIRAFLVEEQKIVKKVLKLQKAKEKVAPKS

SEQ ID NO: 10092 - protein, 120 aa, Eutrema halophilum
MVQRLVYRSRHSYATKSNQHRIVKTPGGKLVYQTSKKRASGPKCPVTGKRIQGIPHLRPAEYKRSRLSRNRRTVNRAYGGVLSASAVRERIIRAFLVEEQKIVKKVLKLQKAKEKVAPKA

SEQ ID NO: 10093 - protein, 118 aa, Utricularia gibba
QRLTYRTRHSYATKSNQHRIVKTPGGKLVYQTTKKRASGPKCPVTGKRIQGIPHLRPAEYSNSRLSRNRRTISRAYGGVLSGGAVRERIIRAFLIEEQKIVKKVLKIQKAKEKLASKS

SEQ ID NO: 10094 - protein, 119 aa, Arabidopsis thaliana
MVQRLVYRSRHSYATKSNQHRIVKTPGGKLTYQTTKKRASGPKCPVTGKRIQGIPHLRPTEYKRSRLSRNRRTVNRAYGGVLSGSAVRERIIRAFLVEEQKIVKKVLKLQKAKEKVAPK

SEQ ID NO: 10095 - protein, 120 aa, Unknown
  Sequence found in Organisms: Brassica napus, Brassica juncea, Brassica rapa
MVQRLVYRSRHSYATKSNQHRIVKTPGGKLTYQTTKKRASGPKCPVTGKRIQGIPHLRPAEYKRSRLSRNRRTVNRAYGGVLSALAVRERIVRAFLVEEQKIVKKVLKLQKAKEKVAPKS

SEQ ID NO: 10096 - protein, 119 aa, Unknown
  Sequence found in Organisms: Hordeum vulgare, Triticum aestivum
MVQRLTYRKRHSYATKSNQTRVVKTPGGRLVYQYTKKRASGPKCPVTGKKIQGIPHLRPTEYKRSRLSRNRRTVNRPYGGVLSGQAVRERIIRAFLVEEQKIVKKVLKIQKTKEKQPSK

SEQ ID NO: 10097 - protein, 119 aa, Brassica napus
VQRLVYRSRHSYATKSNQHRIVKTPGGRLVYQTTKKRASGPKCPVTGKRIQGIPHLRPTEYKRSRLPRNRRTVNRPYGGVLSGGAVRERIIRAFLIEEQKIVKKVLKMQKAKEKVAGKS

SEQ ID NO: 10098 - protein, 119 aa, Unknown
  Sequence found in Organisms: Cenchrus ciliaris, Setaria italica
MVQRLTYRKRHSYATKSNQTRVVKTPGGKLVYQYTKKRASGPKCPVTGKKIQGIPHLRPAEYKRSRLSRNRRTVNRPYGGVLSGTAVRERIIRAFLVEEQKIVKKVLKIQKTKDKTATK

SEQ ID NO: 10099 - protein, 120 aa, Cleome gynandra
MVQRLTYQGRHSYATKSNQHRVVKTPGGKLVYQTTKKRASGPKCPVTGKRIQGIPHLRPAEYKRSRLGRNKRTVNRVYGGVLSGSSVRERIIRAFLVEEQKIVKKVLKLQKAKEKLAAKN

SEQ ID NO: 10100 - protein, 119 aa, Unknown
  Sequence found in Organisms: Cynodon dactylon, Eragrostis curvula
MVQRLTYRKRHSYATKSNQTRVVKTPGGRLVYQYTNKRASGPKCPVTGKKIQGIPHLRPAQYKRSRLPRNRRTVNRPYGGVLSGQAVRERIIRAFLVEEQKIVKKVLKIQKTKEKQPSK

SEQ ID NO: 10101 - protein, 119 aa, Festuca arundinacea
MVQRLTYRKRHSYATKSNQTRVVKTPGGKLVYQYTKKRASGPKCPVTGKKIQGIPHLRPTEYKRSRLSRNRRTVNRPYGGVLSGPAVRERIIRAFLVEEQKIVKKVLKIQKTKDKTASK

SEQ ID NO: 10102 - protein, 119 aa, Zea mays
MVQRLTYRKRHSYATKSNQTRVVKTPGGRLVYQYTKKRASGPKCPVTGKKIQGIPHLRPAEYKRSRLARNRRTVNRPYGGVLSGTAVRERIIRAFLVEEQKIVKKVLKIQKTKDKASKN

SEQ ID NO: 10103 - protein, 119 aa, Zea mays
MVQRLTYRKRHSYATKSNQTRVVKTPGGKLVYQYTKKRASGPKCPVTGKKIQGIPHLRPAEYKRSRLPRSRRTVNRPYGGVLSGIAVRERIIRAFLVEEQKIVKKVLKIQKTKDKTAAK

SEQ ID NO: 10104 - protein, 119 aa, Pennisetum glaucum
MVQRLTYRKRHSYATKSNQTRVVKTPGGRLVYQYTKKRASGPKCPVTGKKIQGIPHLRPAEYKRSRLPRNRRTVNRPYGGVLSGQAVRERIIRAFLVEEQKIVKKVLKIQNTKEKTTSK

SEQ ID NO: 10105 - protein, 120 aa, Nuphar advena
  misc_feature (9)..(9): Xaa can be any naturally occurring amino acid
  misc_feature (20)..(20): Xaa can be any naturally occurring amino acid
MVQRLTYRXRHSYATKSNQXRVVKTPGGRLVYQTSKKRAKGPQCPVTHKRIQGIPHLRPTEYKRSRLSRNRRTVNRAYGGVLSGSAVRERIIRAFLVEEQKIVKKVLKIQKAKEKQAAKS

SEQ ID NO: 10106 - protein, 120 aa, Papaver somniferum
MVQRLIYRSRHSYATKSNQNRVVKTPGGNNVYQRTKKRASGPKCPVTGKRIQGIPHLRPAEYKRSRLSRNRRTVNRAYGGVLSGSAVRERIIRAFLVEEQKIVKKVLKIQKQKEKVAGKS

SEQ ID NO: 10107 - protein, 120 aa, Rosa hybrid cultivar
MVQRLVYRSRHSYATKSNQHRIVKTPGGKLVYQTSKKRASGPKCPVTGKRIQGIPHLRPAEYKRSRLSRNRRTVNRAYGGVLSGAAVKERIIRAFLVEEQKIVKKVLKIQKAKEKLSAKH

SEQ ID NO: 10108 - protein, 119 aa, Unknown
  Sequence found in Organisms: Sorghum bicolor, Saccharum officinarum, Triticum aestivum
MVQRLTYRKRHSYATKSNQTRVVKTPGGKLVYQYTKKRASGPKCPVTGKKIQGIPHLRPAEYKRSRLSRNRRTVNRPYGGVLSGIAVRERIIRAFLVEEQKIVKKVLKIQKTKDKTAAK

SEQ ID NO: 10109 - protein, 119 aa, Zostera marina
MVQRLTYRKRHSYATKSNQTRVVKTPGGKLVYQNTKKRASGPKCPVTGKRIQGIPHLRPTEYKRSRLSRNRRTVNRAYGGVLSGNAVRERVVRAFLIEEQKIVKKVLKIQKTKEKQSKN

SEQ ID NO: 10110 - protein, 120 aa, Unknown
  Sequence found in Organisms: Brassica napus, Brassica juncea, Brassica oleracea, Brassica rapa
MVQRLVYRSRHSYATKSNQHRIVKTPGGKLTYQTTKKRASGPKCPVTGKRIQGIPHLRPAEYKRSRLSRNRRTVNRAYGGVLSALAVRERIVRAFLVEEQKIVKKVLKLQKAKEKVAPRS

SEQ ID NO: 10111 - protein, 120 aa, Brassica napus
MVQRLVYRSRHSYATKSNQHRIVKTPGGKLTYQTTKKRASGPKCPVTGKRIQGIPHLRPAEYKRSRLSRNRRTVNRAYGGVLSALAVRERIVRAFLVEEQKIVKKVLKLQKAKEKLAPRS

SEQ ID NO: 10112 - protein, 119 aa, Avena sativa
MVQRLTYRKRHSYATKSNQTRVVKTPGGKLVYQYTKKRASGPKCPVTGKKIQGIPHLRPTEYKRSRLSRNRRTVNRPYGGVLSGPAVRERIIRAFLVEEQKIVKKVLKIQKTKDKTTSK

SEQ ID NO: 10113 - protein, 120 aa, Arabidopsis thaliana
MVQRLVYRSRHSYATKSNQHRIVKTPGGKLTYQTTNKRASGPKCPVTGKRIQGIPHLRPAEYKRSRLARNERTVNRAYGGVLSGVAVRERIVRAFLVEEQKIVKKVLKLQKAKEKTAPKS

SEQ ID NO: 10114 - protein, 120 aa, Brassica juncea
MVQRLVYRSRHSYATKSNQHRILKTPGGKLTYQTTKKRASGPKCPVTGKRIQGIPHLRPAEYKRSRLSRNRRTVNRAYGGVLSALAVRERIVRAFLVEEQKIVKKVLKLQKAKEKVAPKS

SEQ ID NO: 10115 - protein, 120 aa, Unknown
  Sequence found in Organisms: Brassica napus, Brassica juncea, Brassica rapa
MVQRLVYRSRHSYATKSNQHRIVKTPGGKLTYQTTKKRASGPKCPVTGKRIQGIPHLRPAEYKRSRLSRNRRTVNRAYGGVLSGLAVKDRIVRAFLVEEQKIVKKVLKLQKAKEKTAPKS

SEQ ID NO: 10116 - protein, 119 aa, Unknown
  Sequence found in Organisms: Hordeum vulgare, Triticum aestivum
MVQRLTYRKRHSYATKSNQTRVVKTPGGKLVYQYTKKRASGPKCPVTGKKIQGIPHLRPTEYKRSRLSRNRRTVNRPYGGVLSGTAVRERIIRAFLVEEQKIVKKVLKIQKTKDKTTSK

SEQ ID NO: 10117 - protein, 119 aa, Unknown
  Sequence found in Organisms: Hordeum vulgare, Pseudoroegneria spicata
MVQRLTYRKRHSYATKSNQTRVVKTPGGRLVYQYTKKRASGPKCPVTGKKIQGIPHLRPTEYKRSRLSRNRRTVNRPYGGVLSGPAVRERIIRAFLVEEQKIVKKVLKIQKTKEKTTKS

SEQ ID NO: 10118 - protein, 120 aa, Cleome spinosa
MVQRLTYRGRHSFATKSNQHRVVKTPGGRLVYQTTKKRASGPKCPVTGKRIQGIPHLRPAEYKVSRLARNRRTVNRVYGGVLSSSAVKERIIRAFLVEEQKIVKKVLKLQKAKEKLASRS

SEQ ID NO: 10119 - protein, 119 aa, Setaria italica
MVQRLTYRKRHSYATKSNQTRVVKTPGGRLVYQYTKKRASGPKCPVTGKKIQGIPHLRPAEYKRSRLSRNRRTVNRPYGGVLSGTAVRERIIRAFLVEEQKIVKKVLKIQKTKDKAATK

SEQ ID NO: 10120 - protein, 119 aa, Unknown
  Sequence found in Organisms: Lolium multiflorum, Avena sativa
MVQRLTYRKRHSYATKSNQTRVVKTPGGKLVYQYTKKRASGPKCPVTGKKIQGIPHLRPTEYKRSRLSRNRRTVNRPYGGVLSGPAVRERIIRAFLVEEQKIVKKVLKIQKTKDKTATK

SEQ ID NO: 10121 - protein, 119 aa, Eragrostis curvula
MVQRLTYRKRHSYATKSNQTRVVKTPGGRLVYQYTNKRASGPKCPVTGKKIQGIPHLRPAEYKRSRLPRNRRTVNRPYGGVLSGIAVRERIIRAFLVEEQKIVKKVLKIQKTKDKTATK

SEQ ID NO: 10122 - protein, 119 aa, Zea mays
MVQRLTYRKRHSYATKSNQTRVVKTPGGKLVYQYTKKRASGPKCPVTGKKIQGIPHLRPAEYKRSRLSRNHRTVNRPYGGVLSGIAVRERIIRAFLVEEQKIVKKVLKIQKTKDKTAAK

SEQ ID NO: 10123 - protein, 120 aa, Zea mays
MVQRLTYRKRHSYATKSNQTRVVKTPGGKLVYQYTKKRASGPKCPVTGKKIQGIPHLRPAEYKRSRLSRNRRTVNRPYGGVLSGTAVRERIIRAFLVEEQKIVKKVLKLQKTKDKTSSKK

SEQ ID NO: 10124 - protein, 111 aa, Senecio madagascariensis
MVQRLTYRKRHSYATKSNQHRVVKTPGGKLVYQTTKKRASGPKCPVTGKRIQGIPHLRPTEYKRSRLSRNRRTVNRAYGGVLSAGAVRERIIRAFLVEEQKIVKKVLKIQK

SEQ ID NO: 10125 - protein, 119 aa, Sorghum bicolor
MVQRLTYRKRHSYATKSNQTRVVKTPGGKLVYQYTKKRASGPKCPVTGKKIQGIPHLRPAEYKRSRLSRNRRTVNRPYGGVLSGTAVRERIIRAFLVEEQKIVKKVLKLQKTKDKTSSK

SEQ ID NO: 10126 - protein, 119 aa, Saccharum officinarum
MVQRLTYRKRHSYATKSNQTRVVKTPGGKLVYQYTKKRASGPKCPVTGKKIQGIPHLRPAEYKRSRLSRNRRTVNRPYGGVLSGPAVRERIIRAFLVEEQKIVKKVLKLQKTKDKTSSK

SEQ ID NO: 10127 - protein, 119 aa, Panicum virgatum
MVQRLTYRKRHSYATKSNQTRVVKTPGGRLVYQYTKKRASGPKCPVTGKKIQGIPHLRPAEYKRSRLSRNRRTVNRPYGGVLSGTAVRERIIRAFLVEEQKIVKKVLKIQKTKDKTATK

SEQ ID NO: 10128 - protein, 74 aa, Tamarix hispida
MVQRLTYRTRHSYSTKSNQHRIVKTPGGKLVYQTTKKRASGPKCPVTGKRIQGIPHLRPAEYKRTRLPEEQAYC

SEQ ID NO: 10129 - protein, 119 aa, Zostera marina
MVQRLTYRKRHSYATRSNQTRVVKTPGGKLVYQNTKKRASGPKCPVTGKRIQGIPHLRPTEYKRSRLARNRRTVNRAYGGVLSGNAVRERVIRAFLIEEQKIVKKVLKIQKTKEKQTKA

SEQ ID NO: 10130 - protein, 120 aa, Unknown
  Sequence found in Organisms: Abies balsamea, Pinus taeda
MVQRLTYRKRHSYATKSNQTRVLKTPGGRLIYQTAKKRASGPKCPVTGKRIHGIPHLRPAEYKRSRLSRNRRTVNRAYGGVLSGSAVRDRIIRAFLVEEQKIVKKVLKIQKSKEKQTTRS

SEQ ID NO: 10131 - protein, 120 aa, Abies balsamea
MVQRLTYRKRHSYATKSNQTRVLKTPGGRLIYQTAKKRASGPKCPVTGKRIHGIPHLRPAEYKRSRLSRNRRTVNRAYGGVLSGSAVRDRIIRAFLVEEQKIVKKVLKIQKSKEKQTARS

SEQ ID NO: 10132 - protein, 119 aa, Brassica napus
VQRLVYRSRHSYATKSNQHRIVKTPGGKLTYQTTKKRASGPKCPVTGKRIQGIPHLRPAEYKRSRLSRNRRTVNRAYGGVLSALAVRERIVRAFLVEEQKIVKKVLKLQKAKEKVAPRS

SEQ ID NO: 10133 - protein, 111 aa, Flaveria ramosissima
RHSYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKIQKAKEKTASKA

SEQ ID NO: 10134 - protein, 120 aa, Pinus pinaster
MVQRLTYRKRHSYATKSNQTRVLKTPGGKLIYQTAKKRASGPKCPVTGKRIHGIPHLRPAEYKRSRLSRNRRTVNRAYGGVLSGSAVRDRIIRAFLVEEQKIVKKVLKMQKSKEKQSARS

SEQ ID NO: 10135 - protein, 120 aa, Brassica juncea
MVQRLVYRSRHSYATKSNQHRILKTPGGKLTYQTTKKRASGPKCPVTGKRIQGIPHLRPAEYKRSRLSRNRRTVNRAYGGVLSALAVRERIVRAFLVEEQKIVKKVLKLQKAKEKVAPRS

SEQ ID NO: 10136 - protein, 120 aa, Brassica juncea
MVQRLVYRSRHSYATKSNQHRLVKTPGGKLVYQTTKKRASGPKCPVTGKRIHGIPHLRPTEYKRSRLSRNRRTVNRAYGGVLSALAVRERIVRAFLVEEQKIVKKVLKLQKAKEKVATKA

SEQ ID NO: 10137 - protein, 120 aa, Brassica juncea
MVQRLVYRSRHSYATKSNQHRIVKTPGGKLVYQTTKKRASGPKCPVTGKRIHGIPHLRPTEYKRSRLSRNRRTVNRAYGGVLSALAVRERIVRAFLVEEQKIVKKVLKLQKAKEKVANKA

SEQ ID NO: 10138 - protein, 119 aa, Brachypodium distachyon
MVQRLTYRKRHSYATKSNQTRVVKTPGGKLVYQYTKKRASGPKCPVTGKKIQGIPHLRPTEYKRSRLSRNRRTVNRPYGGVLSGPAVRERIIRAFLVEEQKIVKKVLKIQKTKDKTTKA

SEQ ID NO: 10139 - protein, 120 aa, Brassica napus
MVQRLVYRSRHSYATKSNQHRIVKTPGGKLVYQTTKKRASGPKCPVTGKRIHGIPHLRPTEYKRSRLSRNRRTVNRAYGGVLSALAVRERIVRAFLVEEQKIVKKVLKLQKAKEKVATKA

SEQ ID NO: 10140 - protein, 120 aa, Gnetum gnemon
MVQRLTYRKRHSYATKSNQRRVVKTPGGKLTFQTAKKRASGPKCPVTGKRIHGIPHLRTAEYSRSRLSRSRRTVNRAYGGVLSGVAVRERIIRAFLVEEQKIVKKVLKIQKMKEKQSAKS

SEQ ID NO: 10141 - protein, 110 aa, Populus trichocarpa
MVQRLTYRKRHSYATKSNQHRVVKTPGGKLVYQTTKKRASGPKCPVTGKRIQGRSRLSRNRRTVNRAYGGVLSGSAVRERIIRAFLVEEQKIVKKVLKIQKAKEKQASRS

SEQ ID NO: 10142 - protein, 118 aa, Oryza sativa
MVQRLTYRKRHSYATKSNQTRVVKTPGGRLVYQYTKKRASGPKCPVTGKKIQGIPHLRPAEYKRSRLSRNRRTVNRPYGGVLSGTAVRERIIRAFLVEEQKIVKKVLKIQKTKDKSAK

SEQ ID NO: 10143 - protein, 118 aa, Oryza sativa
MVQRLTYRKRHSYATKSNQTRVVKTPGGRLVYQYTKKRASGPKCPVTGKKIQGIPHLRPAEYKRSRLSRNRRTVNRPYGGVLSGTAVRERIIRAFLVEEQKIVKKVLKIQKTKDKTAK

SEQ ID NO: 10144 - protein, 119 aa, Secale cereale
  misc_feature (114)..(114): Xaa can be any naturally occurring amino acid
MVQRLTYRKRHSYATKSNQTRVVKTPGGKLVYQYTKKRASGPKCPVTGKKIQGIPHLRPTEYKRSRLSRNRRTVNRPYGGVLSGTAVRERIIRAFLVEEQKIVKKVLKIQKTKXKTTTK

SEQ ID NO: 10145 - protein, 120 aa, Picea glauca
MVQRLTYRKRHSYATKSNQTRVLKTPGGRLIYQTAKKRASGPKCPVTGKRIHGIPHLRPAEYKRSRLSRNRRTVNRAYGGVLSGSAVRDRIIRAFLVEEQKIVKKVLKIQKSKEKQTPRS

SEQ ID NO: 10146 - protein, 122 aa, Brassica rapa
EKWCSVLYTGRVTATPPNRNQHRIVKTPGGKLVYQTTKKRASGPKCPVTGKRIHGIPHLRPTEYKRSRLSRNRRTVNRAYGGVLSALAVRERIVRAFLVEEQKIVKKVLKLQKAKEKVATKA

SEQ ID NO: 10147 - protein, 157 aa, Zostera marina
MGGFYGLGLGFFGALVTIALAGSALTFFNGESPQRDETDSLMRLLPLIGSSNISTACLLGITGILAPVLEETVFRGFLMVTLTKWLPTPISVLLSAALFSLAHLSPGGVSSTFYSRMCFRIFICSNSQSYDTHNYTCILELRCDSSPNISSASRIQY

SEQ ID NO: 10148 - protein, 120 aa, Populus trichocarpa
RGSQLLVHPKRHSYATKSNQHRVVISPCGKLVYQTTKKRASGPKCPVTGKRIQGIPHLRPAKYKRSRLSRNRRTVNRAYGGVLSGSAVRERIIRAFLVEEQKIVKKVLKIQKAKEKQASK

SEQ ID NO: 10149 - protein, 98 aa, Flaveria ramosissima
RHSYATKSNQHRVVKTPGGKLVYQTTKKRASGPKCPVTGKRIQGIPHLRPAEYKRSRLSRNRRTVNRAYGGVLSAGAVRERIIRAFLVEETKDCVKRF

SEQ ID NO: 10150 - protein, 111 aa, Flaveria ramosissima
RHSYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKIQKAKEKTAAKA

SEQ ID NO: 10151 - protein, 120 aa, Eutrema halophilum
MVQRLVFRSRHSYATKSNQHRIVKTPGGKLTYQTTKKRASGPKCPVTGKRIQGIPHLRPTEYKRSRLSRNRRTVNRAYGGALSGVAVRERIVRAFLVEEQKIVKKVLKLQKAKEKTVPKS

SEQ ID NO: 10152 - protein, 119 aa, Brachypodium distachyon
MVQRLTYRKRHSYATKSNQTRVVKTPGGKLVYQYTKKRAGGPKCPVTGKKIQGIPHLRPTEYKRSRLSRNRRTVNRPYGGVLSGPAVRERIIRAFLVEEQKIVKKVLKIQKTKDKTGTK

SEQ ID NO: 10153 - protein, 120 aa, Cycas rumphii
MVQRLTYRRRHSYATKSNKMRVLKTPGGRLIYQTAAKRASGPKCAVTGKRIQGIPHLRPAEYKRSRLPRNRRSVNRAYGGVLSGSAVRERIIRAFLVEEQKIVKKVLKIQRAKEKQTAKS

SEQ ID NO: 10154 - protein, 119 aa, Cynodon dactylon
MVQRLTYRKRHSYATKSNQTRVVKTPGGRLVYQYTDKRASGPKCPVTGKKIQGIPHLRPAQYKRSRLSRNHRTVNRPYGGVLSGTAVRERIIRAFLVEEQKIVKKVLKIQKTKDKGASK

SEQ ID NO: 10155 - protein, 112 aa, Actinidia deliciosa
KRHSYATKSNQHRIVKTPGGKLVYQSTKKRASGPKCPVTGKRIQGIPHLRPTEYKRSRLSRNRRTVNRAYGGVLSGGAVRERIIRAFLVEEQKIVKKVLKIQKAKEKQAGKN

SEQ ID NO: 10156 - protein, 119 aa, Allium cepa
MVQRLVYRRRHSYATKSNQTRVVKTPGGKLTYLTAKKRAKGPRCPVTGKRIQGIPHLRPAEYKRSRLARNRRTVNRAYGGVLSGSAVKERIIRAFLVEEQKIVKKVLKIQKAKEKLSSK

SEQ ID NO: 10157 - protein, 112 aa, Arachis hypogaea
MVQRLTYRKRHSYATKSNQHRVVKTPGGKLVYQTTKKRASGPKCPVTGKRIQGIPHLRPAEYKRSRLPRNRRTVNRAYGGVLSGSAVRERIIRVFFGEEQKIVKKVLKIPKS

SEQ ID NO: 10158 - protein, 120 aa, Unknown
  Sequence found in Organisms: Pinus taeda, Pseudotsuga menziesii
MAQRLTYRKRHSYATKSNQTRVLKTPGGRLIYQTAKKRASGPKCPVTGKRIHGIPHLRPAEYKRSRLSRNRRTVNRAYGGVLSGSAVRDRIIRAFLVEEQKIVKKVLKIQKSKEKQTARS

SEQ ID NO: 10159 - protein, 120 aa, Raphanus sativus
MVQRLVYRSRHSYATKSNQHRIVKTPGGKLTFQTTKKRASGPKCPVTGKRIQGIPHLRPAEYKRSRLSRNRRTVNRAYGGVLSGLAVKDRIVRAFLVEEQKIVKKVLKLQKFKEKTAPKS

SEQ ID NO: 10160 - protein, 120 aa, Raphanus sativus
MVQRLVYRSRHSYATKSNQHRILKTPGGKLTFQTTKKRASGPKCPVTGKRIQGIPHLRPAEYKRSRLSRNRRTVNRAYGGVLSALAVRERIVRAFLVEEQKIVKKVLKLQKAKEKVAPKN

SEQ ID NO: 10161 - protein, 120 aa, Raphanus sativus
MVQRLVYRSRHSYATKSNQHRILKTPGGKLTFQTTKKRASGPKCPVTGKRIQGIPHLRPAEYKRSRLSRNRRTVNRAYGGVLSALAVRERIVRAFLVEEQKIVKKVLKLQKAKEKGAPKN

SEQ ID NO: 10162 - protein, 120 aa, Raphanus sativus
MVQRLVYRSRHSYATKSNQHRILKTPGGKLTFQTTKKRASGPKCPVTGKRIQGIPHLRPAEYKRSRLSRNRRTVNRAYGGVLSALAVRERIVRAFLVEEQKIVKKVLKLQKAKEKVAPRS

SEQ ID NO: 10163 - protein, 120 aa, Picea glauca
MAQRLTYRKRHSYATKSNQTRVLKTPGGRLIYQTAKKRASGPKCPVTGKRIHGIPHLRPAEYKRSRLSRNRRTVNRAYGGVLSGSAVRDRIIRAFLVEEQKIVKKVLKIQKNKEKQTTRS

SEQ ID NO: 10164 - protein, 119 aa, Zostera marina
MVQRLTYRKRHSYATRSNQTRVVKTPGGKLVYQNTRKRASGPKCPVTGKRIQGIPHLRPTQYKRSRLSRNRRTVNRAYGGVLSGTAVRERIIRAFLIEEQKIVKKVLKIQKTKDKQAKA

SEQ ID NO: 10165 - protein, 120 aa, Cedrus atlantica
MAQRLTYRKRHSYATKSNQTRVLKTPGGRLIYQTAKKRASGPKCPVTGKRIHGIPHLRPAEYKRSRLSRNRRTVQRAYGGVLSGSAVRDRIIRAFLVEEQKIVKKVLKIQKSKEKQTVRS

SEQ ID NO: 10166 - protein, 119 aa, Distylium racemosum
MVQRLTYRRRHSYHTKSNQTRIVKTPGGRLVYQTAKKRASGPKCPVTGKRIQGIPHLRPAEYRWTRLRRNRRSVNRAYGGVLSGKAVRERIIRAFLVEEQKIVKKVLKIQKSKEKSAKS

SEQ ID NO: 10167 - protein, 111 aa, Flaveria ramosissima
RHSYATKSNQHRVVKTPGGKLVYQTTEKRASGPKCPVTGKRIQGIPHLRPAEYKRSRLSRNRRTVNRAYGGVLSAGAVRERIIRAFLVEEQKIVKKVLKIQRAKEKTASKA

SEQ ID NO: 10168 - protein, 144 aa, Pinus pinaster
MAQRLTYRKRHSYATKSNQTRVLKTPGGRLIYQTAKKRASGPKCPVTGKRIHGIPHLRPAEYKRSRLSRNRRTVNRAYGGVLSGSAVRDRIIRAFLVEEQKIVKKVLKIQKSKENRLLGVRVKMLFFCEMHIFLVVVEGCEQRF

SEQ ID NO: 10169 - protein, 120 aa, Eutrema parvulum
MVQRLVYRSRHSYATKSNQHRIVKTPGGKLTYQTTKKRANGPMCPVTGKRIQGIPHLRPTEYKRSRLSRNRRTVNRAYGGALSGVAVRERIVRAFLVEEQKIVKKVLKLQKAKEKTAPKN

SEQ ID NO: 10170 - protein, 114 aa, Antirrhinum majus
IQIAYSYATKSNQHRVVKTPGGKLVYQTTKKRASGPKCPVTGKRIQGIPHLRPTEYKRSRLSRNRRTVNRPYGGVLSGGAVRERIIRAFLVEEQKIVKKVLKIQKAKEKVASKS

SEQ ID NO: 10171 - protein, 117 aa, Brassica juncea
RLVYRSRHSYATKSNQHRIVKTPGGKLTYQTTKKRASGPKCPVTGKRIQGIPHLRPAEYKRSRLSRNRRTVNRAYGGVLSALAVRERIVRAFLVEEQKIVKKVLKLQKAKEKVAPRS

SEQ ID NO: 10172 - protein, 265 aa, Zingiber officinale
MAASHNGILSNRWSLAGSTALVTGGTKGIGFSIVEELAALGAAVHTCSRNEAELNKCLQDWEKKGFKITGTVCDVSSPADRERLLQDVKAVFDGKLNILVNNAGTGYPKPATLCTADDFKFIMTTNVEAAFHVCQLAHPLLKASGRGSIVFNSSISGIVALEYLSIYGITKGALNQLARSFACEWAKDNIRVNSVAPGAVETPLMKPAFDNKEFVEREAAHVPLGRLGVPEDVAPVVAFLCLPAASYVTGQVIVIDGGRVVNGYY

SEQ ID NO: 10173 - protein, 84 aa, Allium cepa
MVQRLVYRKRHSYATKSNQTRVVKTPGGKLTYLTAKKRAKGPRCPVTGKRIQGIPHLRPAEYKRSRLARNRRTVNRALWRCFIW

SEQ ID NO: 10174 - protein, 120 aa, Pinus taeda
MVQRLTYRKRHSYATKSNQTRVLKTPGGRLIYQTAKKRASGPKCPVTGKRIHGIPHLRPAEYKRSRLSRNRRTVNRAYGGVLSGSAVRDRIIRAFLVEEQKIVKKVLKMQKSREKQTARS

SEQ ID NO: 10175 - protein, 120 aa, Pseudotsuga menziesii
MAQRLTYRKRHSYATKSNQTRVLKTPGGRLIYQTAKKRASGPKCPVTGKRIHGIPHLRPAEYKRSRLSRNRRTVNRAYGGVLSGSAVRDRIIRAFLVEEQKIVKRVLKLQKTKEKQTAKS

SEQ ID NO: 10176 - protein, 119 aa, Sequoia sempervirens
MVQRLTYRRRHSYHTKSNQTRIVKTPGGKLIYQTAKKRASGPKCPVTGKRIQGIPHLRPAEYRVSRLKRSRRTVNRAYGGVLSGSAVRERIIRAFLVEEQKIVKKVLKIQKSKEKTTKS

SEQ ID NO: 10177 - protein, 126 aa, Lippia dulcis
MVQRLTYSKRHSYATKSNQHRVVKTPGGKLVYQTTKKRASGPKCPVTGKRIQGIPHLRPAEYKRSRLSRNRRTVNRAYGGVLSGSAVRERIIRAFLVEEQKIVKKVLKLQKAKERLLPRTRSKAWG

SEQ ID NO: 10178 - protein, 124 aa, Tropaeolum majus
MVQRLTYRTRHSYATKSNQHRIVKTPGGKLVYQTTKKRASGPKCPVTGKRIQGIPHLRPTEYKRSRLPRNRRTVNRAYGGVLSAGAVRERIIRAFLVEEQKIVKKVLKLQKTKENKLERTRERG

SEQ ID NO: 10179 - protein, 120 aa, Cedrus atlantica
MAQRLTYRKRHSYATKSNQTRVLKTPGGRLIYQTAKKRARGPKCPVTGKRIHGIPHLRPAEYKRSRLSRNRRTVQRAYGGVLSGSAVRDRIIRAFLVEEQKIVKKVLKIQKSKEKQTVRS

SEQ ID NO: 10180 - protein, 119 aa, Sciadopitys verticillata
MVQRLTYRRRHSYHTKSNQTRIVKTPGGKLIYQTAKKRASGPKCPVTGKRIQGIPHLRPAEYRVTRLKRNRRSVNRAYGGVLSGQAVRDRIIRAFLVEEQKIVKKVLKIQKSKEKAVKS

SEQ ID NO: 10181 - protein, 119 aa, Taxus baccata
MVQRLTYRRRHSYHTKSNQTRIVKTPGGKLIYQTAKKRASGPKCPVTGKRIQGIPHLRPAEYRVSRLKRSRRTVNRPYGGVLSGSAVRERIIRAFLVEEQKIVKKVLKIQKSKEKTTKS

SEQ ID NO: 10182 - protein, 90 aa, Gnetum gnemon
MLIDIAWETLRKFTRCNKEEKDFIMSLFIFGDFSIKHDTLSFGKHPLVKIEQKMNFCLNVTMVTILIVVKLLFSSCQVVRNVTTIFLEPW

SEQ ID NO: 10183 - protein, 122 aa, Arabidopsis lyrata
MVQRLVYRSRHSYATKSNQHRIVKTPGGKLTYQKTNKRASGPKCPVTGKRIQGIPHLRPAEYKRPRLARNERTVNRAYGGVLSGVAVRERQVIVRAFLVEEQKIVKKVLKLQKAKEKTGPKS

SEQ ID NO: 10184 - protein, 129 aa, Flaveria ramosissima
ADSRRSNPGQRLTYRKRHSYATKSNQHRVVKTPGGKLVYQTTKKRASGPKCPVTGKRIQGIPHLRPAEYKRSRLSRNRRTVNRAYGGVLSAGAVRERIIRAFLVEEQKIVKKVLKIQKAKEKLLQRARF

SEQ ID NO: 10185 - protein, 87 aa, Triticum aestivum
MVQRLTYRKRHSYATKSNQTRVVKTPGGKLVYQYTKKRASGPKCPVTGKKIQGIPHLRPAEYKRSRLPRSRRTVNRPYGGVLSGNCC

SEQ ID NO: 10186 - protein, 119 aa, Cephalotaxus harringtonia
MVQRLTYRRRHSYHTKSNQTRIVKTPGGKLIYQNAKKRASGPKCPVTGKRIQGIPHLRPAEYRVSRLKRSRRTVNRPYGGVLSGAAVRERIIRAFLVEEQKIVKKVLKIQKSKEKTTKS

SEQ ID NO: 10187 - protein, 106 aa, Cucurbita pepo
MVQRLTYRKRHSYATKSNQHRVVKTPGGKLVYQTTKKRASGPKCPVTGKRIQGIPHLRPAEYKRSRLARNRRTVNRAYGGVLSGGAVRERIIRAFLVEEQKIVKRY

SEQ ID NO: 10188 - protein, 106 aa, Cucurbita pepo
MVQRLTYRKRHSYATKSNQHRVVKTPGGKLVYQTTKKRASGPKCPVTGKRIQGIPHLRPAEYKRSRLARNRRTVNRAYGGVLSGGAVRERIIRAFLVEEQKIVKRF

SEQ ID NO: 10189 - protein, 120 aa, Distylium racemosum
MVQRLTYRRRHSYATKSNQTRIVKTPGGKLIYHTAKKRASGPKCPITGKRIHGIPHLRPAEYRTTRLARNRRTVNRAYGGVLSGSAVRQRIIRAFLVEEQKIVKKVLKIQKSKEKVATKS

SEQ ID NO: 10190 - protein, 118 aa, Humulus lupulus
MVQRLTYRTRHSYATKSNQHRVVKTPGGKLVYQTTKKRASGPKCPITGKRIQGIPHLRPTEYKRSRLSRNRRTVNRAYGGVLSGGAVRERIIRAFLVEEQKIVVKVRVFSKTLRKTGT

SEQ ID NO: 10191 - protein, 119 aa, Eutrema parvulum
MVQRLIYRSRHSYATKSNQHRIVKTPGGKLVYQTTKKRANGPKCPVTGKRIHGIPHLRPTEYNRSRLSRNRRTVNRAYGGVLSALAVRERIIRAFLVEEQKIVKKVLKLQKTKEIVPKA

SEQ ID NO: 10192 - protein, 119 aa, Cryptomeria japonica
MVQRLTYRRRHSYHTKSNQTRIVKTPGGKLIYQTAKKRASGPKCPVTGKRIQGIPHLRPAEYRVSRLKRSRRTVSRAYGGVLTGSAVRERIIRAFLVEEQKIVKKVLKIQKSKEKTTKS

SEQ ID NO: 10193 - protein, 119 aa, Podocarpus macrophillus
MVQRLTYRRRHSYHTKSNQNRVVKTPGGKLVYQNVKKRASGPKCPVTGKRIQGIPHLRPAEYRWTRLRRSKRSVNRAYGGVLSGKAVRERIIRAFLVEEQKIVKKVLKIQKSKEKAAKT

SEQ ID NO: 10194 - protein, 110 aa, Vinca minor
HSYATKSNQHRIVKTPGGNLVYQSTKKRASGPKCPVTGKRIQGIPHLRPAEYKRSRLPRNRRTVNRPYGGVLSGGAVRERIVRAFLVEEQKIVKKVLKIQKAKEKLAAKN

SEQ ID NO: 10195 - protein, 115 aa, Festuca arundinacea
GTRRKRHSYATKSNQTRVVKTPGGKLVYQYTKKRASGPKCPVTGKKIQGIPHLRPTEYKRSRLSRNRRTVNRPYGGVLSGPAVRERIIRAFLVEEQKIVKKVLKIQKTKDKTATK

SEQ ID NO: 10196 - protein, 97 aa, Valeriana officinalis
MVQRLTYRKRHSYATKSNQHRIVKTPGGKLVYQGTKKRASGPKCPVTGKRIQGIPHLRPTEYKRSRLSRNRRTVNRAYGGVLSGGAVRERIIRVVFG

SEQ ID NO: 10197 - protein, 112 aa, Brassica napus
MVQRLVYRSRHSYATKSNQHRIVKTPGGKLTYQTTKKRASGPKCPVTGKRIQGIPHLRPAEYKRSRLSRNRRTVNRAYGGVLSALAVRERIVRAFLVEEQKIVKKVLKLTKG

SEQ ID NO: 10198 - protein, 120 aa, Adiantum capillus-veneris
MVQRLTYRRRHSYATKSNQTRVVKTPGGKLVLQYAKKRANGPKCAITGKRIQGIPHLRPAEYRNTRLSKRQKTVNRAYGGALSGGAVRERIIRAFLVEEQKIVKKVLKIQKSKEKQASKV

SEQ ID NO: 10199 - protein, 120 aa, Raphanus sativus
  misc_feature (12)..(12): Xaa can be any naturally occurring amino acid
  misc_feature (28)..(28): Xaa can be any naturally occurring amino acid
  misc_feature (36)..(36): Xaa can be any naturally occurring amino acid
  misc_feature (71)..(71): Xaa can be any naturally occurring amino acid
MVQRLVYRSRHXYATKSNQHRIVKTPGXKLVFQTTXKRANGPKCPVTGKRIHGIPHLRPTEYKRSRLSRNXRTVNRAYGGVLSALAVRERIVRAFLVEEQKIVKKVLKLQKAKEKVATKA

SEQ ID NO: 10200 - protein, 120 aa, Sciadopitys verticillata
MVQRLTYRRRHSYHTKSNQTRILKTPGGRLIYQTAKKRASGPKCPVTGKRIHGIPHLRPAEYRRPRLQRNRRTVNRAYGGVLAASAVRERIIRAFLVEEQKIVKKVLKIQKSKEKMTAKS

SEQ ID NO: 10201 - protein, 139 aa, Brassica oleracea
MVQRLVYRSRHSYATKSNQHRIVKTPGGKLVYQTTKKRASGLKCPVTGKRIHGILHLRPTEYKRSRLSRNRRTVNRAYGGVLSALGVRERIVRAFLVEEQKIVKKVLKLQKVKEKVGYQGLRVLRFLFYFGDTSFSLIF

SEQ ID NO: 10202 - protein, 130 aa, Eragrostis curvula
  misc_feature (11)..(11): Xaa can be any naturally occurring amino acid
TSRKNQKKKHXPVFFATAPTEADSYATSPTRPRRQDPGGRLVYQYTNKRASGPKCPVTGKKIQGIPHLRPTEYKRSRLPRNRRTVNRPYGGVLSGTAVRERIIRAFLVEEQKIVKKVLKIQKTKDKASKS

SEQ ID NO: 10203 - protein, 106 aa, Triticum aestivum
  misc_feature (72)..(72): Xaa can be any naturally occurring amino acid
  misc_feature (98)..(98): Xaa can be any naturally occurring amino acid
  misc_feature (101)..(101): Xaa can be any naturally occurring amino acid
  misc_feature (104)..(104): Xaa can be any naturally occurring amino acid
MVQRLTYRKRHSYATKSNQTRVVKTPGGRLVYQYTKKRASGPKCPVTGKKIQGIPHLRPAEYKRSRLARNRXTVNRPYGGVLSGTAVRERIIRAFLVXEQXIVXKF

SEQ ID NO: 10204 - protein, 122 aa, Ceratodon purpureus
MVQRLTYRRRHCYATKSNQTRVVKTPGGKLVFQTAKKRANGPKCPVTGKRIAGIPHLRPTEYKTSRLHRHRKTVNRAYGGNLAGSAVRERIIRAFLVEEQKIVKKVLKIQKSKEKLASKTQA

SEQ ID NO: 10205 - protein, 121 aa, Ceratodon purpureus
MVQRLTYRRRHCYATKSNQTRVVKTPGGKLVFQTAKKRANGPKCPVTGKRIAGIPHLRPTEYKTSRLHRHRKTVNRAYGGNLAGSAVRERIIRAFLVEEQKIVKKVLKIQKSKEKMAAKTQ

SEQ ID NO: 10206 - protein, 73 aa, Triticum aestivum
MVQRLTYRKRHSYATKSNQTRVVKTPGGKLVYQYTKKRASGPKCPVTGKKIQGIPHLRPAEYKRPGCLGTAEL

SEQ ID NO: 10207 - protein, 106 aa, Flaveria ramosissima
MVQRLTYRRRHSYATKSNQHRVVKTPGGKLVYQTTKKRASGPKCPVTGKRIQGIPHLRPAEYKRSRLSRNRRTVNRAYGGVLSAGAVRERIIRVFLVEEQKIVKRC

SEQ ID NO: 10208 - protein, 110 aa, Linum usitatissimum
KRHSYATKSNQHRIVKTPGGKLVYQPTKKRASGPKCPVTGKRIQGIPHLSPAESKRSRLPRTRRTVTRAYGGVLSGGAVRERIIRAFLVEEQKIVKKVLKIQKSKEKVTK

SEQ ID NO: 10209 - protein, 105 aa, Actinidia deliciosa
KSNQNRVVKTPGGRLVYQTTKKRASGPKCPVTGKRIQGIPHLRPAEYKRSRLSRNRRTVNRAYGGVLSGGAVRERIIRAFLVEEQKIVKKVLKIQKAKEKQSSKN

SEQ ID NO: 10210 - protein, 122 aa, Ceratodon purpureus
MVQRLTYRRRHCYATKSNQTRVVKTPGGKLVFQTAKKRANGPKCPVTGKRIAGIPHLRPTEYKTSRLHRHRKTVNRAYGGNLAGSAVRERIIRAFLVEEQKIVKKVLKIQKSKEKMAAKTQS

SEQ ID NO: 10211 - protein, 81 aa, Gossypium hirsutum
MVQRLTYRTLHSYATKSNQHRVVKTPGGKLVYHTTSKRASGPKCPVPGKRIHWIPNWRPAEYKRSRLPRNRRTVNRAYGGV

SEQ ID NO: 10212 - protein, 113 aa, Citrus sinensis
MGQPLSYRTRHSYATRSNQHRVVKTPGGTLVYQSTEKRASGPKCPVTGKRIRGIPHLRPAEYKRSKLSQNRRTVSRAYGGVLSGGAARERIIRAFLVDDHKMVQMVLKIQKGK

SEQ ID NO: 10213 - protein, 122 aa, Physcomitrella patens
MVQRLTYRRRHCYATKSNQTRVVKTPGGKNVFQTATKRARGPKCPVTGKRIAGIPHLRPTEYKTSRLHRHKKTVNRAYGGTMAGSAVRERIIRAFLVEEQKIVKKVLKIQKSKEKLAAKAQS

SEQ ID NO: 10214 - protein, 122 aa, Physcomitrella patens
MVQRLTYRRRHCYATKSNQTRVVKTPGGKNVFQTATKRARGPKCPVTGKRIAGIPHLRPTEYRTSRLHRHKKTVNRAYGGNLAGSAVRERIIRAFLVEEQKIVKKVLKIQKSKEKLAAKTQS

SEQ ID NO: 10215 - protein, 100 aa, Rhizophora mangle
MVQRLTYRKRHSYATKSNQHRVVKTPGGKLVYQSTKKRASGPKCPVTGKRIQGIPHLRPAEYKRSRLPRNRRTVNRAYGGVLSGAAVRERIIRAFWWKSK

SEQ ID NO: 10216 - protein, 102 aa, Orobanche aegyptiaca
MVQRLTYRKRHSYATKSNQHRIVKTPGGKLVYQSTKKRASGPKCPVTGKRIQGIPHLRPAEYKRSRLPRNRRTVNRPYGGVLSGSAVRERIIRAFLVEEQKL

SEQ ID NO: 10217 - protein, 122 aa, Pteridium aquilinum
MVQRLTYRRRHSYATKSNQTRVVKTPGGKLVFQYAKKRAQGPKCSVTGKRIQGVPHLRPAEYRNTRMSKRKKTVNRAYGGTLSGGAIRERIIRAFLVEEQKIVKKVLKIQKSKEKQAAKAQA

SEQ ID NO: 10218 - protein, 122 aa, Adiantum capillus-veneris
MVQRLTYRRRHSYATKSNQTRVVKTPGGKLVFQYAKKRAQGPKCAITGKRIQGIPHLRPAEYRNTRLSKRKKTVNRAYGGALSGSAVRERIIRAFLVEEQKIVKKVLKIQKSKEKQSAKAQA

SEQ ID NO: 10219 - protein, 122 aa, Physcomitrella patens
MVQRLTYRRRHCYATKSNQTRVVKTPGGKNVFQTATKRARGPKCPVTGKRIAGIPHLRPTEYKTSRLHRHRKTVNRAYGGTMAGSAVRERIIRAFLVEEQKIVKKVLKIQKSKEKLAAKAQS

SEQ ID NO: 10220 - protein, 122 aa, Physcomitrella patens
MVQRLTYRRRHCYATKSNQTRVVKTPGGKNVFQTATKRARGPKCPVTGKRIAGIPHLRPTEYKTSRLHRHRKTVNRAYGGTMAGSAVRERIIRAFLVEEQKIVKKVLKIQKSKEKLAAKAQT

SEQ ID NO: 10221 - protein, 122 aa, Physcomitrella patens
MVQRLTYRRRHCYASKSNQTRVVKTPGGKNVFQTAIKRARGPKCPVTGKRIAGIPHLRPTEYKTSRLHRHRKTVNRAYGGNMSGSAVRERIIRAFLVEEQKIVKKVLKIQKSKEKVAAKTQS

SEQ ID NO: 10222 - protein, 84 aa, Flaveria ramosissima
QHRVVKTPGGKLVYQTTKKRASGPKCPVTGKRIQGIPHLRPAEYKRSRLSRNRRTVNRAYGGVLSAGAVRERIIRAFWLKNKRL

SEQ ID NO: 10223 - protein, 63 aa, Cryptomeria japonica
  misc_feature (53)..(55): Xaa can be any naturally occurring amino acid
  misc_feature (57)..(62): Xaa can be any naturally occurring amino acid
MVQRLTYRRRHSYHTKSNQTRIVKTPGGKLIYQTAKKRASGPKCPVTGKRIQXXXHXXXXXXG

SEQ ID NO: 10224 - protein, 122 aa, Physcomitrella patens
MVQRLTYRRRHCYATKSNQTRVVKTPGGRNVFQTATKRAAGPKCPVSGKRIAGIPHLRPTEYKTSRLHRHKKTVNRAYGGNLAGSAVRERIIRAFLVEEQKIVKKVLKIQKSKEKLAAKTQS

SEQ ID NO: 10225 - protein, 742 aa, Glycine max
MVVKMMRWRPWPPLLSKKFQVRLLVRRLQGCDLLRNAAREGSKLVLEIRWKGPKLTLGSLRRSSVARNFTKEAEFDVDGGGAAVVHWDEEFPTLCNLNGYKDNVFHPWEIAFTLFNGLNQRPKNKVPAIGTALLNIAEFASSTDQNDFDLNIPLTLTGGSGELSPLLCISISLTEVSVAQESVEPIQRSIVPGPSPSAKSGETALVEKDELSAIKAGIRKVMILTEFVSSKKSKKGCREEEGSEGRCSRSEDGEYNYPLDSESIDDSEEGETDEGKEDSSIRKSFSYGTLASANAGGFFHSNMRVNCNDEDWVYYSHRKSDVGCSRMEDSTTSSSDPYLQSSKRSILPWRKRKLSFRSPKAYKGEPLLKKSYAEEGGDDIDFDRRQLSSDESLSLTWYKTEDDLSAHRSSISEFGDGSFAVGSWEQKEVMSRDGHMKLQTQVFFASIDQRSERAAGESACTALVAVIADWFQNNRDLMPIKSQFDSLIREGSSEWRNLCENDAYRERFPDKHFDLETVIQAKIRPLTVAPGKSFIGFFHPEGMDEGRFDFLYGAMSFDNIWDEISRAGQECPSNVEYDCYYIIDTLGERLYEGCNQAYILKFDSNTMMYKMPNVAHSSDNKTSNDQQTVAEILDPNNSQTQQVNSKEVDSVAGEEEQLRSETEEVICRGKEACKEYIKSFLAAIPIRELEADAKKGLISSASLYHRLLQIEFHYTQLLGETSMAEPETLALAITEASTITKL

SEQ ID NO: 10226 - protein, 383 aa, Glycine max
MKRNNSVYPAALNCDDILHEILLRIPPPTISKLIIVSKIWLRVICSPSFRQCYVRQWGQSFRLLGFFVCNFLYLGRPRDGYRRPRWEPALPILSTCKDGDDLKLSGILKHLGYFVDSSKGIILSGFHPKAYYVYNTVTKQKYDSQNLSNSIKFCDPCRCECKLKERNTVSIETYSSKSRQWKQSTLMCSTTLALCPRTAAMVVGGVVHWFAMWGKLAIYDPRLGDRYIALIKLPTGVLTHEHEESVLGESSDGLLQYGQSNNLGLEIWILEKEAGANSSIYCNCTHLKYKWILRWRLNFKVLWKQMPSLSTHSKETQILSFLPQNSTSIFIRSGWNILLCDLETKTVEIVNYQGRGGTISWESSKVVPYFLPAWPHTSSVSVS

SEQ ID NO: 10227 - protein, 401 aa, Cajanus cajan
MKRNSGYPGALNSDDILHEILIRLPPSTISKLIIVSKRWLRVICSPSFRRCYLSKWGQSFRLLGFFVCNFLYLGRPRDGYRRPRWEPALPILSTCKEGDDLKLSGILKHLGYFIDSSKGIILSGFHPKTYYVYNTVTKQKYQLPEPQQFYKILCMALIVEEYLDGDLCYKVIRARCECKLKERKTVSIETFSSKTGQWKQSTLMCSTSFALRPRTAAMVVGGVVHWFAIWGKLAIYDPRLGDRYIALIRLPRGVLSHEHEESVLGESSDGLLQYGQSNNLGLEIWILQKEPGTNSSIYCNCTHMKYKWILRWRLYFKVLWKQMPSLSSHAKETQILSFLPQNSTSIFIRSGWNILLYDLETKTVETVNYQGRGGTISWESSKVVPYFLPAWPHASSGVMTT

SEQ ID NO: 10228 - protein, 419 aa, Glycine max
MDMEMKEGEAPVLWFETSDSVCRRHQFEPDGQLSVVIVDDSRPLYQRVAGSFMNKFFPSGYPYSVNEGYLRYTQFRAVQHVTSAALSVLSTQSLLFAAGLRPTPAQATAVSWILKDGMQHVGKLICSNWGARMDSEPKRWRLLADALYDIGTGLEVLSPLCPHLFLEMAGLGNFAKGMAVVAARATRLPIYSSFAKEGNLSDLFAKGEAFSTLFNVIGIGVGIQLASTICASMQGKLVAGPLLSIIHLYSVSEEMRATPINTLNPRRTAMVVADFLKAGIVSSPADLRYRENLLFNVHVKEDAGNVRVGKDVHKVIKPSRLLELKQVFPEEKFLLNFGNKCIDMVLEQDASGEDALRGWLVAAYAAQTHSFSHELSATSVLHEAYEKMNGVFPVFLRELQNKGWHTDRFLDGTGSRFAF

SEQ ID NO: 10229 - protein, 414 aa, Lotus japonicus
MEKEEGPVFWFETSGSVCHRHHFQSNGQLSVMLVDDSRPLYQKVAGSFMNKFFPSGYPYSVNEGYLRYTQFRSVQHVTSAALSVLSTQSLLFAAGLRPTPAQATAVSWILKDGMQHVGKLICSNWGARMDSEPKRWRLIADVLYDLGTGLEVLSPLCPHLFLQMAGLGNFAKGMAVVAARATRLPIYSSFAKEGNLSDLFAKGEAFSTLCNVIGIGVGIQLASTICASVQGKMVVGPLLSILHIYSVSEEMRATPINTLNPRRTAMIVTDFLKAGVVSSPADLRYREDLLFRVRLTEDAGNVRVGRALHEVIKPSRLLELEQVLPGEKFLLNRGGKCVDMVLEQDASGEDALRGWLVAAYAAQIENSSHELSASVLHEAYKKMTGVFPVFLKELQSKGWHTDRFLDGTGSRFAF

SEQ ID NO: 10230 - protein, 207 aa, Glycine max
MENHGNKRVWDQSSDSNTQRVDSPESKIRRVDSSDSGINSSESQLESVLDSSEVQLQDDIFNMLDDTDNVPERDSVQGLDSVIKSFEDEINAPGSDSGSGDPAQEPDSGELQSNLGYLLEASDDELGLPPTVGDGEEMGRAAPEMAELARFVGFEDDIPSYDAFGFGSGFTAENDGGAGGFVTVDGLFDYSDPSADVLWRSESLQAM

SEQ ID NO: 10231 - protein, 234 aa, Taraxacum officinale
  misc_feature (231)..(231): Xaa can be any naturally occurring amino acid
MSGPECCQNPPAPSSGGESGQLLQIASLNSYVSGNPDSKVAVLLISDVFGYGAPKLRQLADKVAAAGYYVVVPDFFYGDPLTPGANIEDWLKNHAPEQAVDFAKRVIQALKEKGVTKIGAAGFCWGAKVVVELAKDGEIQFAALLHPSFVTLDDIKGVKVPIGILGAEIDKRSPPELVKEFEAALVANEVNNFVKIYPGVAHGWTVRYKDEDAAEVKCAEEAHQDLVDWFXKSH

SEQ ID NO: 10232 - protein, 81 aa, Ambrosia trifida
MSGPECCETHRRSPPAKNPANFCKSHPSIPMFPVKPDSKVRRYSCFLMFTVMELLNSGNLQTKLQLQDIMQWFLISSMVIR

SEQ ID NO: 10233 - protein, 234 aa, Parthenium argentatum
MSGPECFENPPAISSGGESGEVLQIASLNSYVSGKPDSKVAVILVSHVFGYGAPKLRQLADKVAAAGYYVVVPDFFYGDPYTPETKIEDWLSNHAPEQAVDFAKPVIQALREKGITKVGAAGFCWGAKVVVELAKEGEIQFAALLHPSFVTLDDIKGVKIPIGILGAEIDKRSPPELVKEFEAALVANEVNNFVKIYPGVAHGWTVRYKDEDAAEVKCAKEAHQDLVDWFGKCL

SEQ ID NO: 10234 - protein, 234 aa, Parthenium argentatum
MSGPECCQNPPVISSGGESGELLQIASLNSYVSGKPDSKVAVVLVSDVYGYEAPKLRRLADKVAAAGFYVVVPDFFFGDPLTPGANIQDWLKNHAPEQAVDVAKQVIQALKEKGITKIGAAGFCWGAKVVVKLAKDAEIQVAALLHPSFVTVDDIKGVKVPTGILGAEIDKMSPPELVKEFEAALVANEVNNFVKIYPGVAHGWTVRYKDEDAAEVKCAEEAHQDLVQWFGKCL

SEQ ID NO: 10235 - protein, 234 aa, Ambrosia trifida
MSGPECCQNPPAISSGGESGELLQIASLSSYVSGKPDSKVAVILVSDVFGYEAPKLRQLADKVAAAGYYVVVPDFFFGDPLIPGTNIQDWLKNHAPEPAVDFAKQVVQALKEKGITKVGAAGFCWGAKVVVKLAKDAEIQVAALLHPSFVTVDDIKGVKIPTGILGAEIDKMSPPELVKEFEVALVANEVNNFVKIYPGVAHGWTVRYKDEDAAEVKCAEEAHLDLVQWFGKCL

SEQ ID NO: 10236 - protein, 234 aa, Ambrosia trifida
MSGPECCQTHRRSPPAENPVKFCKLHLSVPMFPASLIPKLQLFLFLDVFGYEAPKLRQLADKVAAAGYYVVVPDFFFGDPLIPGTNIQDWLKNHAPEPAVDFAKQVVQALKEKGITKVGAAGFCWGAKVVVKLAKDAEIQVAALLHPSFVTVDDIKGVKIPTGILGAEIDKMSPPELVKEFEAALVANEVNNFVKIYPGVAHGWTVRYKDEDAAEVKCAEEAHQDLVEWFGKCL

SEQ ID NO: 10237 - protein, 234 aa, Helianthus annuus
MSGPECCQNPPVISSGGESGELLQIGSLNSYVSGNPDSKVAVLLVSDVFGYEAPKLRQLADKVAAAGYYVVVPDFFHGDPLTSITKIGDWLKNHAPEQAVEFAKPVIQALKEKGITKIGAAGFCWGAKVVVELAKDGEIQFAALLHPSFVTLDDIKGVKVPTGILGAEIDKMSPPELVKEFEAALVANEVNNFAKIYPGVSHGWTIRYKDEDATEVKCAQEAHQDLVEWFGKCL

SEQ ID NO: 10238 - protein, 232 aa, Ambrosia trifida
GPECCQNPPAISSGGESGELLQIASLSSYVSGKSDSKVAVILVSDVFGYEAPKLRQLADKVAAAGYYVVVPDFFFGDPLTPGANIQDWLKNHAPEPAVDYAKQVVQALKEKGITKVGAAGFCWGAKVVVKLAKDAEIQVAALLHPSFVTVDDIKGVKIPTGILGAEIDKMSPPELVKEFEAALVANEVNNFVKIYPGVAHGWTVRYKDEDAAEVKCAEEAHLDLVQWFGKCL

SEQ ID NO: 10239 - protein, 233 aa, Helianthus annuus
SGPECCQNPPVISSGGESGELLQIGSLNSYVSGNPDSKVAVLLVSDVFGYEAPKLRQLADKVAAAGYYVLVPDFFHGDPLTSIDKLGDWLKNHAPEQAVEFAKPVIQALKEKGITKIGAAGFCWGAKVVVELAKDAEIQFAALLHPSFVTLDDIKGVKVPTGILGAEIDKMSPPELVKEFEAALVAKEVSSFVKIYPGVSHGWTIRYKDEDATEVKCAQEAHQDLVEWFGKCL

SEQ ID NO: 10240 - protein, 213 aa, Ambrosia trifida
LLQIASLNSYVSGKPDSKVAVILVSDVYGYGAPKLRQLADKVAAAGYYVVVPDFFYGDPLTPETKLEDWLSNHAPEQAVDFAKPVIQALKEKGITKIGAAGFCWGAKVVVELAKEGEIQFAALLHPSFVTVDDIKGVKIPIGILGAEIDKRSPPELVKEFEAALVANEVNNFVKIYPGVAHGWTVRYKDEDAAQVKCAKEAHQDLVDWFGKCL

SEQ ID NO: 10241 - protein, 234 aa, Flaveria ramosissima
MSGPECCSNPPAISSGDGAGEVLQIASLNSYVSGDPQSKTAVLLVSDVFGYGAPKLRQLADKVASAGYYVVVPDFFYGDPLTPETKIDDWLKNHAPEQGVELAKPVLQALKEKGVTKIGAAGFCWGAKVVVDLAKDAEIHVAAILHPSFVTVEDIKGVKIPIGILGAEIDKRSPPELVKEFEAAVVANEVNHFVKIYPGVAHGWTIRYKDEDAAEVKCAQEAHQDLMDWFGKCL

SEQ ID NO: 10242 - protein, 234 aa, Arnica chamissonis
MSGPECCENPPAISSGAGSGEVLQIASLNSYVSGKPDSKTAVLLVSDVYGYGAQKLRQLADKVASAGYYVVVPDFFHGDPMTPETKIDDWLKNHAPEQCVQFAKPVIQALSEKGITKIGAAGFCWGAKVVVELAKDAEMQVAAILHPSFVTLDDIKGVKVPIAMLGAEIDKRSPPELIKEFEAALVANKVDHFAKIYPGVAHGWTVRYKDDDAAEVKCAEEAHQDLVDWFGKCL

SEQ ID NO: 10243 - protein, 234 aa, Flaveria ramosissima
MSGPECCSNPPAISSGAGAGEVLQIASLNSYVSGNPQSKTAVLLVSDVFGYGAPKLRQLADKVASSGYYVVVPDFFYGDPLTPETKIDDWLKNHAPEQGVELAKPVLQALKEKGVTKIGAAGFCWGAKVVVDLAKDAEIHVAAILHPSFVTVEDIKGVKIPIGILGAEIDKRSPPELIKEFEAAVVANEVNHFVKIYPGVAHGWTIRYKDEDAAEVKCAQEAHQDLMDWFGKCL

SEQ ID NO: 10244 - protein, 234 aa, Flaveria ramosissima
MSGPECCSNPPAISSGAGAGEVLQIASLNSYVSGNPQSKTAVLLVSDVFGYGAPKLRQLADKVASAGYYVVVPDFFHGDPLTPETKIEDWLKNHAPEQGVELAKPVLQALKEKGVTKIGAAGFCWGAKVVVDLAKDAEIHVAAILHPSFVTVEDIKGVKIPIGILGAEIDKRSPPELIKEFEAVVVANEVNHFVKIYPRVAHGWTVRYKDEDAAEVKCAQEAHQDLMDWFGKYL

SEQ ID NO: 10245 - protein, 243 aa, Guizotia abyssinica
MSGPECCENPPAISSGGDSGELLQIASLNSYVSGKPESKIAVLLVSDVFGYGAQKLRKLADKVASAGYYVVVPDFFYGDPMTPETKIEDWLTNHAPEQAVEFAKPVIQALKEKGITKIGAAGFCWGAKVVVELAKDAEIQVAAILHPSFVTLDDIKGVKVPIGILGAEIDKRSPPELIKEFEAALVANEVNHFAKIYPGVAHGWTVRYKDDNAAEVKCAEEAHQDLVDWFGKGLRLLIQSVKL

SEQ ID NO: 10246 - protein, 242 aa, Ambrosia trifida
QNLLESTHNVWTRVLQNPPAISSGGESGEVLQIASLSSYVSGKPDSKVAVILISDVFGYEAPKLRQLADKVAAAGYYVVVPDFFFGDPLTPGTNIQDWLKNHAPEPAVDFAKQVVQALKEKGITKVGAAGFCWGAKVVVTLAKDAEIQVAALVHPSLVTVDDIKGVKIPTGILGAEIDKMSPPELVKEFETALVTNEVNNFVKIYPGVSHGWTVRYKDEDAAEVKCAEEAHQDLVQWFGKCL

SEQ ID NO: 10247 - protein, 237 aa, Carthamus tinctorius
MSGPQCCENPPAPSSGGESGDLHQIASLNSYVSGNPDSKIAVLLVSDVWGYGAPKLRKLADKVASAGYYVVVPDFFHGDPLTPEAKIEDWLQNHAPGPAVDFAKPVIQALKEKGITKIGAAGFCWGAKVVVELAKDTDLQVAALLHPSFVTLDDIKGVKVPIAILGAEIDQRSPPEVIKQFEEALEAKPEVDQFVKIYPGVSHGWTVRYKDEDEVAVKCALEAHQDLLDWFGKCLKH

SEQ ID NO: 10248 - protein, 209 aa, Ambrosia trifida
MSGPECCENPPAISSGEESGELLQIASLNSYVSGKPDSKVAVILVSDVYGYGAPKLRQLADKVAAAGYYVVVPDFFYGDPLTPGTKIEDWLSNHAPEQAVDFAKPVIQALKEKGVTKIGAAGFCWGAKVVVELAKEGEIQFAALLHPSFVSVDDIKGVKIPIGILGAEIDKRSPPELVKEFEAALVANEVNNFVKYILCAHGWTVRYKE

SEQ ID NO: 10249 - protein, 237 aa, Centaurea maculosa
MSGSQCCENPPAPSSGGESGDLQQIASLNSYVSGNPDSKIAVLLVSDVFGYGAPKLRKLADKVASAGYYVVVPDFFHGDPLTPEAKFEDWLNNHAPGPAVDFAKPVIQALKEKGITKIGAAGFCWGAKVVVDLAKDTDLQVAALLHPSFVTLDDIKGVKVPIAILGAEIDQRSPPEVVKQFEEALEAKPEVDQFVKIYPGVTHGWTVRYKDEDEVAVKCALEAHQDLLDWFGKCLKH

SEQ ID NO: 10250 - protein, 237 aa, Cirsium arvense
MSGSQCCENPPAPSSGGESGELHQIASLNSYVSGNPDSKIAVLLVSDVFGYGAPKLRKLADKVASAGYYVVVPDFFHGDPLTPEAKFEDWLNNHAPGPAVDFAKPVIQALKEKGITKIGAAGFCWGAKVVVDLAKDTDLQVAALLHPSFVTLDDIKGVKVPIAILGAEIDQRSPPEVVKQFEEALEAKPEVDQFVKIYPGVTHGWTVRYKDEDEVAVKCALEAHQDLLDWFGKCLKH

SEQ ID NO: 10251 - protein, 237 aa, Cirsium arvense
MSGPQCCENPPAPSSGGESGDVHQIASLNSYVSGNPDSKIAVLLISDVYGYGAPKLRKLADKVASTGYYVVVPDFFHGDPMTPETRIEDWLKSHAPDHAVEFAKPVIQALKEKGITKIGAAGFCWGAKVVVELAKDTDIQVAALLHPSFVKLDDIKGVKVPIAILGAEIDQRSPPEVIKQFEEALEAKPEVDQFVKIYPGVPHGWTVRYKDEDQVAVKCAQEAHQDLLEWFGKYLQI

SEQ ID NO: 10252 - protein, 242 aa, Cynara scolymus
  misc_feature (75)..(75): Xaa can be any naturally occurring amino acid
  misc_feature (223)..(223): Xaa can be any naturally occurring amino acid
MSGPECCENPPAPASGVESGDIQQIASLNSYVSGNPDSKIAVLLISDIYGYGAPKLRKVADKAASAGYYVVVPDXFHGDPMTPETRIEDWLTSHAPDQAVDFAKPVIQALKEKGFTKIGAAGFCWGAKVVVELAKDTDIQVAVLLHPSFVTLDDIKGVKVPIAILGAEIDRRSPPEVIKQFEEALEAKPEVDQFVKIYPGVSHGWTVRYKDEDEAAVKCAEEXHQDLLEWFGKYLQINHSTL

SEQ ID NO: 10253 - protein, 698 aa, Solanum phureja
FPNLVQLEKEALTKGVPISQALDIEIPPPRPKRKPSNPYPRKMSVAVPSLQVGAKDGKFSTPFSSICEERNLFDLEKEPITEKAGGNEKLGNVQETQNKKNCSQGFTLFKEGASAASMSSGKSLQTHVAPANACAFSESVPVTKGEVNHDIANKSFLTVESNEHQQAEILDIRQSFQGNSSCNTFDGGKSCQSSEKLAQGEKKHPPSQPDHLGEFSRNDMQVLHNYPRHVPVHILDGTNGSQISPDMFNHESTSQQIGGVPGLPNLYSNPASSATSEHHSNSPQSSIHQSFSCFHPIFTPIRDPDDYRSFLQLSSSFSSLIVSALLQNPAAHVAASFAASFWPYANMERPTDSPTDNTASQINSAPSMAAIAAATVAAATAWWAAHGLLPLCSQFQSSFTCVPTSATSMQVDACQPRVDKNEGREGTHNSPHAQEPVPECSEALQEQQSGSKLPPSPSSESEESEGRKLQIGLTATGTEQGAAVTKINEPNTEKGGKQVDRSSCGSNTPSSSEIETDALEKDDKGKEEPQESNINLLVGEAAIRRCRNFISPTESWKEVSEEGRIAFQALFTREVLPQSFSPSLDLKNKGKIILEKFKQRPDEKVQCGPQLDLNDLASSICSSHQTMEDNVLLIGNKDVEKCLPMIELGQVRLKARRTGFKPYKRCSLEANDSRVTSSNCQDEEKSSKRLRLEGEAST

SEQ ID NO: 10254 - protein, 693 aa, Solanum phureja
MEEASVDSEQDVTGQGSGRFQEIESDDQNSEKIESDELFVQNGRQIEANGLDDQNCVTDDGQKEFVAPAVGMEFESYDDAYNYYNCYAREVGFRVRVKNSWFKRNSREKYGAVLCCSSQGFKRIKDVNRLRKETRTGCPAMMRMRMVDSKRWRVLEVTLEHNHSLGTKAYKSIKKTGAGNKKKLDSNCNAEVQTIKLYRALVIDAGANRNANFSARRCQTSSDFHDKLNLRKGDTQAMYNYFCRMQLTNPNFFYLMDLNDEGQLRNVFWIDARSRAAYAYFVDVIYIDNSYLSNKYEIPLVAFVGTNHHGQSMLLGCGLLAGETKASYVWVFKAWLTSSLGRFPQTIITERCKVLETAINEVFPRSLHRFALSHIMRKVPEKLGGLRNYDVIRKALFKTVYEGLKPFDFEAAWRVMIQRFGVGDHEWLCSLYNDRAKWAPVYLKDTFFAGMATARLNETLAAFFDKYVHKQTPLKEFLDKYELALQKKFKEEALADMESRSSNPELKTRCSFELQLSKVYTREIFKRFQLEVEEMYSCFSTTQLHVDGQVVIFLVKERVLEEGNRREIRDYEVLYNRTAAEVRCICSCFNFYGYLCRHALCVLNFNGVEEIPSKYILSRWKKDYKRLCAPDVESSSTESTEQVQWYSQLYRSALQVVEEGVISLDHYKVALNAFEESLSRVYHIEEKPNKNLL

SEQ ID NO: 10255 - protein, 442 aa, Solanum phureja
MIASTVRKPLFGVTLLTLSLFLLLFFFTPFSFFSDPSVTFNSSWRERPEIWSMRRLAEWRPCNWWLQPRTNALPAQANGYIRVDCYGGLNQMRRDLCDGVGIARLLNATLVLPKFEVAAYWNESSGFEDVFDVDFFIQQMKGFVNVVKELPIEIASKDPVRVDCSKRKGQFDYVESVLPSLLKHGYISITPAMSQRRDRYPLYAKAALCQACYSALRLTNTLEKKALELLQAIPKPFLSLHLRFEPDMVAYSQCEYSGISLASAKAIEAARVDRKPWTGETARIWRNRGKCPLTPNETAFILKALAIPTNTTIYLAAGDGLMELEGLTSVYTNVVTKSSLLSGEDFTTMHGNTKAALDYYVSINSDSYMATYFGNMDKMVAAMRVFTGLYKTIFLNRKAFALFTSQGFKGKELTEALWKVHRDDFIMGRGSALPDCFCEFNL

SEQ ID NO: 10256 - protein, 155 aa, Solanum phureja
MNGAMNMHGDMAPPAPDAAVNNHHMMMHMTFFWGKNAEILFSGWPGYNNIGMYVFALFVVFLLAFFVEWLSHSNYIKESANHVTAGLIQTALYGIRIGLAYLVMLSVMSFNGGIFLAAIAGHTLGFLVFGSRVFKKSPLMAYAKASDLPSMPCNC

SEQ ID NO: 10257 - protein, 163 aa, Solanum melongena
MNDATHMHGAGAMDMTPPPTSSGASAANSHHMMMMHMTFFWGKNAEILFSGWPGYNNIGMYVFALFVVFVLAFFVEFLSHTNYIKESANHVAAGLIQTALYGIRIGLAYLVMLSVMSFNGGIFLAAIAGHTLGFMVFGSRVFKKSPLTAYAKASDLPSLPCNC

SEQ ID NO: 10258 - protein, 238 aa, Solanum phureja
MVELKFLGMDFGCALGSLSNGQFPEKDCLLPLISKLLGYAIVAASTTVKLPQILKILQHKSVRGLSVVAFELELLGYTIALAYCLHKGLPFSAFGEYLFLLIQAIILVAIIYYFSQPLGMKTWMKGLLYCAVAPTILAGQIDPVLFEALYASQHAIFLCARIPQIWKNFKSKSTGELSFLTFFMNFAGSMVRVFTSLQEKAPMSVALGSVIGVLMNGTILSQIIIYQKPTPQKGKKKD

SEQ ID NO: 10259 - protein, 241 aa, Nicotiana tabacum
MVELKFLGMDFGCALGSLSKGEFPEKDCLLPLISKLLGYAIVAASTTVKLPQILKILQHKSVRGLSVVAFELELIGYTIALAYCLHKGLPFSAFGEYAFLLIQAIILVAIIYYFSQPLGMKTWVKPLLYCAVAPTVLAGQIDPVLFEALYASQHAIFLFARIPQIWKNFKNKSTGELSFLTFFMNFAGSMVRVFTSLQEKAPMSVALGSALGVLMNGTILSQIIIYQKPTPSEREKEEIEV

SEQ ID NO: 10260 - protein, 238 aa, Tabernaemontana elegans
MTELKFLGIDFSCALGSLSKGEIPEKDCLLPLISKLLGYCIVAASTTVKVPQILKILNHKSVRGLSMVAFELEVIGYTIALAYCLHGGLPFSAYGELLFLLIQAIILVAIIYYFSQPMETKTWIRALLYCAVAPTVLAGKIDPLLFEALYASQHAIFFFARVPQIWENFKNRSTGELSFLTSLMNFAGSMVRVFTSLQEKAPMSVVMGSAIGVLTNGTILSQIIIYQRPHPKKEKKTD

SEQ ID NO: 10261 - protein, 122 aa, Ipomoea nil
MVELKFLGMDFSCALGSLSKGEFPAKDCLLPLISKLLGYAIVAASTTVKLPQILKILRHRSVSGLSVVAFELEVVGYTIALAYCLHKGLPFSAYGEYAFLLVQAIILVSTIYYFSQPLGTKT

SEQ ID NO: 10262 - protein, 238 aa, Amsonia hubrichtii
MTELKFLGIDFSCALGSLRKGEIPEKDCLLPLISKLLGYCIVAASTTVKVPQILKILKHKSIRGLSVVAFELEVIGYTIALAYCLHKGLPFSAYGELAFLLIQAIILVSIIYYFSQPVGTKTWIRALLYCAIAPTILAGQIDPLLFEALYASQHAIFFCARLPQIWKNYKNKSTGELSFLTSLMNFGGSVVRVFTSLQEKAPMSVVMGSAIGVLTNGTILSQIIIYQRPHPKKEKKTD

SEQ ID NO: 10263 - protein, 235 aa, Lippia dulcis
MKFLGMDFSCALGSLSNGEFPEKDCLLPLISKLLGYCIVAASTTVKLPQILKILKHSSVRGLSLVSFELEVVGYTIALAYCLHKGLPFSAYGELAFLLIQAIVLVAIIYYFSQPLGTKTWIRALLYCALAPTILAGQIDPLLFEALYASQHAIFFFARIPQILANFKNKSTGELSFLTSFMNFGGSMVRVFTSIQEKAPMSVVLGSVIGIVTNGTILSQIIIYQKPATKKEKKAD

SEQ ID NO: 10264 - protein, 240 aa, Triphysaria pusilla
MAELKFLGMDFSCALGSLRNGQIPEKDCLLPLISKLLGYCIVAASTTVKLPQILKIVKHSSIRGLSVVAFELELVGYTIALAYCLHKGLPFSAYGELVFLLIQAIILVAIIYYYSQPLGSKTWIKALIYCALAPTVLAGQIDPYLFEALYASQHAIFFCARIPQIWANSKNKSTGELSFLTSLMNFAGSMVRVFTSIQEKAPTSVIMGSVIGIITNGTILSQIIIYEKPKPAAKKEKKAH

SEQ ID NO: 10265 - protein, 265 aa, Antirrhinum majus
  misc_feature (219)..(219): Xaa can be any naturally occurring amino acid
MKFLGMDFRCAVGSVSNGEFPQKDCLLPLISKLLGYCIVAASTTVKLPQILKILKHSSVRGLSLISFELEVVGYTIALAYCLHKGLPFSAYGELAFLLVQAIILVAIMYYFSQPLGTMTWIKGLIYCAVAPTILAGQIDPFLFEALYASQHAIFFCARIPQIWANFKNKSTGELSFLTSLMNFAGSMVRVFTSLQEKAPMSVVMGSVIGIMTNGTILSXISYTRNQLLRKKRKPISKLRWPTKLSTATESGEYRHLHFASSSTPN

SEQ ID NO: 10266 - protein, 235 aa, Lippia dulcis
MKFLGMDFTCALSSLQSGEIPEKDCLLPLISKLLGYLIVAASTTVKLPQILKIVQNSSVRGLSVVAFELEVVGYTIALAYCLHKGLPFSAYGELAFLLIQAIILVAIIYYFSQPLGTKTWIRGLLYCAIAPTVLAGKIGPMLFEALYASQHAIFFCARIPQIWANFKNKSTGELSFLTSLMNFAGSMVRVFTSMQEKAPMSVVMGSVIGIVTNGTILSQIVVYQKPPARKEKKSD

SEQ ID NO: 10267 - protein, 236 aa, Linum usitatissimum
MEYLGIDFGCAIGSLRHGNFPEKDCLLPLISKLLGYAIVAASTTVKLPQILKIVKNRSVRGLSVVAFELEVIGYTIALAYCLHKGLPFSAYGEYAFLLIQAIILVAVIYYFSQPIGTKTWIKALLFSAIAPTILAGQIAPMLFEALYASQHAIFLCARIPQIWANFSNKSTGELSFLTFFMNFGGSMVRVFTSLQEKAPTSVVLGSALGVVMNGTILSQILMYQKKPQPKRGKKEE

SEQ ID NO: 10268 - protein, 235 aa, Mimulus guttatus
MKFLGMDFSCAVGSLSHGQFPEKDCLLPLISKLLGYCIVAASTTVKLPQILKILKNNSVRGLSVLSFELEVVGYTIALAYCLHKGLPFSAYGELAFLLIQGIILVAIIYYYSQPLGTKTWIRALLYCAIAPTIMAGQIDPFLFEALYASQHAIFFCARIPQIWANFKNKSTGELSFLTSLMNFAGSMVRVFTSMQEKAPMSVVMGSVIGIMTNGTILSQIIMYQKPSTKKEKKSD

SEQ ID NO: 10269 - protein, 235 aa, Plantago ovata
MKFLGMDFTCAFGALSNGQFPEKDCLLPLISKLLGYAIVAASTTVKLPQIMKILKHSSVRGLSVLAFELEVVGYTIALAFCLHKGLPFSAYGELAFLLIQALILVSIIYYFSQPMGMKTWIKGLIYCGIAPTILAGQIDPFLFEALYASQHAIFFSARVPQIWTNYKNKSTGELSFLTSLMNCAGSMVRVFTSLQENAPMSVVLGSVIGIMTNGAILSQIIIYQNSTAKKEKKSD

SEQ ID NO: 10270 - protein, 487 aa, Solanum phureja
MATDMEVLQNGKAAAVNGCCKKGPGYASPLAAMDGPKESLIYVTCIYTGMGRGKPDYLATVDVDPKSPSYSKVIHRLPMPYEGDELHHSGWNSCSSCYGDPSAARRYLVLPSLVSGRIYAIDTQKDPKAPSLYKVVQPDDVIKKTGLAFPHTAHCLASGEIMLSCLGDKDGNAEGNGFLLLDSDFNVKGRWEKPGHSPLFGYDFWYQPRHNTMISSTWGAPSAFTKGFNLQDVADGHYGRHLHVYTWPGGELKQTLDLGNTGLLPLEVRFLHNPSEAIGYVGCALTSNMVRFFKNPDGSWGHEVAISVKPVKVQNWILPEMPGLITDFLISLDDRFLYLANWLHGDIRQYNIEDPANPKLTGQVFVGGVFQKGNAVLAEAEDGSTYQVDVPEVQGHRLRGGPQMIQLSLDGKRLYATNSLFSTWDRQFYPEMVEKGGHMLQIDVDSEKGGLAINPRFFVDFGAEPDGPSLAHEMRYPGGDCTSDIWI

SEQ ID NO: 10271 - protein, 489 aa, Solanum tuberosum
MATDMEVLQNGKAAAAVVNGCCKKGPGYASPLAAMDGPKESLIYVTCIYTGTGRGKPDYLATIDVDPTSPSYSKVIHRLPMPYEGDELHHSGWNSCSSCYGDPSAARRYLVLPSLISGRIYAIDTQKDPKAPSLYKVVQPDDVIKKTGLAFPHTAHCLASGEIMLSCLGDKSGNAEGNGFLLLDSDFNVKGRWEKPGHSPLFGYDFWYQPRHNTMISSTWGAPSAFTKGFNLQDVADGHYGRHLHVYTWPGGELKQTLDLGNTGLLPLEVRFLHNPSEAIGYVGCALTSNMVRFFKNPDGSWGHEVAISVKPVKVQNWILPEMPGLITDFLISLDDRFLYLANWLHGDIRQYNIEDPVSPKLTGQVFVGGVFQKGNAVLAEAEDGSTYQVDVPEVQGHRLRGGPQMIQLSLDGKRLYVTNSLFSTWDRQFYPEMVEKGGHMLQIDVDSEKGGLAINPRFFVDFGAEPDGPSLAHEMRYPGGDCTSDIWI

SEQ ID NO: 10272 - protein, 480 aa, Capsicum annuum
MATDMEVGVNGCCKKGPGYAAALAGMSGPKESLIYVTCMYTGTGRGKLDYLATVDVDPNSPYYWKVIHKLPMPYEGDELHHSGWNSCSSCYGDPSAARRYLVLPSLISGRIYAVDTQKDPRAPSLYKVVQPDDVIQKTGLAFPHTAHCLASGEIMVSCLGDKDGNAEGNGFLLLDSDFNVKGRWEKPGHSPFFGYDFWYQPRHNTMISSTWGAPSAFTKGFNLEHVTNGLYGQHLHVYTWPGGEIKQTLDLGNTGLLPLEVRFLHNPAEAIGYVGCALTSNMVRFFKNPDGSWGHEVAISVKPVKVQNWILPEMPGLITDFLISLDDRFLYLANWLHGDIRQYNIEDPANPKLTGQVFVGGVFQKENAVLAEAEDGSTYQVDVPEIQGHQLRGGPQMIQLSLDGKRLYATNSLFSTWDRQFYPELIEKGGHMLQIDVDTEKGGLAVNPNFFVDFGAEPDGPSLAHEMRYPGGDCTSDIWI

SEQ ID NO: 10273 - protein, 485 aa, Olea europaea
MATDMVVVQQAAVNGGCCKKGPGYATPLEAMAGPRESLIYVTCVYKGTGTEKPDYLATVDVDPDSPTYSKVIHRLPMPYIGDELHHSGWNSCSSCHSDPSASRRFLVLPSLVSGRIYAVDTQKDPKAPTLHKVVDPKDIIAKTGLAYPHTAHCLASGDIMVSCLGDKDGNAEGNGFLLLDSDFNVKGRWEKPGHSPLFGYDFWYQPRHKTMISTSWGAPAAFTKGFDLQHVSDGLYGRHLHVYSWPDGELKQTLDLGNTGLLPLEIRFLHDPSRDTGFVGCALTSNMIRFFKNPDGSWSHELSISVKPLKVQNWILPEMPGLITDFLISLDDRFLYLANWLHGDIRQYNIEDPANPQLTGQVWVGGLVRKGSTVVVEADDGSTYQVDVPDVKGNKLRGGPQMIQLSLDGKRLYVTNSLFSTWDRQFYPELVQKGGHILQIDVNNEKGGLAINQNFFVDFGAEPDGPSLAHEMRYPGGDCTSDIWI

SEQ ID NO: 10274 - protein, 489 aa, Mimulus guttatus
MATDMVVLQHADVENGNGNGCCKKGPGYATPLAAMSGPRETLIYVTCVYTGTGKENPDYLATVDIDPNSPTYSKVIHRLPMPYIGDELHHSGWNSCSSCHGDSSASRRFLVLPSLVSGRIYAIDTLKDPKAPSLYKIVDPKEVIQKTGLAYPHTAHCLASGEIMLSCLGDKDGNAEGNGFLLLDSDFNVKGRWEKPGHSPTFGYDFWYQPRHKTMISTSWGAPLAFTKGFNPQHVSDGLYGRHLHVYSWPDGELKQTLDLGNTGLIPLEIRFLHDPDKDTGFVGCALTSNMVRFFKKPDESWGHEVSISVKTLKVQNWILPEMPGLITDFLISLDDRFLYLANWLHGDIRQYNIEDPTNPRLTGQLWVGGLIRKGGPVFAEAEDGTTFQVDIPEVQGHELRGGPQMIQLSLDGKRLYATNSLFSAWDKQFYPDLIEKGSHMLQIDVDTEKGGLAINTDFFVDFGSEPGGASLAHEMRYPGGDCTSDIWI

SEQ ID NO: 10275 - protein, 249 aa, Fraxinus spp
MATDVVVVQHAAVNDGCCKKGPGYATPLEAMAGPRESLIYVTCVYSGTGTEKPDYLATVDVDPNSPTYSQVIHRLPMPHIGDELHHSGWNSCSSCHSDPSASRRFLVLPSLVSGRIYAIDTQKDLKAPTLHKVVDPKDIIAKTGLAYPHTAHCLASGDIMVSCLGDKDGNAEGNGFLLLDSDFNVKGRWEKPGHSPLFGYDFWYQPRHKTMISTSWGHLLLSPKVSTFSMFLMGFMGDICTCTAGPMVN

SEQ ID NO: 10276 - protein, 490 aa, Vinca minor
MVTATDMVVVEHATVAEGGGCCKHKGPGYASPLEAMAGPTEKLIYVTCIYTGTGKEKPDYLATVDIDPNSPTYSKVIHRLPMPYIGDELHHSGWNACSSCFDDSSASRRFLVLPALVSGRIYAIDTLKDPKAPSFHKVVEPEDIVQKTGLAYPHTAHCLASGDILVSCLGDKEGNAQGNGFLLLDSEFNVKGRWEKPGHSPLYGYDFWYQPRHKTMISTSWGAPSAFTKGFNLQDVSDGLYGRHLHVYSWPGGELQQTLDLGPTGLLPLEIRFLHDPSKDTGFVGCALTSNMVRFFKTADGTWSHEIAASVKPLKVQNWILPEMPGLITDFLISLDDRFLYLANWLHGDIRQYNIEDPQNPKLTGQVWVGGLIRKGSSVLAEAEDGTKYQVDVPEVQGKQLRGGPQMIQLSLDGKRLYVTNSLFSAWDRQFYPDLVEKGAHMLQIDVETEKGGLAINPNFFVDFGAEPDGPSLAHEMRYPGGDCTSDIWI

SEQ ID NO: 10277 - protein, 483 aa, Populus trichocarpa
MATGTEVVSDNGHGCCKKGPGYATPLEAMSGPRESLLYVTCVYSGTGIEKPDYLATVDVDPNSPTYSKVIHRLPMPNVGDELHHTGWNSCSSCHGDPSAARRYLVLPSLISGRIYAIDTLKDPRAPSLHKVVEPADIVNKTGLAYPHTSHCLASGDVMVSCLGDKDGNAEGNGFLLLDSEFNVKGRWEKPGHSPTFGYDFWYQPRHNIMISSSWGAPAAFTKGFNLQHVADGLYGRHLNVYSWPNGELKQTLDLGDTGLLPLEIRFLHDPSKDSGFVGCALTSNMVRFFKTPDGSWSHEVAISVKPLKVQNWILPEMPGLVTDFLISLDDRFLYFVNWLHGDVRQYSIEDPEKPVLKGQVWVGGLIQKGSSVVAEGEDGKTWQYDVPEIQGHRLRGGPQMIQLSLDGKRLYVTNSLFSTWDRQFYPELMEKGSHMLQIDVDTEKGGLAINPNYFVDFAAEPDGPSLAHEMRYPGGDCTSDIWI

SEQ ID NO: 10278 - protein, 483 aa, Populus trichocarpa
MATGTEVVSAHGHGCCKKGPGYASPLEAMSGPRESLIYVTCVYAGTGIEKPDYLATVDVDPNSPNYSKVIHRLPMPNLGDELHHSGWNSCSSCHGDPSAARRYLILPSLISGRIYAIDTLKDPRAPSLHKVVEPADIVNKTGLAYPHTSHCLASGDVMVSCLGDKDGKAEGNGFLLLDSEFNVKGRWEKPGHSPKFGYDFWYQPRHNTMISSSWGAPAAFTKGFNPQHVSDGLYGRHLHVYSWPNGELKQTLDLGSTGLLPLEIRFLHNPSKDTGFVGCALTSNMVRFFKTPDESWSHELAISVKPLKVQNWILPEMPGLITDFLLSLDDRFLYFVNWLHGDVRQYNIEDPKNPVLKGQVWVGGLIQKGSPVVAEGEDGKTWQYDVPEIQGHRLRGGPQMIQLSLDGKRLYVTNSLFSTWDRQFYPEVVEKGSHMLQIDVDTEKGGLAINPNYFVDFASEPDGPSLAHEMRYPGGDCTSDIWI

SEQ ID NO: 10279 - protein, 409 aa, Triphysaria pusilla
MPYVGDELHHSGWNACSSCHGDTLVSRRYLVLPSLLSGRIYAIDTQKDPKAPSLYKFVDPKDIIEKTGLAYPHTAHCLATGEIMVSCLGDKDGNAQGNGFLLLDSDFNVKGRWEKPGHTPLFGYDFWYQPRHKTMISSSWGAPAAFTKGFDLQHVSDGLYGRHLHVYSWPEGELKQTLDLGNTGLLPLEIRFLHDPDKDTGFVGCALTSNMVRFFRKPDGSWDHELSASVKPVKVQNWILPEMPGLITDFLISLDDRFFYVSNWLHGDIRQYNIEDPANPRLTGQLFVGGLIRKGSSVLAVADDATTYQVDVPDVQGHELRGGPQMIQLSLDGKRLYVTNSLFSTWDRQFYPDLIEKGSHILQIDVDNEKGGLAINPNFFVDFGNEPDGPSLAHEMRYPGGDCTSDIWI

SEQ ID NO: 10280 - protein, 481 aa, Vinca minor
MATATDTTVVVEQATVAEDGGCCKHKGPGYASPLEAMAGPREKLIYVTCIYTGTGKEKPDYLGTVDVDPNSPNYSKVIHRLPMPYVGDELHHSGWNACSSCYDDSSTSRRFLVLPSLVSGRIYAIDTLKDPKAPSLHKVVEPADIIQKTGLAFPHTAHCLASGDILVSCLGDKEGNAQGNGFLLLDSEFNVKGRWEKPGHSPLYGYDFWYQPRHKTMISTSWGAPSAFTKGFNLQDVSDGLYGRHLHVYSWPGGELQQTVDLGPSGLLPLEIRFLHDPSKDTGFVGCALTSNMVRFFKTADGSWSHEIAISVKPLKVQNWILPEMPGLITDFLISLDDRFLYLANWLHGDIRQYNIEDPKKPKLTGQVWVGGQLPKGSSVLAEAEDGTTYQVDVPEVQGKQLRGGPQMIQLSLDGKRLYATNSLFSVWDRQFYPDLVEKGAHMLQIDVDTEKGGLAINPNFFVDFGAEPDGPSLAHPWLMR

SEQ ID NO: 10281 - protein, 488 aa, Euonymus alatus
MATDMVVLEHGSEQSNSHGCCNKGPGYATPLEAMTGPRESLIYVTCIYSGTGIEKPDYLGTVDVDPNSPTYSKVIHRLPMPNVGDELHHSGWNSCSSCYGDPSANRRFLVLPSLISGRIYAVDTQKDPRAPSVHKVVEPEVIVQKTGLAYPHTAHCLASGEIMVSCLGDKDGNAEGNGFLLLDSEFNVKGRWEKPGHSPLFGYDFWYQPQHKTMISTSWGAPAAFRGGFNLQHVSDGLYGRHLFVYSWPDGELKQTLDLGSEGLLPLEIRFLHNPSKDTGFVGCALSSNMVRFFKNEDGSWSHEVAISVKPLKVQNWILPEMPGLITDFLISLDDRFLYFVNWLHGDVRQYNIEDPAKPILTGQVWVGGLIRKGSPIVAEQEDGTTWQSEVPVVQGSHLKGGPQMIQLSLDGKRLYVTNSLFSAWDRQFYPEILEKGSHMLQIDVDTEKGGLKINPNFFVDFGAEPDGPSLAHEMRYPGGDCTSDIWI

SEQ ID NO: 10282 - protein, 478 aa, Catharanthus roseus
ATVAENNACCKNKGPGYGSPLQAMAGPREKLLYVTCIYTGTGKENPDYLATVDVDPNSPTYSKVIHRLPMPHIGDELHHSGWNACSSCYGDPSAARRYLVLPSLVSGRIYAVDTLKDPRAPALYKVVEPADIIQKTGLAYPHTAHCLASGDILVSCLGDKKGKAEGNGFLLLDSEFNVKGRWEKPGHSPLFGYDFWYQPRHKTMISSSWGAPSAFTKGFNLQDVSDGLYGRHLHVYSWPDGELQQTLDLGSTGLLPLEIRFLHDPSKDTGFVGCALTSNMVRFFKTAEGTWNHEVAISVKPLKVQNWILPEMPGLITDFLISLNDRFLYFANWLHGDIRQYNIEDPQNPKLTGQVWVGGQIRQGSSVLAEAEDGKTYQINVPEIQGKQLRGGPQMIQLSLDGKRLYATNSLFSTWDRQFYPELVEKGAHMLQIDVDTEKGGLAINPNFLVDFGAEPEGPSLAHEMRYPGGDCTSDIWI

SEQ ID NO: 10283 - protein, 488 aa, Amsonia hubrichtii
MAATDVVVVEHAAVSENGCCKHKGPGYASPLEAIAGPREKLIYVTCIYRGTGKEKPDYLATVDVDPSSPTYSKVIHRLPMPYIGDELHHSGWNACSSCHGDPSTSRRFLVLPSLVSGRIYAVDTLKDPRAPALHKIVQPEDIIQKTGLAYPHTAHCLASGDIMVSCLGDKEGKAEGNGFLLLDSEFNVKGRWEKPGHSPLFGYDFWYQPRHKTMISTSWGAPAAFCKGFNLQDVSDGLYGRHLHVYSWPGGEIQQTLDLGNTGLLPLEIRFLHDPSKDTGFVGCALTSNMVRFFKTADGTWSHEVSISVKPLKVQNWILPEMPGLITDFLISLDDRFLYLANWLHGDIRQYNIEDPQNPRLTGQVWVGGQIKKGSSVLAEAEDGMTYQVDVSEIQGKQLRGGPQMIQLSLDGKRLYATNSLFSSWDSQFYPDLVEKGSHMLQIDVDTEKGGLAINPNFFVDFGAEPDGPSLAHEMRYPGGDCTSDIWI

SEQ ID NO: 10284 - protein, 376 aa, Fraxinus spp
MATDVVAVQHAAVNDGCCKKGPGYATPLEAMAGPRESLIYVTCVYTGTGTEKPDYLATVDVDPDSPTYSQVIHRLPMPHIGDELHHSGWNSCSSCHSDPSASRQFLVLPSLVSGRIYAIDTQKDLKAPTLHKVVNPKDIIAKTGLAYPHTAHCLASGDIMVSCLGDKDGNAEGNGFLLLDSDFNVKGRWEKPGHSPLFGYDFWYQPRHKTMINTSWGAPAAFTKGFNLQHVSDGLYGRHLHVYSWPDGELKQTLDLGNTGLLPLEIRFLHDPSRDTGFVGCALTSNMIRFFKNPDGSWSHELSTSVKPLKVQNWILPEMPGLITDFLISLDDHFLYLANWLHGDIRQYNIKDPSKTSADRPSMGWRISPKRKQCGC

SEQ ID NO: 10285 - protein, 480 aa, Actinidia deliciosa
MAMEVVVNPNGCCKGGPGYATPLEAMSGPRESLIYVTCVYAGTGKEKPDYLATVDIDPNSPTYSKVIHRLPMPYVGDELHHSGWNACSSCYGDQSASRRYLVLPSIISGRIYAIDTQKAPKAPTLHKVVEPADILHKTGLAYPHTAHCLASGEIMVSCLGDKDGKAEGNGFLLLDSDFNVKGRWEKPGHSPLFGYDFWYQPRHKTMISTSWGAPAAFTTGFNLQHVSDGLYGRHLHVYSWPGGELKQTLDLGNTGLLPLEIRFLHDPSKDTGFVGCALTSNMVRFFKTPDGSWSHEVVISVKPLKVQNWILPEMPGLITDFLMSLDDRYLYLVNWLHGDVRQYNIEDPKNPVLTGQVWVGGLIQKGSSVLVEADDGTTYQVDIPEIKGNRLRGGPQMIQLSLDGKRLYITNSLFSTWDRQFYPDLLVKGSHMLQIDVDTEKGGLVVNPNFFVDFGSEPDGPSLAHEMRYPGGDCTSDIWI

SEQ ID NO: 10286 - protein, 485 aa, Orobanche aegyptiaca
MATDMMVVQHANVENDCCKKGPGYATPMDAMSGPRETLIYVTCVYAGTGREKPDYLATVDVDPSSPTYSRVVHRLPMPYVGDELHHSGWNACSSCHGNASASRRYLVLPSLISGRIYAIDTQKDPRAPNLHKIVEPKDIIQKTGLAYPHTAHCLASGDIMVSCLGDKDGNAEGNGFLLLDSDFNIKGRWEKPGHSPLFGYDFWYQPRHKTMISSSWGAPAAFTKGFDLQHVSDGLYGRHLHIYSWPEGELKQTLDLGSSGLLPLEVRFLHDPDKDTGFVGCALTSNMVRFFKKPDGSWGHEVSASVKPVKVQNWILPEMPGLITDFLLSLDDRFLYLSNWLHGDIRQYNIEDPANPRLTGQVFVGGLISKGSNVFAVAGDGTTYQVDVPQVQGHQIRGGPQMIQLSLDGKRLYVTNSLFSTWDRQFYPELVEKGSHILQIDVDTQKGGLAINPNLFVDFGSEPNGASLAHEMRYPGGDCTSDIWI

SEQ ID NO: 10287 - protein, 487 aa, Citrus sinensis
MATDTVVAEHRSSNNGHGCCAKGPGYATPLDAMSGPREKLLYVTCLYTGTGREKPDYLATVDADPSSSSYSKVIHRLPVPYIGDELHHSGWNSCSSCYGDSSAQRRFLVLPSLVSGRIYVVDTQKNPRAPSLHKVVEPADIVQKTGLSYPHTAHCLASGDILVSCLGDKDGNAEGNGFLLLDSEFNVKGRWEKPGHSPAFGYDFWYQPRHKTMISSSWGAPLAFTKGFNLQHVSDGLYGRHLFVYSWPDGELKQTLDLGNTGLIPLEIRFLHDPSKDIGFVGCALASTMVRFSKTQDGSWNHEVAISVKSLKVQNWILPEMPGLITDFLISLDDRFLYFSNWLHGDIRQYNIEDPKNPVLTGQVWVGGLFQKGSPVVAVTDDGQPYQSDVPEVQGHRLRGGPQMIQLSLDGKRLYVTNSLFSAWDCQFYPELKEKGSHMLQIDVNSEKGGMAINPNFFVDFEAEPDGPALAHEMRYPGGDCTSDIWI

SEQ ID NO: 10288 - protein, 487 aa, Citrus clementina
MATDTVVAEHRSSNNGHGCCAKGPGYATPLDAMSGPREKLLYVTCLYTGTGREKPDYLATVDADPSSSSYSKVIHRLPVPYIGDELHHSGWNSCSSCYGDSSAQRRFLVLPSLVSGRIYVVDTQKNPRAPSLHKVVEPADIVQKTGLSYPHTAHCLASGDILVSCLGDKDGNAEGNGFLLLDSEFNVKGRWEKPGHSPAFGYDFWYQPRHKTMISSSWGAPLAFTKGFNLQHVSDGLYGRHLFVYSWPDGELKQTLDLGNTGLIPLEIRFLHDPSKDIGFVGCALASTMVRFSKTQDGSWNHEVAISVKSLKVQNWILPEMPGLITDFLISLDDRFLYFSNWLHGDIRQYNIEDPKNPVLTGQVWVGGLFRKGSPVVAVTDDGQPYQSDVPEVQGHRLRGGPQMIQLSLDGKRLYVTNSLFSAWDCQFYPELKEKGSHMLQIDVNSEKGGMAINPKFFVDFEAEPDGPALAHEMRYPGGDCTSDIWI

SEQ ID NO: 10289 - protein, 476 aa, Theobroma cacao
MAGNGTGCCKTGPGYATPLAAMSGPREALIYVTCVYTGTGREKPDFLATVDVDPNSPTYSKVIHRLPVPYLGDELHHSGWNSCSSCHGDPSAERRFLILPSLVSGHIYVIDTQTNPKAPSLHKVVDPEDIVQKTGLAYPHTSHCLASGDIMVSCLGDKDGNAKGNGFLLLDSEFNVKGRWEKPGHSPLFGYDFWYQPRHKTMISSSWGAPAAFTKGFNLQHVADGLYGRHLYVYSWPDGELKQTLDLGDSGLLPLEIRFLHDPSKDTGFVGCALTSNMVRFFKTKDGSWSHEVAISVKPLKVQNWILPEMPGLITDFLISLDDRFLYFANWLHGDVRQYNIEDPKNPVLAGQVWVGGLIQNGSPVVAVIEDGKTWQCNVPEIQGHRLRGGPQMIQLSLDGKRLYVTNSLFSTWDRQFYPELIEKGSHMLQIDVDTEKGGLKVNPYFFVDFGAEPDGPSLAHEMRYPGGDCTSDIWI

SEQ ID NO: 10290 - protein, 434 aa, Solanum phureja
MEEGETGLLLQSNKELLSSGYSIHEYSEEIKKIKSALTWVFLDQSNLWRAGLSWSLFFILTIGVPLVSHFMFACLTCDTMHQRPFDALVQVSLSLFATLSFVSLSSFARKYGIRKFLFLDKLYEDSEKVQQGYTEQLHRSMKILSSFVLPSFIAESIYKIWWFSSGGTQIPYLYNAALSNIFVCILLISSWLYRISISFLVCVLFRLICSLQILRLEEFAQVFEKQSDVSSIMIEHLRIRRNLRVISHRFRVFILSTLILVTISQFLALLLITEPSSTVNIFTAGELALSSITLVTGLFMCLRSAAKITHKAQAVTSLAAKWHACATISTLDDMTEETPMARTVTSQVVYPINSSWDTDEEGDGDDVLDNTNMVPIHASTISYQKRQALVTYFEHNKAGITVYGFMLDRTWLHTIFAIQLSLTLWILNKTIGIS

SEQ ID NO: 10291 - protein, 440 aa, Solanum phureja
MVMVIMAMRGIIHDHDHGSSGVDQRKLLEELAEEEDLKLYGFGSHGNMDEHHHHHDGRGVKDLTGLGLWVNAMGCSLLVSLASLICLILLPLIFIHGKPSKAVVDSLALFGAGAMLGDAFLHQLPHAFGGGHSHSHDDHLHDHSGHSHAHSLEDLSVGLSILAGIVLFLIVEKLVRYVEDFSGGVNERSHGHHHHHHMHYTKLKDDNDADENLQELSQEKDGILSEKAAGGSGVDGVSADSPNGDKPNGGAILRKRNTGSSAAEDNTALDAANFSTNSTSTGEEQAKPRSSLVFGYLNLFSDGVHNFTDGMALGSAFLLHGSVGGWSRTLFLLAHELPQEIGDFGILVRSGFSVSKALFFNFLSALVALAGTALALTLGQDSGHSSLIEGFTAGGFIYISVAGVLAEMNNSGRTTLVNTVIQLISLVSGMAVALCISLIE

SEQ ID NO: 10292 - protein, 1019 aa, Solanum phureja
MVFINLPNHKTLTLEINPFVTSLQTLTLEIHLKFHIPITQQRLYSSCRRLLDAEALLSDLGISPNSTLTLHVPLLGGMQAPVAPKARLEFLNTRPPPNYVAGLGRGATGFTTRSDIGPARAAPDLPDRSAVGGAPATGVGRGRGKGAGEEDEEDDAEEKGYDENQKFDEFEGNDVGLFASAEYDEDDKEADAIWESIDQRMDSRRKDRREARLKQEIEKYRASNPKITEQFADLKRKLYTLSSDEWDSIPEIGDYSLRNKKKRFESFVPVPDTLLERARQEKEHVSALDPRSRMVGGMETPSSQTPVADLTAVGEGRGTVLSVRLDRILDSVTGQTVVDPKGYLTDLKSMKITSDAEISDIKKARLLLKSVTQTNPKHPPGWIAAARLEEVAGKMQVARQLIKKGCEECPKNEDVWLEACRLASPLEAKAVIAQGVKANPNSVKLWMQASKLEDDTANKSRVLRKGLEHIPDSVRLWKAVVELANEEDARLLLQRAVECCPLHVELWLALAKLETYDNAKKVLNKAREKLPKEPAIWITAARLEEADGNTASVGKIIERAIRALQREGLEIDREAWMKEAEGCERAGSLGTCQAIINNTVGVGVEEEDRKRTWVADAEECKRRGSIETAKYIYAHALTVFRTKKSIWLKAAQLEKSHGTRESLDALLRKAVTYIPKAEVLWLMGAKEKWLAGDVPAARAILEEAFAAIPDSEEIWLAAFKLEFENCETERARKLLAKARERGGLERVWMKSVIVERELGNVDEERRLLDEALRRFPSFFKLWLMLGQLEERLGNSNKAKDAFESGIKNCPNCIPLWLSLASLEEKMNGLSKARAVLTMARKRNPQNPELWLAAVRAEARHGYKREADVLMAKALQECPNSGILWAASIEMAPRPQRKTKSSDALKKCDHDPHVIAAVAKLFWQERKVDKARNWFNRAVTLAPDIGDFWALYFKFEQQHGAEEQRSDVLKRCVAAEPKHGEKWQATSKAVENSHEPTESILKKVVATLKKEENLAENNHN

SEQ ID NO: 10293 - protein, 1023 aa, Cucumis sativus
MVFLSIPNQKTLFLNLNPSTTSILNLKRAIEDVSHIPISFQRLFLSQSFQLSHFNDSTLLSHLRILPNSTLTLHVPLFGGMQAPTIPKPRLDFLNSKPPPNYVAGLGRGATGFTTRSDIGPARAAPDLPDRSATTIGGAAAAPPGRGRGKGGEEEEEDEGEDKGYDENQKFDEFEGNDVGLFASAEYDEDDKEADAVWEAIDKRMDSRRKDRREARLKEEIEKYRASNPKITEQFADLKRKLYTLSAQEWESIPEIGDYSLRNKKKRFESFVPVPDTLLEKARQEQEHVTALDPKSRAAGGTETPWAQTPVTDLTAVGEGRGTVLSLKLDRLSDSVSGLTVVDPKGYLTDLKSMKITSDAEISDIKKARLLLKSVTQTNPKHPPGWIAAARLEEVAGKIQAARQLIQKGCEECPKNEDVWLEACRLASPDEAKAVIAKGAKSIPNSVKLWLQAAKLEHDTANKSRVLRKGLEHIPDSVRLWKAVVELANEEDARLLLHRAVECCPLHVELWLALARLETYDRAKKVLNSAREKLPKEPAIWITAAKLEEANGNTAMVGKIIEKGIRALQRVGVVIDREAWMKEAEAAERAGSVATCQAIIHNTIGVGVEEEDRKRTWVADAEECKKRGSIETARAIYAHALTVFLTKKSIWLKAAQLEKSHGSRESLDALLRKAVTYRPQAEVLWLMGAKEKWLAGDVPAARSILQEAYAAIPNSEEIWLAAFKLEFENHEPERARMLLAKARERGGTERVWMKSAIVERELGNAEEESKLLIEGLKRFPSFFKLWLMLGQLEERLKHLEKAKEAYESGLKHCPSCIPLWLSLAHLEEKMNGLSKARAVLTMARKKNPQNPELWLSAVRAELRHGHKKEADILMAKALQECPNSGILWAASIEMVPRPQRKTKSMDAIKKCDHDPHVIAAVAKLFWYDRKVDKARNWLNRAVTLAPDVGDFWALYYKFELQHGGDENQKDVLKRCIAAEPKHGEKWQTISKAVENSHQPTESILKKVVVALGKEEGAVESSKN

SEQ ID NO: 10294 - protein, 1023 aa, Vitis vinifera
MVFVKSFDNKTLILNLNPKATTFETLKHQIERELGIPLSLQRIFLNPRRLIGDESALIAELGVRSDSALTLHLPLFGGMQAPVVPKPRLEFLNTKPPPNYVAGLGRGATGFTTRSDIGPARAAPDLPDRSATTIGGAAAPGGIGRGRGKGGAEEEEEDEGDEKGYDENQKFDEFEGNDVGLFASAEYDEDDKEADAVWEAIDKRMDSRRKDRREARLKQEIEKYRASNPKITEQFADLKRKLCTLSAQEWDSIPEIGDYSLRNKKRRFESFVPVPDTLLEKARQEQEHVTALDPRSRAAGGTETPWAQTPVTDLTAVGEGRGTVLSLKLDRLSDSVSGLTVVDPKGYLTDLKSMKITSDAEISDIKKARLLLKSVTQTNPKHPPGWIAAARLEEVAGKIQAARQLIHKGCEECPKNEDVWLEACRLASPDEAKAVIAKGVKAISNSVKLWMQAAKLEHDDVNKSRVLRKGLEHIPDSVRLWKAVVELANEEDARLLLQRAVECCPLHVELWLALARLETYDNAKKVLNKAREKLSKEPAIWITAAKLEEANGNTAMVGKIIERGIRALQREGLAIDREAWMKEAEAAERAGSVASCQAIVHNTIGIGVEEEDRKRTWVADAEECKKRGSIETARAIYAHALTVFLTKKSIWLKAAQLEKSHGTRESLDALLRKAVTYRPQAEVLWLMGAKEKWLAGDVPAARAILQEAYAAIPNSEEIWLAAFKLEFENHEPERARMLLAKARERGGTERVWMKSAIVERELGNTGEERRLLGEGLKLFPSFFKLWLMLGQLEERFGNFEKAKEAYDSGLKHCPSCIPLWLSLSHLEEKMNGLSKARAVLTMARKKNPQNPELWLAAVRAESRHGNKKEADILMAKALQECPTSGILWAASIEMVPRPQRKTKSLDALKKCDHDPHVIAAVAKLFWHDRKVDKARTWLNRAVTLAPDIGDFWALYYKFEVQHGSEENQKDVLRRCVAAEPKHGEKWQVISKAVENSHLPTEAILKKAVVALGKEESVAESSKD

SEQ ID NO: 10295 - protein, 1023 aa, Citrullus lanatus
MVFLSIPNQKTLFLNLNPATTSIFNLKRAIEEVSHIPVSLQRLFLSQSFQLSHLNDSTLLSHARVLPNSTLTLHVPLYGGMQAPTIPKPRLDFLNSKPPPNYVAGLGRGATGFTTRSDIGPARAAPDLPDRSATTIGGAAAAPPGRGRGKGGEEEEEDEGEDKGYDENQKFDEFEGNDVGLFASAEYDEDDKEADAVWEAIDKRMDSRRKDRREARLKEEIEKYRASNPKITEQFADLKRKLYTLSAQEWESIPEIGDYSLRNKKKRFESFVPVPDTLLEKARQEQEHVTALDPKSRAAGGTETPWAQTPVTDLTAVGEGRGTVLSLKLDRLSDSVSGLTVVDPKGYLTDLKSMKITSDAEISDIKKARLLLKSVTQTNPKHPPGWIAAARLEEVAGKIQAARQLIQKGCEECPKNEDVWLEACRLASPDEAKAVIARGAKSIPNSVKLWLQAAKLEHDTANKSRVLRKGLEHIPDSVRLWKAVVELANEEDARLLLHRAVECCPLHVELWLALARLETYDRAKKVLNSAREKLPKEPAIWITAAKLEEANGNTAMVGKIIEKGIRALQRVGVVIDREAWMKEAEAAERAGSVATCQAITHNTIGVGVEEEDRKRTWVADAEECKKRGSIETARAIYAHALTVFLTKKSIWLKAAQLEKSHGTRESLDALLRKAVTYRPQAEVLWLMGAKEKWLAGDVPAARSILQEAYAAIPNSEEIWLAAFKLEFENHEPERARMLLAKARERGGTERVWMKSAIVERELGNSEEESKLLIEGLKRFPSFFKLWLMLGQLEERLRHMEKAKEAYESGLKHCPSCIPLWLSLAHLEEKMNGLSKARAVLTMARKKNPQNPELWLSAVRAELRHGNKKEADILMAKALQECPNSGILWAASIEMVPRPQRKTKSMDALKKCDHDPHVIAAVAKLFWHDRKVDKARTWLNRAVTLAPDVGDFWALYYKFELQHGVDENQKDVLKRCIAAEPKHGEKWQTISKAVENSHQPTEAILKKVVVALGKEEGVVENSKN

SEQ ID NO: 10296 - protein, 1026 aa, Prunus persica
MVFITSPNHKTLTLNLNPKTTTLQTLKLQIEQKSQIPISEQRLFISQSLQLLTQTGSTLLSDLGIRPLSTLTLHIPLFGGTQPPNVPKPRLEFLNSKPPPNYVAGLGRGATGFTTRSDIGPARAAPDLPDRSATTIGGAASAAAPPGVGRGRGKPEEEEEDEGEDKGYDENQKFDEFEGNDVGLFASAEYDDEDKEADAVWEAIDTRMDSRRKDRREARLKEEIEKYRASNPKITEQFANLKRKLYTVSAQEWESIPEIGDYSLRNKKKRFESFVPVPDTLLEKARQEKEHVTALDPKSRAASGTETPWSQTPVTDLTAVGEGRGTVLSLKLDRLSDSVSGLTVVDPKGYLTDLKSMKITSDAEISDIKKARLLLKSVTQTNPKHPPGWIAAARLEEVAGKIQAARQLIQKGCEECPKSEDVWLEACRLANPDEAKAVIAKGVKTIPNSVKLWMQAAKLEHDDLNRSRVLRKGLEHIPDSVRLWKAVVELANEEDARLLLHRAVECCPLHIELWLALARLETYDNAKKVLNKAREKLSKEPAIWITAAKLEEANGNTSMVGKIIERGIRALQREGLAIDREAWMREAEAAERAGSVATCQAIIRNTIGIGVEEEDRKRTWVADAEECKKRGSIETARAIYAHALTVFLTKKSIWLKAAQLEKSHGTRESLDALLRKAVTYRPQAEVLWLMGAKEKWLAGDVPAARAILQEAYAAIPNSEEIWLAAFKLEFENHEPERARMLLAKARERGGTEKVWMKSAIVERELGNLDEERKLLDEGLKRYASFFKLWLMLGQLEERLGHLEKAKEAYDSGLKHCSNSIPLWLSRANLEEKMVGLSKARAVLTMGRKKNPQNPELWLAAVRAELRHGNKKEADILMAKALQECPNSGILWAASIEMVPRPQRKTKSMDALKKCDHDPHVIAAVAKLFWHDRKVDKARNWLNRAVTLAPDIGDFWALYYKFELQHGTEENQKDVLKRCEAAEPKHGEKWQPISKAVENSHQSFEAILKKVVVALGKEESAAENNKH

SEQ ID NO: 10297 - protein, 1026 aa, Malus domestica
MVFITSPNHKTLTLNLNPKTTTLKTLKLQIEQNSHIPISQQRLFISQSLQLLTQSDSSLLSDLGIRPLSTLTLHIPLFGGTQPPAVPKPRLEFLNSKPPPNYVAGLGRGATGFTTRSDIGPARAAPDLPDRSATTIGGAAAPAAPPGVGRGRGKPEEEEEDEGEDKGYDENQKFDEFEGNDVGLFASAEYDDEDKEADAVWEAIEQRMDSRRKDRREARLKEEIEKYRASNPKITEQFATLKRKLYTVSAQEWESIPEIGDYSSRNKKKRFESFVPVPDTLLEKARQEKEHVTALDPKSRGAGGMETPWSQTPVTDLTAVGEGRGTVLSLKLDRLSDSVSGLTVVDPKGYLTDLKSMKITSDAEISDIKKARLLLKSVTQTNPKHPPGWIAAARLEEVAGKIQAARQLIQKGCEECPKSEDVWLEACRLSSPDEAKAVISKGVKSIPNSVKLWMQAAKLERDDLNRSRVLRKGLEHIPDSVRLWKAVVELANEEDARLLLHRAVECCPLHIELWLALARLETYENARKVLNRAREKLSKEPAIWITAAKLEEANGNTAMVGKIIERGIRALQREGLAIDREAWMKEAEAAERAGSVATCQAIIRNTIGIGVEEEDRKRTWVADAEECKKRGSIETARAIYAHALTVFLTKKSIWLKAAQLEKSHGTRESLDALLRKAVTYRPQAEVLWLMGAKEKWLAGDVPAARAILQEAYAAIPNSEEIWLAAFKLEFENHEPERARMLLAKAREKGGTERVWMKSAIVERELGNINEERKLLDDGLKRFPSFYKLWLMLGQLEERLGHLEKAKEAYDSGQKHCSSSIPLWLSLANLEEKMSGLSKARAILTMARKKNPQNPELWLAAVRAELRHGNKKEADILMAKALQECPNSGILWAASIEMVPRPQRKTKSMDALKKCDHDPHVIAAVSKLFWHDRKVDKARTWLNRAVTLAPDIGDFWALYYKFELQHGTEENQKDVLKRCIAADPKHGEKWQPISKAVENSHQPTEAILKKVVVALGKEESAAENNKQ

SEQ ID NO: 10298 - protein, 819 aa, Malus domestica
MDSRRKDRREARLKEEIEKYRASNPKITEQFATLKRKLYTVSAQEWESIPEIGDYSSRNKKKRFESFVPVPDTLLEKARQEKEHVTALDPKSRGAGGTETPWSQTPVTDLTAVGEGRGTVLSLKLDRLSDSVSGLTVVDPKGYLTDLKSMKITSDAEISDIKKARLLLKSVIQTNPKHPPGWIAAARLEEVAGKIQAARQLIQKGCEECPKSEDVWLEACRLSSPDEAKSVISKGVKSIPNSVKLWMQAAKLERDDLNRSRVLRKGLEHIPDSVRLWKAVVELANEEDARLLLHRAVECCPLHIELWLALARLETYDNARKVLNRAREKLSKEPAIWITAAKLEEANGNTAMVGKIIERGIRALQREGLAIDREAWMKEAEAAERAGSVATCQAIIRNTIGIGVEEEDRKRTWVADAEECKKRGSIETARAIYAHALTVFLTKKSIWLKAAQLEKSHGTRESLDALLRKAVTYRPQAEVLWLMGAKEKWLAGDVPAARAILQEAYAAIPNSEEIWLAAFKLEFENHEPERARMLLAKAREKGGTERVWMKSAIVERELGNINAERKLLDDGLKRFPSFYKLWLMLGQLEERLGHLEKAKEAYDSGLKYCSSSIPLWLSLANLEEKMTGLSKARAILTMARKKNPQNPELWLAAVRAELRHGNKKEADILMAKALQECPNSGILWAASIEMVPRPQRKTKSMDALKKCDHDPHVIAAVSKLFWHDRKVDKARTWLNRAVTLAPDIGDFWALYYKFELQHGTDENQKDVLKRCIAAEPKHGEKWQPISKAVENSHQPTEAILKKVVVALGKEESAAENNKQ

SEQ ID NO: 10299 - protein, 818 aa, Fragaria vesca
MDSRRKDRREARLKQEIEKYRASNPKITEQFANLKRQLYTVSAEEWDKIPDIGDYSARNKKRKFESFVPVPDTLFEKARQEQEHVTALDPKSRAATGTETPWSQTPVTDLTAVGDGRSTVLSLKLDRLSDSVSGLTVVDPKGYLTDLKSMKITSDAEISDIKKARLLLKSVTQTNPKHPPGWIAAARLEEVAGKIQAARQLIQKGCEECPKSEDVWLEACRLASPDGAKAVIAAGVKSIPNSVKLWMQAAKLEHDDSNKSRVLRKGLEHIPDSVRLWKAVVELANEEDARLLLHRAVECCPLHIELWLALARLETYDNAKKVLNKAREKLSKEPAIWITAAKLEEANGNTSVGKIIERGIRALQREGLVIDREAWMKEAEAAERAGSVATCQAIIRNTIGIGVEEEDRKRTWVADAEECKKRGSIETARAIYAHALTVFLSKKSIWLKAAQLEKSHGTRESLDALLRKAVTYRPQAEVLWLMGAKEKWLAGDVFNARKILEEAYAAIPNSEEIWLAAFKLEFENHEPERARLLLAKAREKGGTERVWMKSAIVERELGNLDEERKLLAEGLKRFPSFFKLWLMLGQLEERLNHLDKAKETYDSGLKHCSNSIPLWLSLANLEEKMNGLSKARAVLTMARKKNPQNPELWLAAVRAELRHGNKKEADILMAKALQECPNSGILWAASIEMVPRPQRKTKSMDALKKCDHDPHVIAAVAKLFWLDRKVDKARTWLNRAVTLAPDIGDFWALYYKFELQNGTDENQKDVLKRCIAAEPKHGEKWQPISKAVENSHQPTEAILKKVVVALGKEESAAENNRQ

SEQ ID NO: 10300 - protein, 1031 aa, Ricinus communis
MVFVKSPNNKTLSLNLNPNTTTLSLLKQHIQSQTQIPISDQFFLNPSFNVYSSSKYANIFESCPLSHLGITNFSTLTLYIPFHGGTQTPAPPKPRLDFLNSKPPPNYVAGLGRGATGFTTRSDIGPARAAPDLPDRSAVAIGAAGGAAGAGMGRGRGKGGEEDDEDDGDEKGYDENQKFDEFEGNDVGLFASAEYDEDDKEADAVWEAIDKRMDSRRKDRREARLKEEIEKYRASNPKITEQFADLKRKLHTLSAEEWESIPDIGDYSLRNKKKRFESFVPVPDTLLEKARQEQEHVTALDPKSRAAGGAETPWSQTPVTDLTAVGEGRGTVLSLKLDRLSDSVSGLTVVDPKGYLTDLKSMKITSDAEISDIKKARLLLKSVTQTNPKHPPGWIAAARLEEVAGKIQAARQLIQRGCEECPKNEDVWIEACRLASPDEAKAVIAKGVKCIPNSVKLWLQAAKLEHDDVNKSRVLRKGLEHIPDSVRLWKAVVELANEEDARTLLHRAVECCPLHVELWLALARLETYDSAKKVLNRAREKLPKEPAIWITAAKLEEANGNTSTVGKIIERGIRALQREGLVIDREAWMKEAEAAERAGSVVTCQAIIKNTIGIGVEEEDRKRTWVADAEECKKRGSIETARAIYAHALTVFLTKKSIWLKAAQLEKSHGTRESLDALLRKAVTYRPQAEVLWLMGAKEKWLAGDVPAARAILQEAYAAIPNSEEIWLAAFKLEFENHEPERARMLLAKARERGGTERVWMKSAIVERELGNTEEERRLLDEGLKRFPSFFKLWLMLGQLEERIFHLDKAKEVYESGLKHCPSCIPLWLSLANLEEKMNGLSKARAVLTMARKKNPQNPELWLAAVRAESRHGNKKESDILMAKALQECPNSGILWAASIEMVPRPQRKTKSMDALKKCDHDPHVIAAVAKLFWHDRKVDKARTWLNRAVTLAPDIGDFWALYYKFELQHGTEENQRDVLKRCIAAEPKHGEKWQAISKAVENAHQQTEAILKKVVIVLGKEENAAENNKH

SEQ ID NO: 10301 - protein, 1030 aa, Manihot esculenta
MVFVKSSDNKTLSFHLNPNTTTLSALKYHIHTQFQIPISHQRFLLPSFNPLYNPSDTQNSDEVLLSQLGITPYSTLTLYIPFLGGTQTPAPPKPRLDFLNSKPPPNYVAGLGRGATGFTTRSDIGPARAAPDLPDRSATTIGGASAAGSGVGRGRGKGGDEEDEDDGDDKGYDENQKFDEFEGNDVGLFASAEYDEDDKEADAVWEAIDKRMDSRRKDRREARLKQEIEKYRASNPKITEQFADLKRKLYTLSAQEWESIPDIGDYSLRNKKRRFESFVPVPDTLLEKARQEQEHVTALDPKTRAAGGTETPWSQTPVTDLTAVGEGRGTVLSLKLDRLSDSVSGLTVVDPKGYLTDLKSMKITSDAEISDIKKARLLLKSVTQTNPKHPPGWIAAARLEEVAGKIQAARQLIQRGCEECPKNEDVWLEACRLASPDEAKAVIAKGVKSIPNSVKLWLQAAKLEHDDVNKSRVLRKGLEHIPDSVRLWKSVVELSNEENARILLHRAVECCPLHVELWLALARLETYDNAKKVLNRAREKLPKEPAIWITAAKLEEANANTSMVGKIIERGIRALQREAVVIDREAWMKEAEAAERAGSVVTCQAIIKNTIGIGVEEEDRKRTWVADAEECKKRGSIETARAIYAHALTVFLTKKSIWLKAAQLEKSHGTRESLDALLRKAVTYRPQAEVLWLMGAKEKWLAGDVPAARAILQEAYAAIPNSEEIWLAAFKLEFENHEPERARMLLAKARERGGTERVWMKSAIVERELGNTEEERRLLDEGLKRFPSFFKLWLMLGQLEARLGQLEKAKEAYESGLKHCPSCIPLWLSLANLEEKMNGLSKARAVLTMARKKNPQNPELWLAAVRAESRHANKKEADILMAKALQECPNSGILWAASIEMVPRPQRKSKSMDALKKCDHDPHVISAVAKLFWHDRKVDKARTWLNRAVTLAPDIGDFWALYYKFELQHGTEENQKDVLKRCIAAEPKHGEKWQAISKAVENAHQQTEAILKKVVVALGKEENAENNRHN

SEQ ID NO: 10302 - protein, 1033 aa, Theobroma cacao
MVFVATPNSKTVSLNLNPKTTTLLSLQQSIQLHTQIPISHQNLLLSPNPRSLLLSSQNPDSVLLSQLHITPYSTLFLHVPLLGGTQPGPGGAAPPKPRLDFLNSKPPPNYVAGLGRGATGFTTRSDIGPARAAPDLPDRSATTIGGAAASSGLGRGRGKPGEDEDEDEGDDKGYDENQKFDEFEGNDVGLFASAEYDEDDKEADAVWEAIDKRMDSRRKDRREARLKQEIEKYRASNPKITEQFADLKRKLHTMSAQEWESIPEIGDYSLRNKKRRFESFVPVPDTLLEKARQEQEHVTALDPKSRAAGGTETPWAQTPVTDLTAVGEGRGTVLSLKLDRLSDSVSGLTVVDPKGYLTDLKSMKITSDAEISDIKKARLLLKSVTQTNPKHPPGWIAAARLEEVAGKIQAARQLIQKGCEECPKNEDVWLEACRLSSPDEAKAVIARGVKSIPNSVKLWLQAAKLEHDDVNKSRVLRRGLEHIPDSVRLWKAVVELANEEDAVLLLERAVECCPLHVELWLALARLRDYDKAKKVLNRAREKLPKEPAIWITAAKLEEANGNNAMVGKIIERCIRALQREGLVIDREAWMKEAEAAERAGSVVTCQAIIRNTIGIGVEEEDRKRTWVADAEECKKRGSIETARAIYAHALTVFLTKKSIWLKAAQLEKSHGTRESLDALLRRAVTYRPQAEVLWLMGAKEKWLAGDVPAARAILQEAYAAIPNSEEIWLAAFKLEFENHEPERARMLLAKARERGGTERVWMKSAIVERELGNTEEERRLLDEGLKQFPSFFKLWLMLGQLEEGLGNLEKAKEVYESGLKHCPSCIPLWVSLAILEEKMNGIAKARAVLTLARKKNPQQPELWLAAIRAESRHGYKREADILMAKALQECPNSGILWAVSIEMVPRPQRKTKSMDALKKCDHDPHVIAAVAKLFWHDRKVDKARTWLNRAVTLAPDIGDFWALYYKFELQHGSEENQKDVMKRCVAAEPKHGEKWQAISKAVENSHQPTEAILKKVVVALGKEESAAENNSKH

SEQ ID NO: 10303 - protein, 736 aa, Gossypium hirsutum
MLRLWTQEQGCGGTETPWAQTPVTDLTAVGEGRGTVLSLKLDRLSDSVSGLTVVDPKGYLTDLKSMKITSDAEISDIKKARLLLKSVTQTNPKHPPGWIAAARLEEVAGKIQTARQLIQKGCEECPKNEDVWLEACRLASPDEAKAVIAKGVKSIPNSVKLWLQAAKLEHDDVNKSRVLRRGLENIPDSVRLWKAVVELANEKDAATLLERAVECCPLHVELWLALARLKDYDKAKKVLNRAREKLPKEPAIWITAAKLEEANGNNAMVGKIIERCIRALQREGFVIDREAWMKEAEAAERAGSVVTCQAIIRNTIGIGVEEEDRKRTWVADAEECKKRGSIETARAIYAHALTVFLTKKSIWLKAAQLEKSHGTRESLDALLRKAVTYRPQAEVLWLMGAKEKWLAGDVPAARAILQEAYAAIPNSEEIWLAAFKLEFENHEPERARILLAKARERGGTERVWMKSAIVERELGNTEEERRLLDEGLKQFPSFFKLWLMLGQLEERLGNLEKAKGVYESGLKHCPSCIPLWVSLAILEEKMNGIAKARAVLTLARKKNPQKPELWLAAIRAEARHGYKKEADILMAKALQECPNSGILWAASIEMVPRPQRKTKSMDALKKCDHDPHVIAAVAKLFWHDRKVDKARTWLNRAVTLAPDIGDFWALYYKFELQHGSEENQKDVMKRCVAAEPKHGEKWQAISKAVENSHQPTEAILKKVVVVLGKEESAAENNSKH

SEQ ID NO: 10304 - protein, 670 aa, Malus domestica
MKITSDAEISDIKKARLLLKSVIQTNPKHPPGWIAAARLEEVAGKIQAARQLIQKGCEECPKSEDVWLEACRLSSPDEAKSVISKGVKSIPNSVKLWMQAAKLERDDLNRSRVLRKGLEHIPDSVRLWKAVVELANEEDARLLLHRAVECCPLHIELWLALARLETYDNARKVLNRAREKLSKEPAIWITAAKLEEANGNTAMVGKIIERGIRALQREGLAIDREAWMKEAEAAERAGSVATCQAIIRNTIGIGVEEEDRKRTWVADAEECKKRGSIETARAIYAHALTVFLTKKSIWLKAAQLEKSHGTRESLDALLRKAVTYRPQAEVLWLMGAKEKWLAGDVPAARAILQEAYAAIPNSEEIWLAAFKLEFENHEPERARMLLAKAREKGGTERVWMKSAIVERELGNINAERKLLDDGLKRFPSFYKLWLMLGQLEERLGHLEKAKEAYDSGLKYCSSSIPLWLSLANLEEKMTGLSKARAILTMARKKNPQNPELWLAAVRAELRHGNKKEADILMAKALQECPNSGILWAASIEMVPRPQRKTKSMDALKKCDHDPHVIAAVSKLFWHDRKVDKARTWLNRAVTLAPDIGDFWALYYKFELQHGTDENQKDVLKRCIAAEPKHGEKWQPISKAVENSHQPTEAILKKVVVALGKEESAAENNKQ

SEQ ID NO: 10305 - protein, 1027 aa, Mimulus guttatus
MVFVKSPDNKTLILNLNPSTTTRQALSLHIQRNYLIPIAQQRLYLSHRLLSTPENDAVLLSHLGVSPNSTLTLHVPFLGGMQAPVAPKKLEFLGTRPPPNYVAGLGRGATGFTTRSDIGPARSAPDLPDRSAAAIGVTAPPLGAAAVGRGRGKGTGDEDEDEDPEEKGYDENQKFDEFEGNDAGLFASAEYDEEDKEADAVWDAIDERMDSRRKDRREARLKEEIEKYRASNPKITEQFADLKRKLYTLSTSDWDSIPDIGDYTSKNKKKRFESFVPVPDTLLEKARQEKEHVSALDPKSRGVGGTETPWGQTPVTDLTAVGEGRGTVLSLKLDRLSDSVSGLTVVDPKGYLTDLKSMKITSDAEVSDINKARLLLKSVTQTNPKHPNGWIAAARLEEVAGKIQAAQHLIKRGCDECPRSEDVWLESCRLASHADAKAVIAKGVKAIPKSVRLWMQAAKLEQDDTNKSRVLRKALENIPDSVRLWKAVVELANEEDARLLLQRAAECCPLHVELWLALARLETYENAKKVLNKAREKLPKEPAIWITAAKLEEANGNTAMVGKIIERGIRALQREGLEIDREMWMKEAEAAERAGSVATCKAIIENTIKVGVEEEDRKRTWVADAEECKKRGSIETARAIYGHALNVFLTKKSIWLKAAQLEKSHGTRESLDALLRRAVTYIPHAEVLWLMGAKEKWLAGDVPSARAILQEAYAAIPNSEEIWLAAFKLEFENQEPERARMLLAKARERGGTERVWMKSAIVERELGNTAEERRLLDEGLKLFPSFFKLWLMLGQLEERLSNLDKAKETYELGLKHCQNCIQLWLSLAHLEEKVNGLSKARAILTMARKKNPQNPHLWLAAVWAEARHGNKKESDILMAKALQECPTSGILWAASIEMVSRPQQKTKSRDAYKKCGDDPHVLAAVGRIFWHDRKVDKARSWFNRAVTLSPDIGDFWALYYKFELQHGTEETQRDVLNRCVTAEPKHGEKWQAISKAVENSHQPTEFILKKVVVAIGKEEHAAENSKN

SEQ ID NO: 10306 - protein, 1034 aa, Glycine max
MVFIVSPNHKTFSIDINPNTTTLHLLKLAIQHILTLPISHQRLFLSHSRRLSADNDGSDDSLLISDLGVGPYSTLTLHVPFLGGTNPPAVPKPRFDFLNSKPPPNYVAGLGRGATGFTTRSDIGPARAAPDLPDRSATTIGGTSGAGRGRGKPGEDEDDDDGEDKGYDENQKFDEFEGNDVGLFASAEYDEDDKEADAVWEAVDKRMDSRRKDRREARLKQEIEKYRASNPKITEQFADLKRRLYTLSPDDWQSLEKFESGGYSSRNKKKRFESFVPVPDTLLEKARQEQEHVTALDPKSRAANGTETPWAQTPVTDLTAVGEGRGTVLSLKLDRLSDSVSGMTNVDPKGYLTVLNSMKITSDAEISDFKKARLLLKSVTQTNPKHPPGWIAAARLEELAGKLQAARQLIQKGCEECPKNEDVWLEACRLANPDEAKAVIARGVKSIPNSVKLWMQASKLENDDANKSRVLRKGLEHIPDSVRLWKAVVELANEEDARLLLHRAVECCPLHVELWLALARLETYDNAKKVLNRARERLSKEPAIWITAAKLEEANGNTSMVGKIIERGIRALQREGVVIDREAWMKEAEAAERAGSIVTCQAIIHNTIGVGVEEEDRKRTWVADAEECKKRGSIETARAIYAHALTVFLTKKSIWIKAAQLEKSHGTRESLDALLRKAVTYRPQAEVLWLMGAKEKWLAGDVPAARAILQEAYAAIPNSEEIWLAAFKLEFENHEPERARMLLAKARERGGTERVWMKSAIVERELGNIEEERRLLDEGLKQFPSFFKLWLMLGQLEEQLAENEKRLDRMNAAKKVYEAGLRNCPNCVPLWLSLANLEEEMNGLSKERAVLTMARKKNPQNPELWLAAVRAELKHGYKKEADILMAKALQECPNSGILWAASIEMVPRPQRKTKSADAIKKCDHDPHVIAAVAKLFWHDRKVDKARTWLSRAVTLAPDIGDFWALLYKFELQHGTEENQKDVLKRCIAAEPKHGEKWQAISKAVENSHQPTESILKKVVVALGKEENAAENNKH

SEQ ID NO: 10307 - protein, 824 aa, Gossypium hirsutum
MDSRRKDRREARLKEEIEKYRASNPKITEQFADLKRKLHTLSAEEWESIPEIGDYSLRNKKRRFESFVPVPDTLLEKARQEQEHVTALDPKSRAAGGTETPWAQTPVTDLTAVGEGRGTVLSLKLDRLSDSVSGLTVVDPKGYLTDLKSMKITSDAEISDIKKARLLLKSVTQTNPKHPPGWIAAARLEEVAGKIQTARQLIQKGCEECPKNEDVWLEACRLASPDEAKAVIAKGVKSIPNSVKLWLQAAKLEHDDVNKSRVLRRGLENIPDSVRLWKAVVELANEKDAATLLERAVECCPLHVELWLALARLKDYDKAKKVLNRAREKLPKEPAIWITAAKLEEANGNNAMVGKIIERCIRALQREGFVIDREAWMKEAEAAERAGSVVTCQAIIRNTIGIGVEEEDRKRTWVADAEECKKRGSIETARAIYAHALTVFLTKKSIWLKAAQLEKSHGTRESLDALLRKAVTYRPQAEVLWLMGAKEKWLAGDVPAARAILQEAYAAIPNSEEIWLAAFKLEFENHEPERARILLAKARERGGTERVWMKSAIVERELGNTEEERRLLDEGLKQFPSFFKLWLMLGQLEERLGNLEKAKGVYESGLKHCPSCIPLWVSLAILEEKMNGIAKARAVLTLARKKNPQQPELWLAAIRAEARHGYKKEADILMAKALQECPNSGILWAASIEMVPRPQRKTKSMDALKKCDHDPHVIAAVAKLFWHDRKVDKARTWLNRAVTLAPDIGDFWALYYKFELQHGSEENQKDVMKRCVAAEPKHGEKWQAISKAVENSHQATEAILKKVVVVLKRAHFRYIKLQNLPFFF

SEQ ID NO: 10308 - protein, 862 aa, Amsonia hubrichtii
LKLDLPVSLQRLYLSPRLLSTPQDDGVFLSVLGVLPHSTLTLHVPLMGGMQAPVVPKNTRLDFLNTRPPPNYVAGLGRGATGFTTRSDIGPARAAPDLPDRSLGAAAGAPGVGRGRGKGGPGEEEEEEENDEKGYDENQKFDEFEGNDVGLFASAEYDDEDKEADAIWEAIDKRMDLRRKDRREARLKEEIEKYRASNPKITEQFADLKRKLHTMSNEEWESIPEIGDYSLRNKKKRFESFVPVPDTLLEKARQEKEHVTALDPKSRAVGGTETPWSQTPVTDLTAVGEGRGTVLSLKLDRLSDSVTGQTVVDPKGYLTDLRSMKITSDAEISDIKKARMLLSSVIHSNPKHPPGWIAAARLEEVAGKIQSARQLITKGCEECPKSEDVWLEASRLANPDESKAVIARAIKANPTSVRLWLEAAKLEHDDANKSRVLRKGLERIPDSVRLWKAVVELANEEDARLLLHRAVECCPLRVELWIALARLETYDNSKKVLNTAREKLPKEPAIWITAAKLEEANGNVSMVGKIVERAIRALQREGLEIDREAWMKEAEAAERAGSVVTCQAIIRNTIGIGVEEEDRKRTWVADAEECKKRGSIETARAIYAHALTVFLTKKSIWLKAAQLEKSHGTRESLDALLRKAVTYIPHAEVLWLMGAKEKWLAGDVPAARAILQEAYAAIPNSEEIWLAAFKLEFENHEPERARMLLAKARERGGTERVWMKSAIVERELGNTEEERKLLDEGLKRFPSFFKLWLMLGQLEERLHNLEQAKETYESGLKHCPSCIPLWLSLANLEEKMNGLSKARAVLTMARKKNPRNPELWLAAVRAESRHGYKKEADNFDGQGTTGVPEQRYSLGYCH

SEQ ID NO: 10309 - protein, 1037 aa, Lotus japonicus
MVFIVPPHGRTLALNINPKTTTLHLLKLAIEQTHGIPVSQQRLLLSHSLRLLGVNDSLLISDLGVGPYSTLTLHVPLYGGMQPPVVPKPRFDFLNSKPPPNYVAGLGRGATGFTTRSDIGPARAAPDLPDRSAAAASGAGRGRGKGGEDEEDEEGEDKGYDENQKFDEFEGNDVGLFASAEYDEDDKEADAVWEEIDKRMDSRRKDRREARLKEEIEKYRASNPKITEQFADLKRKLYTLSSDDWQSLEKFESGGYSSRSKKKRFESFVPVPDTLLEKARKEQEHVSALDPKSRVASGTETPWAQTPVTDLTAVGEGRGTVLSLKLDRLSDSVSGMTNVDPKGYLTVLNSMKITSDAEISDFKKARLLLKSVTQTNPKHPPGWIAAARLEELAGKLQVARQLIEKGCEECPKNEDVWLEACRLANPEEAKAVIAQGVKSIPSSVKLWLQAAKLEHDDANRSRVLRKGLEHIPDSVRLWKAVVELANEHDASLLLHRAVECCPLHVELWLALARLETYDNAKKVLNRARERLPKEPAIWITAAKLEEANGNTSMVGKIIERGIRALQREGVVIDREAWMKEAEAAERAGSVATCQSIIQNTIGIGVEEEDRKRTWVADAEECKKRGSIETARAIYAHALTLSVFMQKKSIWLKAAQLEKSHGTRESLDALLRTAVKYIPQAEVLWLMGAKEKWLAGDVPAARAILQEAYAAIPNSEEIWLAAFKLEFENHEPERARMLLAKARERGGTERVWMKSAIVERELGNIEEERRLLDEGLKQFPSFFKLWLMLGQLEERLGENAKRLDQPEKRLDHLKEAKKVYESGLKNCPNCVPLWLSLATLEEETNGLSKARAVLTMARKRNPQNPELWLAAVRAELKHASKKEADNLISKALQECPNSGILWAAAIEMVPRPQRKTKSMDALKKCDHDPHVIAAVAKLFWHDRKVDKARTWLNRAVTLAPDIGDFWALYYKFELQHGAEENQKDVLKRCVAAEPKHGEKWQVISKAVENAHQPSESILKKVVVALGKEENAADNNSKH

SEQ ID NO: 10310 - protein, 148 aa, Solanum phureja
MGQNTGASGKGKKEAEMEKETVVEEEEVEEGGEEAEQDGMSVHSPCKPASSALRKEQSQVELEIRLLEALEIYPPAKLRGIHRHFVLYGLTEHLRRSFNRQFAPDEVLKLLDRFYNLDMVKPEDEDSEILNQEEEFCLPHSYFSKDEP

SEQ ID NO: 10311 - protein, 135 aa, Capsicum annuum
MKKERVVEEEEVEEGGEEGEHDEQDGMSVHSPCKPASSALRKEQSQVELEIRLLEALEIYPPAKLRGIHRHFVLYGLTEYLRRSFNRHFAPDDVLKLLDRFYNLEMVKPDDEDAEILNQEEEFCLPHSYFSKEEP

SEQ ID NO: 10312 - protein, 138 aa, Nicotiana tabacum
  misc_feature (7)..(7): Xaa can be any naturally occurring amino acid
EEMKKEXVEEEEEEEEEVEEGGEHDEQDGMSVHSPCKPPSSALRKEQSQVELEIRLLEALEIYPPAKLRGIHRHFVLYGLTEYLRRSFNRQFAPDDVLKLLDRFYNLEMVKPDDEDAEILNQEEEFSLPESYFSKEES

SEQ ID NO: 10313 - protein, 335 aa, Triticum aestivum
MAAEPEICVLSNGRITANIASWGATITSLLVPDAQGDLADVVLGFDTLEPYLKGMAPYFGCIVGRVANRIKNGKFDLNGVEYSLPINNVPNSLHGGLKGFDKVVWDVVERKDGEYPSITFQYESKDGEEGYPGDVTVRAMYSLPEATTLRLDMEAIPANKATPISLAQHTYWNLAGHNSGSILDHSIQIWAKHITPVNENTIPTGEIMPVQDTPFDFTTEHKIGDRISDVPGGYDHNYVLDSGDEKNGLKHAAKLKDPSSSRTLDLWTDAPGMQFYTANYVNGITGKGGAVYGKHAGVCLETQGFPNAINQPNFPSVVVQPGAKYKHTMLFEFSA

SEQ ID NO: 10314 - protein, 335 aa, Triticum aestivum
MAAEPEICVLSNGRITANIASWGATITSLLVPDAQGDLADVVLGFDTLEPYLKGMAPYFGCIVGRVANRIKNGKFDLNGVEYSLPINNGPNSLHGGLKGFDKVVWDVVERKEGEYPSITFQYESKDGEEGYPGDVTVRAVYSLPEATTLRLDMEAIPANKATPISLAQHTYWNLAGHNSGSILDHSIQIWAKHVTPVNENTIPTGEIMPVQDTPFDFTTEHRIGERINNVPGGYDHNYVLDSGDEKNGLKHAAKLKDPSSSRTLDLWTDAPGMQFYTANYVNGITGKGGAVYGKHAGVCLETQGFPNAINQPNFPSVVVQPGAKYKHTMLFEFSA

SEQ ID NO: 10315 - protein, 335 aa, Leymus cinereus x Leymus triticoides
  misc_feature (37)..(37): Xaa can be any naturally occurring amino acid
  misc_feature (219)..(219): Xaa can be any naturally occurring amino acid
  misc_feature (226)..(226): Xaa can be any naturally occurring amino acid
  misc_feature (229)..(229): Xaa can be any naturally occurring amino acid
MAAEPEICVLSNGRITANIASWGATITSLLVPDAQGXLADVVLGFDTLEPYLKGMAPYFGCIVGRVANRIKNGKFDLNGVEYSLPINNGPNSLHGGLKGFDKVVWDVVERKDGEYPSITFQYESKDGEEGYPGDVTVRAMYSLPEATTLRLDMEAIPANKATPISLAQHTYWNLAGHNSGNILDHLIQIWAKHITPVNENTIPTGEIMPVQDTPFDFTXEHKIGDXINXVPGGYDHNYVLDSGDEKNGLKHAAKLKDPSSSRTLDLWTDAPGMQFYTANYVDGITGKGGAVYGKHAGVCLETQGFPNAINQPNFPSVVVQPGAKYKHTMLFEFSA

SEQ ID NO: 10316 - protein, 335 aa, Hordeum vulgare
MAVEPEICVLSNGRITANIANWGATITSLLVPDAQGDLADVVLGFDTLEPYLKGMAPYFGCIVGRVANRIKDGKFDLNGVEYSLPINNGPNSLHGGLKGFDKVVWDVVERKDGEYPSITFQYESKDGEEGYPGDVTIRATYSLPEATTLRLDMEAIPANKATPISLAQHTYWNLAGHNSGTILDHSIQIWAKHITPVNENTIPTGEIMSVQDTPFDFTTEHRIGDRINDVPGGYDHNYVLDSGDEKNGLKHAAKLKDSSSSRTLDLWTDAPGMQFYTANYVNGITGKGGAVYGKHAGVCLETQGFPNAINQTNFPSVVVQPGAKYKHTMLFEFSA

SEQ ID NO: 10317 - protein, 335 aa, Avena sativa
MAAEPEIFELSNGRITAKIANWGATITSLLVPDAQGNLADVVLGFDTLEPYLKGMAPYFGCIVGRVANRIKNGKFDLNGVEYSLPINNGPNSLHGGLKGFDKVVWDVVERKDGEYPSITFQYDSKDGEEGYPGDVTIRAIYSLPEATTLRLDMEAIPANKATPISLAQHTYWNLAGHNSGNILDHSIQIWGKHITPVDENTIPTGEIMPVQDTPFDFTTERKIGDRINDVPGGYDHNYVLDLGDEKDGLKHAAKLKDTSSSRTLDLWTDAPGMQFYTANYVDGIIGKGGSVYGKHAGVCLETQGFPDAINQPNFPSVVVQPGAKYKHTMLFEFSA

SEQ ID NO: 10318 - protein, 305 aa, Pseudoroegneria spicata
  misc_feature (3)..(3): Xaa can be any naturally occurring amino acid
VPXAQGDLADVVLGFDTLEPYLKGMAPYFGCIVGRVANRIKNGKFDLNGVEYSLPINNGPNSLHGGLKGFDKVVWDIVERKDGEYPSITFQYESKDGEEGYPGDVTVRAMYSLPEATTLRLDMEAIPANKATPISLAQHTYWNLAGHNSGSILDHSIQIWAKHITPVNENTIPTGEIMPVQDTPFDFITEHKIGDRISDVPGGYDHNYVLDSGDEKNGLKHAAKLKDPSSSRTLDLWTDAPGMQFYTANYVNGITGKGGAVYGKHAGVCLETQGFPNAINQPNFPSVVVQPGAKYKHTMLFEFSA

SEQ ID NO: 10319 - protein, 335 aa, Setaria italica
MAAEPKIIELSNGRITTRIASWGATITSLLVPDAHGNVADVVLGFDDLEPYMKGMAPYFGCIVGRVANRIKDGKFTLNGAEYSLPINNGPNSLHGGLTGFDKVMWDVVEHKDGECPSVTFQYHSKDGEEGYPGDVTVRATYSLPEATTLRLDMEAIPHDKATPINLAQHTYWNLAGHNSGDILNHTIQIWGKHITPVDENTIPTGEIMPVEGTPFDFTTEHKIGERINDVPGGYDHNYVLDCGDEKNGVKHAAKLRDPSSSRTLNLWTDAPGMQFYTANYVTGITGKGGAVYEKHAGVCLETQGFPNAINQPNFPSVVVQPGEKYKHTMLFEFSA

SEQ ID NO: 10320 - protein, 333 aa, Oryza sativa
MAAEEILELSNGRITAKIAAWGATITSLIVPDAHGNLADVVLGFDTLEPYMKGISPYFGCIVGRVANRIKEGKFTLNGVEYSLAINNGPNSLHGGLKGFDKVVWDVVERKSECPSITFQYHSKDGEEGYPGDVTVRATYSLPDSTTLRLDMEAVAENKATPINLAQHTYWNLAGHNSGDTLDHSIQIWGKHITPVDENTIPTGEIMPVKGTPFDFTTEHKIGARINDVPGGYDHNYVLDSGEEKNGLKHAAKLKDSSNSRTLDLWTDAPGMQFYTANYVDGVTGKGGAVYGKHSGVCLETQGFPNAINQPNFPSVVVQPGEKYKHTMLFEFSA

SEQ ID NO: 10321 - protein, 335 aa, Pennisetum glaucum
MAAEPKILELSNGRITARIASWGATITSLLVPDAHGNVADVVLGFDDLEPYMKGMAPYFGCIVGRVANRIKDGKFTLNGAEYSLPINNGPNSLHGGLTGFDKVVWDVVEHKDGECPSITFQYHSKDGEEGYPGDITVRATYSLPEATTLRLDMEAVPHDKATPINLAQHTYWNLAGHNSGDILNHSIQIWAKSITPVDENTIPTGEIIPVEGTPFDFTTEHKIGEHINDVPGGYDHNYVLDCGDEKNGVKRAAKLRDPSSSRTLNLWTDAPGMQFYTANYVSGITGKGGAVYEKHAGVCLETQGFPNAINQPNFPLVVVQPGEKYKHTMLFEFSA

SEQ ID NO: 10322 - protein, 335 aa, Panicum virgatum
MATEPKILELSNGRITARITSWGATITSLLVPDAHGNVADVVLGFDDLEPYMKGISPYFGCIVGRVANRIKDGKFALNGAEYSLPINNGPNSLHGGLKGFDKVVWDVVEHKDGECPSITFQYHSKDGEEGYPGHVTVRATYSLPEATTLRLDMEATPHDKATPISLAQHTYWNLAGHNSGDILNHSVQIWGKHITPVDENTIPTGEIMPVEGTPFDFTTEHKIGERITDVPGGYDHNYVLDCGDEQNGVKHAAKLRDPSSLRTLDLWTNAPGMQFYTANYVSGITGKGGAVYEKHAGVCLETQGFPNAINQPNFPSVVVQPGEKYKHTMLFEFST

SEQ ID NO: 10323 - protein, 335 aa, Panicum virgatum
MAAEPKILELSNGRITARIASWGATITSLLVPDAHGIVADVVLGFDDLEPYMKGISPYFGCIVGRVANRIKDGKFALNGAEYSLPINNGPNSLHGGLKGFDKVVWEVVEHKDGECPSITFRYHSKDGEEGYPGDVTVRATYSLPEATTLRLDMEATPHDKATPISLAQHTYWNLAGHNSGDILNHSVQIWGKHITPVDENTIPTGEIMPVEGTPFDFTTEHKIGERITDVPGGYDHNYVLDCGDKKNGVKHAAKLRDPSSLRTLDLWTNALGMQFYTANYVSGITGKGGAVYEKHAGVCLETQGFPNAINQPNFPSVVVEPGEKYKHTMLFEFST

SEQ ID NO: 10324 - protein, 333 aa, Brachypodium distachyon
MAAEIFELSNGRITAKIANFGATIISLLVPDAQGDLADVVLGFDTLEPYLKGISPYFGCIVGRVANRIKNGKFTLNGVEYSLPINNGPNCLHGGLRGFDKVVWDVVERKDGKDPSITFQYHSKDGEEGFPGDVVVRATYSLPEPTTLRLDMEAIAENKATPISLAQHTYWNLAGHNSGDTLGHSIQIWGKYYTPVDENSIPTGEIVPVKDTPFDFTTLHKVGARINDVPGGYDHNYVLDCGDEKNGLKLAAKLKDPSTSRTLNLWTDAPGMQFYTANYVDGITGKGGAVYEKHSAVCLETQGFPNAINQPNFPSVVVQPGEKYKHTMLFEFSA

SEQ ID NO: 10325 - protein, 337 aa, Sorghum bicolor
MAAEPEPRILELSNGKITARISNWGATITSLLVPDAQGSIADVVLGFDDLDPYVKGMSPYFGCIVGRVANRIKDGKFRLNEVEYSLPVNNGPNSLHGGLRGFDKVVWDVVDHKDGECPSITFQYHSKDGEEGYPGDVTIRATYSLPEAATLRLDMEATPENKATPISLAQHTYWNLAGHASGDILNHSIQIWGKHITPVDENTIPTGEIMPVNGTSFDFTTEHKIGERINDVPGGYDHNYMLDCGDEKNGLKHAAKLRDPSSLRTLELWTDAPGMQFYTANYVNDISGKGGAVYEKHAGVCLETQGFPNAINQPNFPSVVVRPGEKYKHTMLFEFSN

SEQ ID NO: 10326 - protein, 336 aa, Zea mays
MAAEPKILELSNGKITARISNWGATITSLLVPDAQGSVADVVLGFDGLDPYVKGMSPYFGCIVGRVANRIKDGKFTLNGLEYSLPVNNGPNSLHGGLKGFDKVVWDVVEHKDGECPSITFQYHSKDGEEGYPGDVTIRATYSLPEATTLRLDMEATPENKATPISLAQHTYWNLAGHACGDILNHSLQIWGKHITPVDENTIPTGEIMPVDGTPFDFTTERRIGERIDGVPGGYDHNYVLDCGDEKDGLKRAARLKDPSSLRTLDLWTDAPGMQLYTANYVDGIGGKAGAVYAKHAGVCLETQGFPNAINQPEFPSVVVRPGEKYKHTMLFEFSGC

SEQ ID NO: 10327 - protein, 420 aa, Festuca arundinacea
  misc_feature (361)..(361): Xaa can be any naturally occurring amino acid
  misc_feature (406)..(406): Xaa can be any naturally occurring amino acid
MFGRSPKKSDNTKYYEILGVPKTAAQDDLKKAYRKAAIKNHPDKGGDPEKFKELAQAYEVLSDPEKREIYDQYGEDALKEGMGGGGGGGVDPFDIFSSFFGPSFGGGGGSSRGRRQRRGEDVVHPLKASLEDLYNGTSKKLSLSRSVLCSKCKGKGSKSGASMRCPGCQGSGMKVTIRQLGPSMIQQMQQPCNECRGTGESINEKDRCPGCKGEKVHQEKKVLEVHVEKGMQHNQKITFPGEADEAPDTVTGDIVFVVQQKEHPKFKRKGDDLFYEHTLSLTEALCGFQLVLTHLDNRQLLVKSNPGEVVKPDSFKAISDEGMPMYQRPFMKGKLYIHFTVDFPDSLAPDQCKALEAVLPXKPASKLTDMELDECEETTMHDVNNIEEEMRRKAQAAQEAYDEDDXMPGGGGQRVQCAQQ

SEQ ID NO: 10328 - protein, 213 aa, Unknown
  Sequence found in Organisms: Brassica napus, Brassica rapa
MMNRLFGKPKPETNALQTLDKLNETLEMLEKKEKVLLKKAGQEVEKAKEYTRAKNKRAAIQCLKRKRLYEQQVEQLGNFQLRIHDQMIMLEGAKATTETVDALRSGASAMKAMQKATNIDDVDKTMDEINEQTENMKQIQEALSTPIGAAADFDEDELEAELEELEGAELEEQLLQPTTVLPSVPAGRQQARPIPKRTAEEEELAALQAEMAL

SEQ ID NO: 10329 - protein, 213 aa, Brassica napus
MMNRLFGKPKPETNALQTLDKLNETLEMLEKKEKVLLKKAGQEVEKAKEYTRSKNKRAAIQCLKRKRLYEQQVEQLGNFQLRIHDQMIMLEGAKATTETVDALRSGASAMKAMQKATNIDDVDKTMDEINEQTENMKQIQEALSTPIGAAADFDEDELEAELEELEGAELEEQLLQPTTVLPSVPAGRQQARPIPKRTAEEEELAALQAEMAL

SEQ ID NO: 10330 - protein, 213 aa, Brassica oleracea
MMNRLFGKPKPETNALQTLDKLNETLEMLEKKEKVLLKKAGQEVEKAKEYTRSKNKRAAIQCLKRKRLYEQQVEQLGIFQLRIHDQMIMLEGAKATTETVDALRSGASAMKAMQKATNIDDVDKTMDEINEQTENMKQIQEALSTPIGAAAEFDEDELEAELEELEGAELEEQLLQPTTVLPSVPAGRQQARPIPKRTAEEEELAALQAEMAL

SEQ ID NO: 10331 - protein, 215 aa, Raphanus sativus
MMNRLFGKPKVENNALQTLDKLNETLEMLEKKEKVLLKKAGQEVEKAKEYTRAKNKRAAIQCLKRKRLYEQQVEQLGNFQLRIHDQMIMLEGAKATTETVDALRSGASAMKAMQKATNIDDVDKTMDEINEQTENMKQIQEALSTPIGAAADFDEDELEAELEELEGAELEEQLLQPTTVLPSVPVPAGRQAARPTPKRTAEEEELAALQAEMAL

SEQ ID NO: 10332 - protein, 215 aa, Eutrema parvulum
MMNRLFGKPKQETNALQTLDKLNETLEMLEKKEKVLLKKAGQEVEKAKEYTRAKNKRAAIQCLKRKRLYEQQVEQLGNFQLRIHDQMIMLEGAKATTETVDALRSGASAMKAMQKATNIDDVDKTMDEINEQTENMKQIQEALSTPIGAAADFDEDELEAELEELEGAELEEQLLQPTTTLPSVPVPSGRQTNRPAAKRTAEEEELAALQAEMAL

SEQ ID NO: 10333 - protein, 212 aa, Unknown
  Sequence found in Organisms: Brassica napus, Brassica juncea
MMNRLFGKPKHEGNALQTLDKLNETLEMLEKKEKVLLKKAGQEVEKAKEYTRAKNKRAAIQCLKRKRLYEQQVEQLGNFQLRIHDQMIMLEGAKATTETVDALRSGASAMKAMQKATNIDDVDKTMDEINEQTENMKQIQEALSTPIGAAADFDEDELEAELEELEGAELEEQLLQPTPMPSVPGRQPVRPAAPKRTAEEEELAALQAEMAL

SEQ ID NO: 10334 - protein, 212 aa, Brassica oleracea
MMNRLFGKPKHEGNALQTLDKLNETLEMLEKKEKVLLKKAGQEVEKAKEYTRAKNKRAAIQCLKRKRLYEQQVEQLGNFQLRIHDQMIMLEGAKATTETVEALRSGASAMKAMQKATNIDDVDKTMDEINEQTENMKQIQEALSTPIGAAADFDEDELEAELEELEGAELEEQLLQPTPMPSVPGRQPVRPAAPKRTAEEEELAALQAEMAL

SEQ ID NO: 10335 - protein, 212 aa, Unknown
  Sequence found in Organisms: Brassica napus, Brassica rapa
MMNRLFGKPKHEGNALQTLDKLNETLEMLEKKEKVLLKKAGQEVEKAKEYTRAKNKRSAIQCLKRKRLYEQQVEQLGNFQLRIHDQMIMLEGAKATTETVDALRSGASAMKAMQKATNIDDVDKTMDEINEQTENMKQIQEALSTPIGAAADFDEDELEAELEELEGAELEEQLLQPTPMPSVPGRQPVRPAAPKRTAEEEELAALQAEMAL

SEQ ID NO: 10336 - protein, 212 aa, Brassica napus
MMNRLFGKPKREGNALQTLDKLNETLEMLEKKEKVLLKKAGQEVEKAKEYTRAKNKRSAIQCLKRKRLYEQQVEQLGNFQLRIHDQMIMLEGAKATTETVDALRSGASAMKAMQKATNIDDVDKTMDEINEQTENMKQIQEALSTPIGAAADFDEDELEAELEELEGAELEEQLLQPTPMPSVPGRQPVRPAAPKRTAEEEELAALQAEMAL

SEQ ID NO: 10337 - protein, 212 aa, Raphanus sativus
MMNRLFGKPKHEGNALQTLDKLNETLEMLEKKEKVLLKKAGQEVEKAKEYTRSKNKRAAIQCLKRKRLYEQQVEQLGNFQLRIHDQMIMLEGAKATTETVDALRSGASAMKAMQKATNIDDVDKTMDEINEQTENMKQIQEALSTPIGAAADFDEDELEAELEELEGAELEEQLLQPTPMPSVPGRQPVRPVAPKRTAEEEELAALQAEMAL

SEQ ID NO: 10338 - protein, 218 aa, Eutrema halophilum
MMNRLFGKPKQESNALQTLDKLNETLEMLEKKEKVLLKKAGQEVEKAKEYTRAKNKRAAIQCLKRKRLYEQQVEQLGNFQLRIHDQMIMLEGAKATTETVDALRSGASAMKAMQKATNIDDVDKTMDEINEQTENMKQIQEALSTPIGAAADFDEDELEAELEELEGAELEEQLLQPTTTAPLPTVPMPAGRQQARPAAQKRTAEEEELAALQAEMAL

SEQ ID NO: 10339 - protein, 265 aa, Thellungiella halophila
  misc_feature (181)..(181): Xaa can be any naturally occurring amino acid
  misc_feature (184)..(184): Xaa can be any naturally occurring amino acid
MMNRLFGKPKQESNALQTLDKLNETLEMLEKKEKVLLKKAGQEVEKAKEYTRAKNKRAAIQCLKRKRLYEQQVEQLGNFQLRIHDQMIMLEGAKATTETVDALRSGASAMKAMQKATNIDDVDKTMDEINEQTENMKQIQEALSTPIGAAADFDEDELEAELEELEGAELEEQLLQPTTTXPLXTVPMPAGRHKPVPLLRSGPLRKKNSLLYRLRWPSKVTSTSLIYKQNTFVFKHKFFLLHLPLYVGNKNSHVSGNENSRFFLL

SEQ ID NO: 10340 - protein, 218 aa, Arabidopsis lyrata
MMNRLFGKPKQESNALQTLDKLNETLEMLEKKEKVLLKKAGQEVDKAKEFTRAKNKRAAIQCLKRKRLYEQQVEQLGNFQLRIHDQMIMLEGAKATTETVDALRSGASAMKAMQKATNIDDVDKTMDEINEQTENMKQIQEALATPIGAAADFDEADLEQELEDLESEELESQLLQPATTAPLPSVPVPAGRQPARPVPQKRTAEEEELAALQAEMAL

SEQ ID NO: 10341 - protein, 219 aa, Arabidopsis thaliana
MMNRLFGKPKQEANALQTLDKLNETLEMLEKKEKVLLKKAGAEVEKAKEYSRAKNKRAAIQCLKRKRLYEGQVEQLGNFQLRIHDQMIMLEGAKATTETVDALRSGASAMKAMQKATNIDDVDKTMDEINEQTENMKQIQEALATPMGAAADFDEDELAAELDELESEELESQLLQPATTAPPLPSVPVPAGRQPARPVPQKRTAEEEELAALQAEMAL

SEQ ID NO: 10342 - protein, 218 aa, Tropaeolum majus
MLNRLFGKPKQETNALATLDKLNETLEMLEKKEKVLLKKAGAEVEKAKDFSRAKNKRAAIQCLKRKRLYEQQIEQLGNFQLRIHDQMIMLEGAKATTETVDALRSGASAMKAMQKATNIDDVDKTMDEINEQTENMKQIQEALSTPIGAAADFDEDELEAELEELEGAELEEQLLQPATTAPAAPLQVPAGRQPARPAPQKRTAEEDELAALQAEMAL

SEQ ID NO: 10343 - protein, 218 aa, Euphorbia peplus
MFNRLFGKPKQETNALTTLDKLNETLEMLEKKEKVLIKKAAQEVEKAKEFTRAKNKRAAIQCLKRKRLYEQQIEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATTAPAAPVHVPAGRQPARPVPQKRTAEEDELAALQAEMAL

SEQ ID NO: 10344 - protein, 218 aa, Euphorbia peplus
MFNRLFGKPKQETNALTTLDKLNETLEMLEKKEKVLIKKAAAEVEKAREFTRSKNKRAAIQCLKRKRLYEQQIEQLGNFQLRIHDQMIMLEGAKATTETVDALRTGASAMKAMQKATNIDDVDKTMDEINEQTENMKQIQEALSTPIGAAADFDEDELEAELEELEGAELEEQLLQPATTAPAAPVHVPAGRQPTRPVPQKRTAEEDELAALQAEMAL

SEQ ID NO: 10345 - protein, 218 aa, Tripterygium wilfordii
MFNRLFGKPKQETNALTTLDKLNETLEMLEKKEKVLLKKAAAEVEKARDFTRLKNKRAAIQCLKRKRLYEQQIEQLGNFQLRIHDQMIMLEGAKATTETVDALRTGASAMKAMQKATNIDDVDKTMDEINEQTENMKQIQEALSTPIGAAADFDEDELEAELEELEGAELEEQLLQPVTTAPAAPVQVPAGRQPARPAPQKRTAEEDELAALQAEMAL

SEQ ID NO: 10346 - protein, 218 aa, Aristolochia fimbriata
MFQRIFGKPKQETNALATLDKLNETLEMLEKKEKVLLKKVAAEIEKAKEYTRAKNKRAAIQCLKRKRLYEQQVEQLGNFQLRIHDQMILLEGAKATTETVDALRTGASAMKAMQKATNIDDVDKTMDEINEQTENMKQIQEALSTPIGAAADFDEDELEAELEELEGAELEEQLLQPATTAPATVPYVPAGRQAARPAPQKTTPEEDELAALQAEMAL

SEQ ID NO: 10347 - protein, 218 aa, Solanum phureja
MFSRMFGKPKQETNALMTLDKLNETLEMLEKKEKVLQKKASTEVEKAKDFTRAKNKRAAIQCLKRKRLYEQQIEQLGNFQLRIHDQMIMLEGAKATTETVDALRTGASAMKAMQKATNIDDVDKTMDEINEQTENMKQIQEALATPIGAAADFDEDELEAELEELEGAELEEQLLQPATTALAAPVHVPAGKQPARPIPQKRTAEEDELAALQAEMAL

SEQ ID NO: 10348 - protein, 218 aa, Unknown
  Sequence found in Organisms: Cannabis sativa, Humulus lupulus
MLNRLFGKPKQETNALTTLDKLNETLEMLEKKEKVLLKKAGAEVERAKEFTRAKNKRAAIQCLKRKRLYEQQIEQLGNFQLRIHDQMIMLEGAKATTETVDALRTGAAAMKAMQKATNIDDVDKTMDEINEQTENMKQIQDALSAPFGAAADFDEDELEAELEELEGAELEEQLLQPATTAPAAPVHVPAGRQPARPVPQKRTAEEDELAALQAEMAL

SEQ ID NO: 10349 - protein, 218 aa, Euphorbia peplus
MFNRLFGKPKQETNALTTLDKLNETLEMLEKKEKVLIKKAGAEVEKAREFTRSKNKRAAIQCLKRKRLYEQQIEQLGNFQLRIHDQMIMLEGAKATTETVDALRTGASAMKAMQKATNIDDVDKTMDEINEQTENMKQIQEALSTPIGAAADFDEDELEAELEELEGAELEEQLLQPATTAPAAPVHVPAGRQPTRPVPQKRTAAQDELAALQAEMAL

SEQ ID NO: 10350 - protein, 218 aa, Cleome gynandra
MNRLFGKPKQESNALQTLDKLNETLEMLEKKEKVLLKKAASEVEKAKEFTRAKNKRAAIQCLKRKRLYEQQVEQLGNFQLRIHDQMIMLEGAKATTETVDALRSGASAMKAMQKATNIDDVDKTMDEINEQTENMKQIQEALSAPIGAAADFDEDELEAELEELEGAELEEQLLQPATTAPAAPVPVSAGRQPAHPAAQKQRTAEEDELAALQAEMAL

SEQ ID NO: 10351 - protein, 218 aa, Arachis hypogaea
MFGRMFGKPKQETNALTTLDKLNETLEMLEKKEKVLLKKVSAEVEKAKEFTRAKNKRAAIQCLKRKRLYEQQIEQLGNFQLRIHDQMIMLEGAKATTETVDALRSGASAMKAMQKATNIDDVDKTMDEINEQTENMKQIQEALSAPIGAAADFDEDELEAELEELEGAELEEQLLQPATTAPAAPVQVPAGRQPTRPVPAKRTQEEDELAALQAEMAL

SEQ ID NO: 10352 - protein, 219 aa, Unknown
  Sequence found in Organisms: Citrus sinensis, Citrus clementina, Citrus sinensis
MFTRLFGKPKQETNALTTLDKLNETLEMLEKKEKVLLKKASVEVEKAKDYSKAKNKRAAIQCLKRKRLYEQQIEQLGNFQLRIHDQMIMLEGAKATTETVDALRTGASTMKAMQKATNIDDVDKTMDEINEQTENMKQIQEALSTPIGAAADFDEDELEAELEELEGAELEEQLLQPATTAPAAPVQVPAGRQQARPVPQKQRTAEEDELAALQAEMAL

SEQ ID NO: 10353 - protein, 218 aa, Citrullus lanatus
MFNKLFGKPKQESNALATLDKLNETLEMLEKKEKVLLKKAATEVEKAKDYTRAKNKRAAIQCLKRKRLYEQQIEQLGNFQLRIHDQMILLEGAKATTETVDALRTGAAAMKAMQKATNIDDVDKTMDEINEQTENMKQIQEALSNPIGAAADFDEDELEAELEELEGAELEEQLLQPATTAPAAPIPVPAGRQTARPAPQKRTAEEDELAALQAEMAL

SEQ ID NO: 10354 - protein, 218 aa, Manihot esculenta
MFNRLFGKPKQETNALTTLDKLNETLEMLEKKEKVLVKKAAAEVEKAREFTRARNKRAAIQCLKRKRLYEQQIEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATTAPAAPVQVPAGRQPARPVPQRRTAEEDELAALQAEMAL

SEQ ID NO: 10355 - protein, 217 aa, Castanea mollissima
MFNRLFGKPKQETNALSTLDKLNETLEMLEKKEKVLLKKAAAEVEKAKEFTRAKNKRAAIQCLKRKRLYEQQIEQLGNFQLRIHDQMILLEGAKATTETVDALRTGASAMKAMQKATNIDDVDKTMDEINEQTENMKQIQEALSTPIGATADFDEDELEAELEELEGAELEEELLKPATTAPAAPVQVPAGPQRNRPTPKPTAEDDELAALQAEMAL

SEQ ID NO: 10356 - protein, 218 aa, Cucumis melo
MLNKLFGKPKQESNALATLDKLNETLEMLEKKEKVLLKKASTEVEKAKDYTRAKNKRAAIQCLKRKRLYEQQIEQLGNFQLRIHDQMILLEGAKATTETVDALRTGAAAMKAMQKATNIDDVDKTMDEINEQTENMKQIQEALSNPIGAAADFDEDELEAELEELEGAELEEQLLQPATTAPAAPIPVPAGRQTARPAPQKRTAEEDELAALQAEMAL

SEQ ID NO: 10357 - protein, 218 aa, Cirsium arvense
MFSRMFGKPKQETNAVTTLDKLNETLEMLEKKEKVLLKKAAAEVEKAKEFTRAKNKRAAIQCLKRKRLYEQQIEQLGNFQLRIHDQMIMLEGAKATTETVDALRTGAQAMKAMQKAVNIDDVDKTMDEINEQTENMKQIQEALSTPIGAAADFDEDELEAELEELEGAELEEQLLQPATTAPAAPVHVPAGRQPTRPPPRKNTAEEDELAALQAEMAL

SEQ ID NO: 10358 - protein, 218 aa, Cucurbita pepo
MLNRLFGKPKQEANALATLDKLNETLEMLEKKENVLIKKAAAEVEKAKEFTRVKNKRAAIQCLKRKRLYEQQVEQLGNFQLRIHDQMIMLEGAKATTETVDALRTGASAMKAMQKATNIDDVDKTMDEINEQTENMKQIQEALSTPIGAAADFDEDELEAELEELESAELEEQLLQPASTAPAGPVSVPSGRVPARPVPQKRTAEEDELAALQAEMAL

SEQ ID NO: 10359 - protein, 218 aa, Cucurbita pepo
MFNKLFGKPKQESNALATLDKLNETLEMLEKKENVLLKKAATEVEKAKDYTRAKNKRAAIQCLKRKRLYEQQIEQLGNFQLRIHDQMILLEGAKATTETVDALRTGAAAMKAMQKATNIDDVDKTMDEINEQTENMKQIQEALSNPIGAAADFDEDELEAELEELEGAELEEQLLQPATTAPVASIPVPAGRQTARPAPQKRTAEEDELAALQAEMAL

SEQ ID NO: 10360 - protein, 218 aa, Solanum lycopersicum
MFSRIFGKPKQETNALMTLDKLNETLEMLEKKEKVLQKKASTEVEKAKDFTRAKNKRAAIQCLKRKRLYEQQIEQLGNFQLRIHDQMIMLEGAKATTETVDALRTGASAMKAMQKATNIDDVDKTMDEINEQTENMKQIQEALATPIGAAADFDEDELEAELEELEGAELEEQLLQPATTAPAAPVHVPAGKQPARPIPQKRTAEEDELAALQAEMAL

SEQ ID NO: 10361 - protein, 218 aa, Aristolochia fimbriata
MFEKIFGKPKQETNALGTLDKLNETLEMLEKKEKVLLKKVAAEVEKAKEYTRAKNKRAAIQCLKRKRLYEQQVEQLGNFQLRIHDQMIMLEGAKATTETVDALRTGAAAMKAMQKATNIDDVDKTMDEINEQTENMKQIQEALSTPIGVAADFDEDELEAELEELEGAELEEQLLQPATTAPATVPYVPAGKQPIRAGPLKTTPEEDELAALQAEMAL

SEQ ID NO: 10362 - protein, 218 aa, Theobroma cacao
MFNRLFGKPKQETNALTTLDKLNETLEMLEKKEKVLVKKAAAEVEKAKEFAKGRNKRAAIQCLKRKRLYEQQIEQLGNFQLRIHDQMIMLEGAKATTETVDALRTGASAMKAMQKATNIDDVDKTMDEINEQTENMKQIQEALSAPIGAAADFDEDELEAELEELEGAELEEQLLQPATTAPAAPIQVPAGRQPARPVPQKRTAEEDELAALQAEMAL

SEQ ID NO: 10363 - protein, 218 aa, Ricinus communis
MFNRLFGKPKQETNALTTLDKLNETLEMLEKKEKVLSKKAIAEVERAKEFTRTKNKRAAIQCLKRKRLYEQQIEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATTAPAAPVQVPAGRQPNRPAAQKQTAEEDELAALQAEMAL

SEQ ID NO: 10364 - protein, 218 aa, Cichorium intybus
MFTRIFGKPKQEANAVATLDKLNETLEMLEKKEKVLLKKAAAEVEKAKEFTRAKNKRAAIQCLKRKRLYEQQIEQLGNFQLRIHDQMIMLEGAKATTETVDALRTGASAMKAMQKATNIDDVDKTMDEINEQTENMKQIQDALSAPIGAAADFDEDELEAELEELEGAELEEQLLQPTTTAPAAPVHAPASRQQVRPPPRKNTAEEDELAALQAEMAL

SEQ ID NO: 10365 - protein, 218 aa, Cucumis sativus
MFNKLFGKPKQESNALATLDKLNETLEMLEKKEKVLLKKASTEVEKAKDYTRAKNKRAAIQCLKRKRLYEQQIEQLGNFQLRIHDQMILLEGAKATTETVDALRTGAAAMKAMQKATNIDDVDKTMDEINEQTENMKQIQEALSNPIGAAADFDEDELEAELEELESAELEEQLLQPATTAPAAPIPVPAGRQTARPAPQKRTAEEDELAALQAEMAL

SEQ ID NO: 10366 - protein, 218 aa, Elaeis guineensis
MFGRIFGKPKEQTNALATLDKLNETLEMLEKKEKVLLKKVAAEVEKAKEFTRAKNKRAAIQCLKRKRLYEQQVEQLGNFQLRIHDQMIMLEGAKATTETVDALRTGAAAMKAMQKATNIDDVDKTMDEINEQTENMKQIQEALSAPIGAAADFDEDELEAELEELEGAELEEQLLQPATTAPAAPVHVPAGRQQVRPAPQKNTAEEDELAALQAEMAM

SEQ ID NO: 10367 - protein, 218 aa, Carica papaya
MFNRLFGKPKQETNALATLDKLNETLEMLEKKENVLLKKAATEVERAKEFSRAKNKRAAIQCLKRKRLYEQQIEQLGNFQLRIHDQMIMLEGAKATTETVDALRTGAAAMKAMQKATNIDDVDKTMDEINEQTENMKQIQEALSTPLGAAADFDEDELEAELEELEGAELEEQLLQPATTTPAAPVQVPSGKQPVRPAPQKRTAEEDELAALQAEMAL

SEQ ID NO: 10368 - protein, 218 aa, Solanum tuberosum
MFSRMFGKPKQETNALMTLDKLNETLEMLEKKEKVLQKKASTEVEKAKDFTRAKNKRAAIQCLKRKRLYEQQIEQLGNFQLRIHDQMIMLEGAKATTETVDALRTGASAMKAMQKATNIDDVDKTMDEINEQTENMKQIQEALATPIGAAADFDEDELEAELEELEGAELEEQLLQPATTAPAAPVHVPAGKQPARPIPQKRTAEEDELAALQAEMAL

SEQ ID NO: 10369 - protein, 214 aa, Euphorbia esula
MFNRLFGKPKQETNALTTLDKLNETLEMLEKKEKVLIKKAGAEVEKAREFTRSKNKRAAIQCLKRKRLYEQQIEQLGNFQLRIHDQMIMLEGAKATTETVDALRTGASAMKAMQKATNIDDVDKTMDEINEQTENMKQIQEALSTPIGAAADFDEDELEAELEELEGAELEEQLLQPATTAPAAPVHVPAGRQPTRPVPQKRTAEEDELAALQA

SEQ ID NO: 10370 - protein, 216 aa, Solanum melongena
MFGRIFGKPKQETNALATLDKLNETLDMLEKKEKVLLKKAAAEVEKAKEFTRAKNKRAAIQCLKRKRLYEQQIEQLGNFQLRIHDQMIMLEGAKATTETVDALRTGAAAMKAMQKATNIDDVDKTMDEINEQTENMKLIQEALSTPIGSAADFDEDELEAELEELEGAELEEQLLQPATTAPVAPISVPAGRQQVRPAAQKTEEDELAALQAEMAL

SEQ ID NO: 10371 - protein, 216 aa, Nicotiana tabacum
MFPRLFGKPKQETNALATLDKLNETLEMLEKKEKVLLKKAAGEVEKAKEFTRAKNKRAAIQCLKRKRLYEQQIEQLGNFQLRIHDQMIMLEGAKATTETVDALRTGAAAMKAMQKATNIDDVDKTMDEINEQTENMKLIQEALATPIGSAADFDEDELEAELEELEGAELEEQLLQPATTAPVAPINVPAGRQQVRPAAQKTEEDELAALQAEMAL

SEQ ID NO: 10372 - protein, 220 aa, Tabernaemontana elegans
MFTRIFGKPKQETNAVATLDKLNETLEMLEKKEKVLQKKASAEVEKAKEFTRAKNKRAAIQCLKRKRLYEQQIEQLGNFQLRIHDQMIMLEGAKATTETVDALRTGASAMKAMQKATNIDDVDKTMDEINEQTENMKQIQEALATPIGAAADFDEDELEAELEELEGAELEEQLLQPATTAPAAPVHVPAPAGRQQARPTPQRQTAEEDELAALQAEMAL

SEQ ID NO: 10373 - protein, 219 aa, Eucalyptus grandis
MFNRLFGKPKQETNALTTLDKLNETLEMLEKKEKVLIKKASQEVEKAKEFTRAKNKRAAIQCLKRKRLYEQQIEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATTAPAAPVHVPTGPGPRPARPVPQRTAEEDELAALQAEMAL

SEQ ID NO: 10374 - protein, 135 aa, Tragopogon dubius
MFTRIFGKPKQEANAVATLDKLNETLEMLEKKEKVLLKKAAAEVEKAKEFTRAKNKRAAIQCLKRKRLYEQQIEQLGNFQLRIHDQMIMLEGAKATTETVDALRTGASAMKAMQKATNIDDVDKTMDEINEQTET

SEQ ID NO: 10375 - protein, 216 aa, Solanum lycopersicum
MFTRMFGKPKQETNALATLDKLNETLEMLEKKEKVLLKKAAAEVEKAKEFTRAKNKRAAIQCLKRKRLYEQQIEQLGNFQLRIHDQMIMLEGAKATTETVDALRTGAAAMKAMQKATNIDDVDKTMDEINEQTENMKLIQEALSTPIGSAADFDEDELEAELEELEGAELEEQLLQPATTAPVAPINLPAGRQQVRPAAQKTEEDELAALQAEMAL

SEQ ID NO: 10376 - protein, 218 aa, Manihot esculenta
MFNRLFGKPKQETSALATLDKLNETLEMLEKKEKVLVKKAAAEVEKAREFTRTRNKKAAIQCLKRKRLYEQQIEQLGNFQLRIHDQMIMLEGAKATTETVDALRTGASAMKAMQKATNIDDVDKTMDEINEQTENMKQIQEALSTPIGAAADFDEDELEAELEELEGAELEEQLLQPATTAPAAPVQVPAGRQPARPVAQKRTAEEDELAALQAEMAL

SEQ ID NO: 10377 - protein, 218 aa, Gossypium hirsutum
MFNRLFGKPKQEINALTTLDKLNETLEMLEKKEKVLLKKAAAEVEKAKEFAKARNKRAAIQCLKRKRLYEQQIEQLGNFQLRVHDQMIMLEGAKATTETVDALRTGAAAMKAMQKATNIDDVDKTMDEINEQTENMKQIQEALSTPIGAAADFDEDELEAELEELEGAELEEQLLQPATTAPAAPIHVPAGRQPARPIPQKHTAEEDELAALQAEMAL

SEQ ID NO: 10378 - protein, 218 aa, Ipomoea nil
MFTRIFGKPKQETNALATLDKLNETLEMLEKKEKVLQKKAAAEVEKAKEFTRAKNKRAAIQCLKRKRLYEQQIEQLGNFQLRIHDQMIMLEGAKATTETVDALRTGAAAMKAMQKATNIDDVDKTMDEINEQTENMKQIQEALSTPIGAAADFDEDELEAELEELEEAELEEQLLQPATTAPAAPIHVPAGRQPERHAPRKNTAEEDELAALQAEMAL

SEQ ID NO: 10379 - protein, 218 aa, Lactuca sativa
MFARMFGKPKQEANAVTTLDKLNETLEMLEKKEKVLLKKAGAEVEKAKEFTRAKNKRAAIQCLKRKRLYEQQIEQLGNFQLRIHDQMIMLEGAKATTETVDALRTGAQAMKAMQKAVNIDDVDKTMDEINEQTENMKQIQEALSTPIGAAADFDEDELEAELEELEGAELEEQLLQPATTAPAAPLHVPAGRQSTRPPPRHNTAEEDELAALQAEMAL

SEQ ID NO: 10380 - protein, 218 aa, Lotus japonicus
MFTRIFGKPKQEANALTTLDKLNETLEMLEKKEKVLLKKASAEVEKAKEFTRAKNKRAAIQCLKRKRLYEQQIEQLGNFQLRIHDQMIMLEGAKATTETVDALRTGASAMKAMQKATNIDDVDKTMDEINEQTENMKQIQEALSAPIGAAADFDEDELEAELEELEGAELEEQLLQPATTAPAAPVHAPAGRQPTRPVTTKPTPEEDELAALQAEMAL

SEQ ID NO: 10381 - protein, 218 aa, Nicotiana benthamiana
MFSKIFGKPKQETNALATLDKLNETLEMLEKKEKVLQKKASAEVEKAKDFTRAKNKRAAIQCLKRKRLYEQQIEQLGNFQLRIHDQMIMLEGAKATTETVDALRTGASAMKAMQKATNIDDVDKTMDEINEQTENMKQIQEALATPIGAAADFDEDELEAELEELEGAELEEQLLQPATTAPAAPVHVPAGRQPARPIPQRRTAEEDELAALQAEMAL

SEQ ID NO: 10382 - protein, 216 aa, Solanum tuberosum
MFTRMFGKPKQETNALATLDKLNETLEMLEKKEKVLLKKAAAEVEKAKEFTRAKNKRAAIQCLKRKRLYEQQIEQLGNFQLRIHDQMIMLEGAKATTETVDALRTGAAAMKAMQKATNIDDVDKTMDEINEQTENMKLIQEALSTPIGSAADFDEDELEAELEELEGAELEEQLLQPATTAPNAPINLPAGRQQVRPAAQKTEEDELAALQAEMAL

SEQ ID NO: 10383 - protein, 218 aa, Prunus persica
MFTRLFGKPKQEGNALTTLDKLNETLEMLEKKEKVLQKKAAAEVERAKEFTRAKNKRAAIQCLKRKRLYEQQIEQLGNFQLRIHDQMIMLEGAKATTETVDALRTGAAAMKAMQKATNIDDVDKTMDEINEQTENMKQIQEALSAPIGAAADFDEDELEAELEELEGAELEEQLLQPATTAPAAPVQAPAGRQPTRPIPQKRTAEEDELAALQAEMAL

SEQ ID NO: 10384 - protein, 190 aa, Cucurbita pepo
MLEKKEKVLLKKASTEVEKAKDYTRAKNKRAAIQCLKRKRLYEQQIEQLGNFQLRIHDQMILLEGAKATTETVDALRTGAAAMKAMQKATNIDDVDKTMDEINEQTENMKQIQEALSNPIGASADFDEDELEAELEELEGAELEEQLLQPATTAPAAPIPVPAGRQTARPAPKRTAEEDELAALQAEMAL

SEQ ID NO: 10385 - protein, 216 aa, Vitis vinifera
MFTRLFGKPKQEANALTTLDKLNETLEMLEKKEGVLLKKAAAEVEKAKEFTRAKNKRAAIQCLKRKRLYEQQIEQLGNFQLRIHDQMILLEGAKATTETVDALRTGASAMKAMQKATNIDDVDKTMDEINEQTENMKQIQEALATPIGAAADFDEDELEAELEELEGAELEEQLLQPATTAPAAPIPAGRVPARPAPQRNTAEDDELAALQAEMAL

SEQ ID NO: 10386 - protein, 218 aa, Chelidonium majus
MFTRIFGKPKQETNALTTLDKLNETLEMLEKKEKVLIKKASGEVEKAKEFTRAKNKRAAIQCLKRKRLYEQQIEQLGNFQLRIHDQMIMLEGAKATTETVDALRTGAAAMKAMQKATNIDDVDKTMDEINEQTENMKQIQDALSAPIGAAADFDEDELEAELEELEGAELEEQLLQPATTTPAAPIYVPAGRQPTRPVAQKNTAEEDELAALQAEMAL

SEQ ID NO: 10387 - protein, 218 aa, Unknown
  Sequence found in Organisms: Centaurea maculosa, Cirsium arvense
MFSRMFGKPKQETNAVTTLDKLNETLEMLEKKEKVLLKKAAAEVEKAKEFTRAKNKRAAIQCLKRKRLYEQQIEQLGNFQLRIHDQMIMLEGAKATTETVDALRTGAQAMKAMQKAVNIDDVDKTMDEINEQTENMKQIQEALSAPIGAAADFDEDELEAELEELEGAELEEQLLQPATTAPAAPVHVPAGRLPTRPPPRKNTAEEDELAALQAEMAL

SEQ ID NO: 10388 - protein, 218 aa, Unknown
  Sequence found in Organisms: Cirsium arvense, Cynara scolymus
MFTRLFGKPKQEANAVTTLDKLNETLEMLEKKEKVLLKKAAAEVEKAKEFTRAKNKRAAIQCLKRKRLYEQQVEQLGNFQLRIHDQMIMLEGAKATTETVDALRTGAQAMKAMQKAVNIDDVDKTMDEINEQTENMKQIQEALSAPIGAAADFDEDELEAELEELEGAELEEQLLQPATTTPTTSVYAPAGKQPTRPAPRQNKAEEDELAALQAEMAL

SEQ ID NO: 10389 - protein, 218 aa, Euonymus alatus
MFNKLFGKPKQETSALATLDKLNETLEMLEKKESVLIKKAAAEVEKARDFTRSKNKRAAIQCLKRKRLYEQQIEQLGNFQLRLHDQMIMLEGAKATTETVDALRSGASAMKAMQKATNIDDVDKTMDEINEQTENMKQIQEALSNPIGAAADFDEDELEAELEELEGAELEEQLLQPATTAPAAPVQVPAGRQPARPAPQKRTAEEDELAALQAEMAL

SEQ ID NO: 10390 - protein, 218 aa, Aquilegia formosa
MFARVFGRPRQEANALTTLDKLNETLEMLEKKEKVLLKKASGEVERAKEFTRAKNKRAAIQCLKRKRLYEQQIEQLGNFQLRIHDQMIMLEGAKATTETVDALRTGAAAMKAMQKATNIDDVDKTMDEINEQTENMKQIQEALSTPIGSAADFDEDELEAELEELEGAELEEQLLQPATTAPAASVHVPAGRQPTRPLPQKRTAEEEEFAALQAEMAL

SEQ ID NO: 10391 - protein, 218 aa, Cichorium intybus
MFARMFGKPKQETNAVTTLDKLNETLEMLEKKEKVLLKKAAAEVEKAKEFTRAKNKRAAIQCLKRKRLYEQQIEQLGNFQLRIHDQMIMLEGAKATTETVDALRTGAQAMKAMQKAVNIDDVDKTMDEINEQTENMKQIQEALSAPIGAAADFDEDELEAELEELEGAELEEQLLQPATTAPAAPLHVPAGRQSTRPAPRQNTAEEDELAALQAEMAL

SEQ ID NO: 10392 - protein, 218 aa, Vigna unguiculata
MFTRIFGKPKQEANTLTTLDKLNETLEMLEKKEKVLLKKAAAEVERAKEFTRAKNKRAAIQCLKRKRLYEQQIEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATTAPAAPVHVPAGRQPTRPASSKPTAEEDELAALQAEMAL

SEQ ID NO: 10393 - protein, 218 aa, Vitis vinifera
MFTRIFGKPKQEANALTTLDKLNETLEMLEKKEKVLLKKAAAEVEKAKEFTRAKNKRAAIQCLKRKRLYEQQIEQLGNFQLRIHDQMIMLEGAKATTETVDALRTGAAAMKAMQKATNIDDVDQTMDEINEQTENMKQIQEALSTPIGSAADFDEDELEAELEELEGFELEEQLLQPATTAPAAPVHVPAGRQPARAAPQKRTAEEDELAALQAEMAL

SEQ ID NO: 10394 - protein, 218 aa, Hevea brasiliensis
MFTRLFGKPKQETNALTTLDKLNETLEMLEKKEKVLVKKAAAEVEKAREFTRARNKRAAIQCLKRKKLYEQQIEQLGNFQLRIHDQMIMLEGAKATTETVDALRTGAAAMKAMQKATNIDDVDMTMDEINEQTENMKQIQEALSTPIGAAADFDEDELEAELEELEGAELEEQLLQPATTAPAATVQVPAGRQPARPLPQRHTAEEDELAALQAEMAL

SEQ ID NO: 10395 - protein, 218 aa, Ipomoea batatas
MFTRIFGKPKQETNALATLDKLNETLEMLEKKEKVLQKKAAAEVERAKEFTRAKNKRAAIQCLKRKRLYEQQIEQLGNFQLRIHDQMIMLEGAKATTETVDALRTGAAAMKAMQKATNIDDVDKTMDEINEQTENMKQIQEALSTPIGAAADFDEDELEAELEELEEAELEEQLLQPATTAPAAPIHVPAGRQPERHAPRKNTAEEDELAALQAEMAL

SEQ ID NO: 10396 - protein, 218 aa, Momordica charantia
MFNKLFGKPKQESTALATLDKLNETLEMLEKKEKVLLKKAATEVEKAKDYTRAKNKRAAIQCLKRKRLYEQQIEQLGNFQLRIHDQMILLEGAKATTETVDALRTGAAAMKAMQKATNIDDVDKTMDEINEQTENMKQIQEALSNPIGASADFDEDELEAELEELEGAELEEQLLQPATTAPAAPIPVPAGKQPARPAPQKRTAEEDELAALQAEMAL

SEQ ID NO: 10397 - protein, 218 aa, Cajanus cajan
MFTRIFGKPKQEANTLTTLDKLNETLEMLEKKEKVLLKKAAAEVERAKEFTRAKNKRAAIQCLKRKRLYEQQIEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATTAPAAPVHVPAGRQPTRPVSSKPTAEEDELAALQAEMAL

SEQ ID NO: 10398 - protein, 212 aa, Populus trichocarpa
MFNRLFGKPKQETNALTTLDKLNETLEMLEKKEKVLLKKAAAEVEKAKEFTRGKNKRAAIQCLKRKRLYEQQIEQLGNFQLRIHDQMIMLEGAKATTETVDALRTGAAAMKAMQKATNIDDVDKTMDEINENMKQIQEALSTPIGAAADFDEDELEAELEELEGAELEEQLLQPATTAPAAPVQVPAGKKPVPQKRTAEEEELANLQAEMAL

SEQ ID NO: 10399 - protein, 218 aa, Nicotiana tabacum
MFSKIFGKPKQETNALATLDKLNETLEMLEKKEKVLQKKASAEVEKAKDFTRAKNKRAAIQCLKRKRLYEQQIEQLGNFQLRIHDQMIMLEGAKATTETVDALRTGASAMKAMQKATNIDDVDKTMDEINEQTENMKQIQEALATPIGAAADFDEDELEAELEELEGAELEEQLLQPATTAPAAPVHVPAVRQPARPIPQRRTAEEDELAALQAEMAL

SEQ ID NO: 10400 - protein, 218 aa, Solanum lycopersicum
MFKRLLGKPKQETNALATLDKLNETLEMLEKKESVLLKKATAEVERAKEFTRAKNKRAAIQCLKRKRLYEQQVEQLGNFQLRIHDQMILLEGAKATTETVDALRTGAAAMKAMQKATNIDDVDKTMDEINEQTENMKMIQEALSTPIGAAADFDEDELEAELEELEGAELEEQLLQPATAAPSAPIHMPAGRQQVRPAAQHSRTEEDELAALQAEMAL

SEQ ID NO: 10401 - protein, 215 aa, Taraxacum officinale
MFARMFGKPKQEANTVTTLDKLNETLEMLEKKEKVLLKKASAEVEKAKEFTRAKNKRAAIQCLKRKRLYEQQVEQLGNFQLRIHDQMIMLEGAKATTETVDALRTGAQAMKAMQKAVNIDDVDKTMDEINEQTENMKQIQEALSAPIGAAADFDEDELEAELEELEGAELEEQLLQPATTAPAAPFRVPAGRQSTRPPPTAEEDELAALQAEMAL

SEQ ID NO: 10402 - protein, 217 aa, Actinidia deliciosa
MFTKLFGKPKQEANALTTIDKLNETLEMLEKKEKVLQKKASAEVEKAKEFTKAKNKRAAIQCLKRKRLYEQQIEQLGNFQLRIHDQMIMLEGAKATTETVDALRTGASAMKAMQKATNIDDVDKTMDEINEQTENMKQIQEALATPIGAAADFDEDELEAELEELEGAELEEQLLQPATTAPAAPVQVPAGRLPARVAPKRTAEEDELAALQAEMAL

SEQ ID NO: 10403 - protein, 217 aa, Quercus alba
MLNRLFGKSKQETNALSTLDKLNETLEMLEKKEKVLLKKAAAEVERAKEFTRAKNKRAAIQCLKRKRLYEQQIEQLGNFQLRIHDQMILLEGAKATTETVDALRTGAAAMKAMQKATNIDDVDKTMDEINEQTENMKQIQEALSTPIGASADFDEDELEAELEELEGAELEEELLKPATTAPAAPVQVPAGPQRNRPTPKPTAEDDELAALQAEMAL

SEQ ID NO: 10404 - protein, 212 aa, Brassica juncea
MMNRLFGKPKHEGNALQTLDKLNETLEMLEKKEKVLLKKAGQEVEKAKEYTRAKNKRAAIQCLKRKRLYEQQVEQLGNFQLRIHDQMIMLEGAKATTETVDALRTGAATMKAMQKATNIDDVDKTMDEINEQTDNMKQIQDALSAPFGSAADFDEDELEAELEELEGLELEDQLLQPARPVPEGKQPARPLPQKQQSAHEDELAALQAEMAL

SEQ ID NO: 10405 - protein, 213 aa, Zostera marina
MFGRIFGKPKQETNALTTLDKLNETLEMLEKKEHVLLKKAGVEVERAKEFTRAKNKRAAIQCLKRKRLYEQQVEQLGNFQLRIHDQMIMLEGAKATTETVDALRTGAAAMKAMQKATNIDDVDKTMDDINEQTENMKQIQEALSTPIGAASDFDEDELEAELEELEGAELEEQLLEPPIVVPRPSVPQPTRPTPQKNTAEEDEFAALQAEMAL

SEQ ID NO: 10406 - protein, 220 aa, Catharanthus roseus
MFTRIFGKPKQESNAVATLDKLNETLEMLEKKEKVLQKKASAEVEKAKEFTRAKNKRAAIQCLKRKRLYEQQIEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATTAPAAPVHVPAPAGRQQARPAPQKQTAEEDELAALQAEMAL

SEQ ID NO: 10407 - protein, 220 aa, Euonymus alatus
MSVFNRLFGKPKQETNALTTLDKLNETLEMLEKKEKVLLKKAAAEVEKARDFTRSKNKRAAIQCLKRKRLYEQQIEQLGNFQLRLHDQMIMLEGAKATTETVDALRTGASTMKAMQKATNIDDVDQTMDEINEQTENMKQIQEALSTPIGAAADFDEDELEAELEELEGAELEEQLLQPATTAPAAPVQVPAGRQPARPAPQKRTAEEDELAALQAEMAL

SEQ ID NO: 10408 - protein, 220 aa, Cleome spinosa
MFVNRLFGKPKQESNALQTLDKLNETLEMLEKKENVLLKKASAEVEKAKEFTRAKNKRAAIQCLKRKRLYEQQVEQLGNFQLRIHDQMIMLEGAKATTETVDALRSGAAAMKAMQKATNIDDVDKTMDEINEQTENMKQIQDALSAPIGAAADFDEDELEAELEELEGAELEEQLLQPATMAPTATVPMPAGRQPARPAAQKQRTAEEDELAALRAEMAL

SEQ ID NO: 10409 - protein, 220 aa, Coffea canephora
MFTRIFGKPKQETNAVTTLDKLNETLEMLEKKEKVLQKKASAEVEKAKEFTRAKNKRAAIQCLKRKRLYEQQIEQLGNFQLRIHDQMIMLEGAKATTETVDALRTGASAMKAMQKATNIDDVDKTMDEINEQTENMKQIQEALATPIGAAADFDEDELEAELEELEGAELEEQLLQPAINTPAAPVHAPTPAGRQPARPAPQKQSAEEDELAALQAEMAL

SEQ ID NO: 10410 - protein, 192 aa, Gossypium hirsutum
MLEKKEKVLLKKASAEVEKAKEFTKAKNKRAAIQCLKRKRLYEQQIEQLGNFQLRIHDQMIMLEGAKATTETVDALRSGASAMKAMQKATNIDDVDKTMDEINEQTENMKQIQEALSTPIGAAADFDEDELEAELEELEGAELEEQLLQPATTAPAPAATVQAPAGRQPAHNAPKRTAEEDELAALQAEMAL

SEQ ID NO: 10411 - protein, 191 aa, Ambrosia trifida
MLEKKEKVLLKKASAEVEKAKEYTKAHNKRAAIQCLKRKKLYEQQVEQLGNFQLRIHDQMIMLEGAKATTETVDALRTGAAAMKAMQKATNIDDVDKTMDEINEQTENMKQIQEALATPLGAAADFDEDELEAELEELEGAELEEQLLQPATTAPAAPVHVPAGRQQTRPAPRQNKAEEDELAALQAEMAL

SEQ ID NO: 10412 - protein, 218 aa, Ambrosia trifida
MFSRVFGKPKQETNAVTTLDKLNETLEMLEKKEKVLLKKASAEVEKAKEYTKAHNKRAAIQCLKRKKLYEQQVEQLGNFQLRIHDQMIMLEGAKATTETVDALRTGAAAMKAMQKATNIDDVDKTMDEINEQTENMKQIQEALATPLGAAADFDEDELEAELEELEGAELEEQLLQPATTAPAAPVHVPAGRQQTRPPPRQNKAEEDELAALQAEMAL

SEQ ID NO: 10413 - protein, 218 aa, Chelidonium majus
MFSRMFGKPKQETNALTTLDKLNETLEMLEKKEKVLIKKASAEVEKAKEFTRAKNKRAAIQCLKRKRLYEQQVEQLGNFQLRIHDQMIMLEGAKATTETVDALRTGAAAMKAMQKATNIDDVDKTMDEINEQTENMKQIQDALSAPIGAAADFDEDELEAELEELEGAELEEQLLQPATTTPAAPVHVSAGRQPTRPAPQKNKAEEDELAALEAEMAL

SEQ ID NO: 10414 - protein, 132 aa, Tripterygium wilfordii
MILLEGAKATTETVDALRTGAAAMKAMQKATNIDDVDKTMDEINEQTENMKQIQEALSTPIGAAADFDEDELEAELEELEGAELEEQLLQPATTAPAAPVHVPAGRQPARPAPQKRTAEEDELAALQAEMAL

SEQ ID NO: 10415 - protein, 218 aa, Phaseolus coccineus
MFTRIFGKPKQEANTLTTLDKLNETLEMLEKKEKVLLKKAAAEVERAKDFTRAKNKRAAIQCLKRKRLYEQQIEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATTAPAAPVHVPAGRQPTRPASSKPTAEEDELAALQAEMAL

SEQ ID NO: 10416 - protein, 218 aa, Gossypium hirsutum
MFNRLFGKPKQEANALTTLDKLNETLEMLEKKEKVLVKKAAAEVEKAKEFAKGRNKRAAIQCLKRKRLYEQQIEQLGNFQLRIHDQMIMLEGAKATTETVDALRTGAAAMKAMQKATNIDDVDKTMDEINEQTENMKQIQEALSTPLGAAADFDEDEFEAELEELEGAELEEQLLQPATTAPAAPVQVPAGRQPARPIPQKRTAEEDELAALQAEMAL

SEQ ID NO: 10417 - protein, 218 aa, Cynara scolymus
  misc_feature (167)..(167): Xaa can be any naturally occurring amino acid
  misc_feature (177)..(177): Xaa can be any naturally occurring amino acid
MFSRMFGKPKQETNAVTTLDKLNETLEMLEKKEKVLLKKAAAEVEKAKEFTRAKNKRAAIQCLKRKRLYEQQIEQLGNFQLRIHDQMIMLEGAKATTETVDALRTGAQAMKAMQKAVNIDDVDKTMDEINEQTENMKQIQEALSAPIGAAADFDEDELEAELEELEXAELEEQLLQXATTAPAAPVHVPAGRQPTRPAPRKNTAEEDELAALQAEMAL

SEQ ID NO: 10418 - protein, 217 aa, Zingiber officinale
  misc_feature (193)..(193): Xaa can be any naturally occurring amino acid
  misc_feature (197)..(197): Xaa can be any naturally occurring amino acid
MFTRLFGKPKEQTNTLATLDKLNETLEMLEKKEKVLLKKVDAEVEKAKEYTRAKNKRAAIQCLKRKRLYEQQVEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATTAPAAPVHAPAGRXARPXAQKNTAEEDELAALQAEMAM

SEQ ID NO: 10419 - protein, 218 aa, Lactuca sativa
MFTRIFGKPKQEANAVATLDRLNETLEMLEKKEKVLLKKAAAEVEKAKEFTRAKNKRAAIQCLKRKRLYEQQIEQLGNFQLRIHDQMIMLEGAKATTETVDALRTGASAMKAMQKSTNIDDVDKTMDEINEQTENMKQIQEALSAPIGAAADFDEDELEAELEELEGAELEEQLLQPATTAPAAPVHTPAGRQHARPPPQKNTAEEDELAALQAEMAL

SEQ ID NO: 10420 - protein, 218 aa, Solanum phureja
MFKRLLGKPKQETNALATLDKLNETLEMLEKKESVLLKKATAEVERAKEFTRAKNKRAAIQCLKRKRLYEQQVEQLGNFQLRIHDQMILLEGAKATTETVDALRTGAAAMKAMQKATNIDDVDKTMDEINEQTENMKMIQEALSTPIGAAADFDEDELEAELEELEGAELEEQLLQPATTAPSAPIHLPAGRQQVRPAAQHSRTEEDELAALQAEMAL

SEQ ID NO: 10421 - protein, 218 aa, Nicotiana tabacum
  misc_feature (40)..(40): Xaa can be any naturally occurring amino acid
MFTKIFGKPKQETNALATLDKLNETLEMLEKKEKVLLKKXAAEVEKAKEFTRAKNKRAAIQCLKRKRLYEQQVEQLGNFQLRIHDQMILLEGAKATTETVDALRTGAAAMKAMQKATNIDDVDKTMDEINEQTENMKMIQEALSTPIGAAADFDEDELEAELEELEGAELEEQLLQPAATAPSAPIHLPAGRQQVRPAAQQNKAEEDELAALQAEMAL

SEQ ID NO: 10422 - protein, 69 aa, Ambrosia trifida
MFSRVFGKPKQETNAVTTLDKLNETLEMLEKKEKVLLKKASAEVEKAKEYTKAHNKKDGNTMFEEEEAV

SEQ ID NO: 10423 - protein, 217 aa, Amorphophallus konjac
MFSRLFGKPKEEANALTTLDKLNETLEMLEKKEKVLLKKVAAEVEKAKEFTRAKNKRAAIQCLKRKKLYEQQVEQLGNFQLRIHDQMIMLEGAKATTETVDALRTGAAAMKAMQKATNIDDVDKTMDEINEQTENMKQIQEALSAPIGTAADFDEDELEAELEELEGAELEEQLLQPATTAPAAPVQVPSGRQPVRPPPQKTAEDDELAALQAEMAL

SEQ ID NO: 10424 - protein, 217 aa, Aquilegia formosa
MFTRIFGKPKQDTNALTTLDKLNETLEMLEKKEKVLLKKASGEVEKAKEFTRAKNKRAAIQCLKRKRLYEQQIEQLGNFQLRIHDQMIMLEGAKATTDTVDALRTGAAAMKAMQKAVNIDDVDKTMDEINEQTENMKQIQEALSTPIGSAADFDEDDLEAELEELEEAELEEQLLQPATTAPSASVHVPAGRQPTRLPQKRTAEEEEFAALQAEMAL

SEQ ID NO: 10425 - protein, 220 aa, Amsonia hubrichtii
MFTRIFGKPKQESNAVATLDKLNETLEMLEKKEKVLQKKASAEVEKAKEFTRAKNKRAAIQCLKRKRLYEQQIEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATTAPAAPVHVPASAGRQQARPAPQKQTDEEDELAALQAEMAL

SEQ ID NO: 10426 - protein, 220 aa, Vinca minor
MFTRIFGKPKQETNAVATLDKLNETLEMLEKKEKVLQKKASAEVEKAKEFTRAKNKRAAIQCLKRKRLYEQQIEQLGNFQLRIHDQMIMLEGAKATTETVDALRTGAAAMKAMQKATNIDDVDQTMDEINEQTENMKQIQEALSTPIGAAADFDEDELEAELEELEGAELEEQLLQPATTAPAAPVHVPAAAGRQQARPAPQKQSAEEDELAALQAEMAL

SEQ ID NO: 10427 - protein, 220 aa, Vinca minor
MFTRIFGKPKQESNAVATLDKLNETLEMLEKKEKVLQKKASGEVEKAKEFTRAKNKRAAIQCLKRKRLYEQQIEQLGNFQLRIHDQMIMLEGAKATTETVDALRTGAAAMKSMQKATNIDDVDKTMDEINEQTENMKQIQEALSTPIGAAADFDEDELEAELEELEGAELEEQLLQPTTTAPAAPIHVPAAAGRQQARPAPQKQSAEEDELAALQAEMAL

SEQ ID NO: 10428 - protein, 220 aa, Medicago truncatula
MFTRVFGKPKQDTSSNALATLDKLNETLEMLEKKENVLLKKAAAEVEKAKEYTKRKNKKAAIQCLKRKRLYEQQVEQLGNFQLRIHDQMIMLEGAKATTETVDALRTGAATMKAMQKATNIDDVDKTMDEINEQTENMKQIQEALSAPIGAAADFDEDELEAELEELESAELEEQLLQPTFTAPAPSMQVPAGRQPARPAPAKPTPEEDELAALQAEMAL

SEQ ID NO: 10429 - protein, 192 aa, Gossypium hirsutum
MLEKKEKVLLKKASAEVEKAKEFTKAKNKRAAIQCLKRKRLYEQQIEQLGNFQLRIHDQMIMLEAAKATTETVDALRSGASAMKAMQKATNIDDVDKTMDEINEQTENMKQIQEALSTPIGAAADFDEDELEAELEELEGAELEEQLLQPATTAPAPAAAVQAPAGRQPAHNAPKRTAEEDELAALQAEMAL

SEQ ID NO: 10430 - protein, 191 aa, Lotus japonicus
MLEKKEKVLIKKASQEVEKAKDFTKAKNKRAAIQCLKRKRLYEQQIEQLGNFQLRIHDQMIMLEGAKATTETVDALRTGASAMKAMQKATNIDDVDKTMDEINEQTENMKQIQEALSAPIGAAADFDEDELEAELEELEGAELEEQLLQPATTAPAASVHVPAGRQPTRPVSAKTTPEEDELAALQAEMAL

SEQ ID NO: 10431 - protein, 218 aa, Arnica chamissonis
MFSRMFGKPKQESNTVTTLDKLNETLEMLEKKEKVLLKKAAAEVEKAKEFTRAKNKRAAIQCLKRKRLYEQQIEQLGNFQLRIHDQMIMLEGAKATTETVDALRTGAQAMKAMQKAVNIDDVDKTMDEINEQTENMKQIQEALSTPIGAAADFDEDELEAELEELEGAELEEQLLQPATTAPAAPVHVPAGKQPTRPAPRQNTAEEDELAALQAEMAL

SEQ ID NO: 10432 - protein, 218 aa, Cirsium arvense
MLKRILGKPKQEANAVTTIEKLNETLEMLEKKEKVLLKKSAAEVEKAKEFTRAKNKRAAIQCLKRKRLYEQQIEQLGNFQLRIHDQMIMLEGAKATTETVDALRTGASAMKAMQKATNIDDVDKTMDEINEQTENMKQIQEALATPIGAAADFDEDELEAELEELEGAELEEQLLQPATTAPVAPIHAPAGRQQVRPPPRKNTSEEDELAALQAEMAL

SEQ ID NO: 10433 - protein, 218 aa, Unknown
  Sequence found in Organisms: Centaurea maculosa, Cirsium arvense
MFTRLFGKPKQEANAVTTLDKLNETLEMLEKKEKVLLKKAAAEVERAKEFTRAKNKRAAIQCLKRKRLYEQQVEQLGNFQLRIHDQMIMIEGAKATTETVDALRTGAQAMKAMQKAVNIDDVDKTMDEINEQTENMKQIQEALSAPIGAAADFDEDELEAELEELEGAELEEQLLQPATTTPTTSVYAPAGKQPTRPAPRQNKAEEDELAALQAEMAL

SEQ ID NO: 10434 - protein, 218 aa, Cirsium arvense
MLKRILGKPKQEANAVTTIEKLSETLEMLEKKEKVLLKKSAAEVEKAKEYTRAKNKRAAIQCLKRKRLYEQQIEQLGNFQLRIHDQMIMLEGAKATTETVDALRTGASAMKAMQKATNIDDVDKTMDEINEQTENMKQIQEALATPIGAAADFDEDELEAELEELEGAELEEQLLQPATTAPAAPVHAPAGRQQVRPPPRKNTSEEDELAALQAEMAL

SEQ ID NO: 10435 - protein, 214 aa, Lippia dulcis
MFTRIFGKPKQETNALATLDKLNETLEMLEKKEKVLLKKASAEVEKAKEFTRAKNKRAAIQCLKRKRLYEQQVEQLGNFQLRIHDQMIMLEGAKATTETVDALRTGAAAMKAMQKATNIDDVDKTMDEINEQTENMKMIQEALSTPIGAAADFDEDELEAELEELEGAELEEQLLQPATTAPAAPVRVPAGRQPAKKVEDEDDELAELQREMAL

SEQ ID NO: 10436 - protein, 218 aa, Vigna unguiculata
MFSRMFGKPKQETNAVATLDKLNETLEMLEKKEKVLLKKVGAEVEKAKEFTRGKNKRAAIQCLKRKRLYEQQIEQLGNFQLRIHDQMIMLEGAKATTETVDALRTGAAAMKAMQKATNIDDVDKTMDEINEQTENMKQIQDALSAPIGAAADFDEDELEAELEELEGAELEEQLLQPATTTPAAPVQVPAGRQPTRPVASKPTPEEDELAALQAEMAL

SEQ ID NO: 10437 - protein, 218 aa, Cynara scolymus
  misc_feature (209)..(209): Xaa can be any naturally occurring amino acid
MFTRVFGKPKQEANAVTTLDKLNETLEMLEKKEKVLLKKASAEVEKAKDYTRAKNKRAAIQCLKRKKLYEQQIEQLGNFQLRIHDQMIMLEGAKATTETVDALRTGAAAMKAMQKATNIDDVDKTMDEINEQTENMKQIQEALATPIGAAADFDEDELEAELEELEGAELEEQLLQPATTAPAAPVQVPAGRQPTRPAPRQNTAEEDEXAALQAEMAL

SEQ ID NO: 10438 - protein, 218 aa, Cajanus cajan
MFSRVFGKPKQETNAVATLDKLNETLEMLEKKEKVLLKKVSTEVEKAKEFTRGKNKRAAIQCLKRKRLYEQQIEQLGNFQLRIHDQMIMLEGAKATTETVDALRTGAAAMKAMQKATNIDDVDKTMDEINEQTENMKQIQDALSAPIGAAADFDEDELEAELEELEGAELEEQLLQPATTAPAAPVQVPAGRQPTRPVTAKPTPEEDELAALQAEMAL

SEQ ID NO: 10439 - protein, 215 aa, Populus trichocarpa
MFNRLFGKPKLESSALTSLDKLNETLEMLEKKEKVLVKKAAAEVEKAKEFTRGKNKRAAIQCLKRKRLYEQQIEQLGNFQLRIHDQMIMLEGAKATTETVDALRTGASAMKAMQKATNIDDVDKTMDEINEQTENMKQIQEALSTPIGSAADFDEDELEAELEELEGAELEEQLLQPATTAPAAPVHVPAGKKPAPKKRTAEEEELADLQAEMAL

SEQ ID NO: 10440 - protein, 218 aa, Carthamus tinctorius
  misc_feature (93)..(93): Xaa can be any naturally occurring amino acid
MFSRMFGKPKQETNAVTTLDKLNETLEMLEKKEKVLLKKAAAEVEKAKEFTRAKNKRAAIQCLKRKRLYEQQIEQLGNFQLRIHDQMIMLEGXKATTETVDALRTGAQAMKAMQKAVNIDDVDKTMDEINEQTENMKQIQEALSAPIGAAADFDEDELEAELQELEGAELEEQLLQPATTAPAAPVHVPAGRLPTRPPPRKNTAEEDELAALQAEMAL

SEQ ID NO: 10441 - protein, 218 aa, Glycine max
MFSRMFGKPKQETNAVATLDKLNETLEMLEKKEKVLLKKVAAEVEKAKEFTRGKNKRAAIQCLKRKRLYEQQIEQLGNFQLRIHDQMIMLEGAKATTETVDALRTGAAAMKAMQKATNIDDVDKTMDEINEQTENMKQIQDALSAPIGAAADFDEDELEAELEELEGAELEEQLLQPATTAPAAPVQVPAGQQPTRPVPAKRTPEEDELAALQAEMAL

SEQ ID NO: 10442 - protein, 218 aa, Glycine max
MFTRIFGKPKQEANTLTTLDKLNETLEMLEKKEKVLLKKAAAEVEKAKEFTRAKNKRAAIQCLKRKRLYEQHVEQLGNFQLRIHDQMIMLEGAKATTETVDALRTGAAAMRAMQKATNIDDVDKTMDEINEQTENMRQIQEALSTPIGAAADFDEDELEAELEELEGAELEEQLLQPATTAPAAPVHVPAGRQPTHPVSSKLTAEEDELAALQAEMAL

SEQ ID NO: 10443 - protein, 218 aa, Fragaria vesca
MFTRIFGKPKTETSALTTLDKLNETLEMLEKKEKVLQKKAAAEVERAKEFTRAKNKRSAIQCLKRKKLYEQQIEQLGNFQLRIHDQMIMLEGAKATTETVDALRTGAAAMKAMQKATNIDDVDKTMDEINEQTENMKQIQEALSTPIGSAADFDEDELEAELEELEGAELEEQLLQPATQAPAAPVQVPAGRQPARPLPQKRTAEEDELAALQAEMAL

SEQ ID NO: 10444 - protein, 218 aa, Helianthus annuus
MFSRMFGKPKPEATTVTTLDKLNETLEMLEKKEKVLLKKAAAEVEKAKEFTRAKNKRAAIQCLKRKRLYEQQVEQLGNFQLRIHDQMIMLEGAKATTETVDALRTGAKAMKAMQKAVNIDDVDKTMDEINEQTENMKQIQEALSAPIGAAADFDEDELEAELEELEGAELEEQLLQPATTAPAAPVYVPAGRQQTRPAPRQNTAEEDELAALQAEMAL

SEQ ID NO: 10445 - protein, 218 aa, Cirsium arvense
MFTRVFGKPKQEANAVTTLDKLNETLEMLEKKEKVLLKKASAEVEKAKDYTRAKNKRAAIQCLKRKKLYEQQIEQLGNFQLRVHDQMIMLEGAKATTETVDALRTGAAAMKAMQKATNIDDVDKTMDEINEQTENMKQIQEALATPIGAAADFDEDELEAELEELEGAELEEQLLQPATTAPAAPVQAPAGRQPTRPAPRQNTAEEDELAALQAEMAL

SEQ ID NO: 10446 - protein, 219 aa, Phalaenopsis aphrodite
MFSRLFGKPKEQTNALATLDKLNETIEMLEKKEKVLLKKAAAEVEKAKEFTRAKNKRAAIQCLKRKKLYEQQIEQLGNFQLRIHDQMIMLEGAKATTETVDALRTGASAMKAMQKATNIDDVDKTMDEINEQTENMKQIQEALSAPIGSAADFDEDELEAELEELEGAELEAELLTPATTAPAAPLPNVPSGKQPLRPAPHKNTAEEDELAALQAEMAL

SEQ ID NO: 10447 - protein, 218 aa, Primula obconica
MFSRVFGKPKQETSAVATLDKLNETLEMLEKKEKVLQKKASQEIEKAKDFTKAKNKRAAIQCLKRKRLYEQQIEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATMAPAAPVHVPGGRVPARAAPQKRTAEEDELAALQAEMAL

SEQ ID NO: 10448 - protein, 218 aa, Sarracenia psittacina
MFGRIFGKPKQEANTLTTLDKLNETLEMLEKKEKVLLKKAAAEVEKAKEFTKAKNKRAAIQCLKRKRLYEQQIEQLGNFQLRIHDQMIMLEGAKATTETVDALRTGAAAMKAMQKATNIDDVDKTMDEINEQTENMKQIQEALATPIGASADFDEDELEAELEELEGAELEEQLLQPATTAPAAPVQVPAGRQPARAAQKQHTAEEDELAALQAEMAL

SEQ ID NO: 10449 - protein, 218 aa, Valeriana officinalis
MFTRIFGKPKEEANAVATLDKLNETLEMLEKKEKVLVKKASAEVEKAKEFTKSKNKRAAIQCLKRKRLYEQQVEQLGNFQLRIHDQMIMLEGAKATTETVDALRTGAAAMKAMQKATNIDDVDKTMDEINEQTENMKMIQEALSAPIGAAADFDEDELEAELEELEGAELEEQLLQPATTAPAAPIHVPGGRQQARPAPQKNTAEEDELAALQAEMAL

SEQ ID NO: 10450 - protein, 218 aa, Centaurea maculosa
MLKRILGKPKQEANAVTTIEKLSETLEMLEKKEKVLLKKSAAEVEKAKEYTRAKNKRAAIQCLKRKRLYEQQIEQLGNFQLRIHDQMIMLEGAKATTETVDALRTGASAMKAMQKATNIDDVDKTMDEINEQTENMKQIQEALATPIGAAADFDEDELEAELEELEGAELEEQLLQPATTAPAAPVHAPAGRQQARPPPRKNTSEEDELAALQAEMAL

SEQ ID NO: 10451 - protein, 218 aa, Cucumis melo
MFNRLFGKPKQEANALATLEKLSETLEMLEKKENVLVKKAAAEVERAKEFTRVKNKRAAIQCLKRKRLYEQQIEQLGNFQLRIHDQMIMLEGAKATTETVDALRTGASAMKAMQKATNIDDVDKTMDEINEQTENMKQIQEALSAPIGAAADFDEDELEAELEDLESAELEEQLLQPASTAPAAPVSVPAGRVPARPAPQKRTAEEDELAALQAEMAL

SEQ ID NO: 10452 - protein, 132 aa, Thalictrum flavum
MIMLEGAKATTETVDALRTGAAAMKAMQKAVNIDDVDKTMDEINDQTENMKQIQEALSTPVGSAADFDEDELEAELEELEEAELEEQLLQPATTAPAASVHVPAGRQPTRPLPQKRTAEEEEFAALQAEMAL

SEQ ID NO: 10453 - protein, 214 aa, Antirrhinum majus
MFTRIFGKPKQETNALATLDKLNETLEMLEKKEKILLKKAAGEVEKAKEFTRAKNKRAAIQCLKRKRLYEQQVEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPTTTAPTTSIRVPTGRQPAKKVEDDDDELAELQREMAL

SEQ ID NO: 10454 - protein, 217 aa, Taraxacum officinale
MFTRVFGKPKQESSNAVTSLDKLNETLEMLEKKERVLLKKASAEVEKAKDYTRAKNKKAAIQCLKRKRLYEQQIEQLGNFQLRIHDQMIMLEGAKATTETVDALRTGAAAMKAMQKATNIDDVDKTMDEINEQTENMKLIQEALATPMGAAADFDEDELEAELEELEGAELEEQLLQPATTAPVQVPAGRQQPIPAAPRKNTAEEDELAALQAEMAL

SEQ ID NO: 10455 - protein, 213 aa, Mimulus guttatus
MFTRIFGKPKQETNALATLDKLNETLEMLEKKEKVLLKKAGAEVEKAKEFTRAKNKRAAIQCLKRKRLYEQQIEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATTAPDGPVRIPAGRQPVKVEDDDDELAELQREMAL

SEQ ID NO: 10456 - protein, 220 aa, Vinca minor
MFTRIFGKPKQESNAVATLDKLNETLEMLEKKEKVLQKKASGEVEKAKEFTRAKNKRAAIQCLKRKRLYEQQIEQLGNFQLRIHDQMIMLEGAKATTETVDALRTGAATMKSMQKATNIDDVDKTMDEINEQTENMKQIQEALSTPIGAAADFDEDELEAELEELEGAELEEQLLQPTTTAPAAPIHVPAAAGRQQARLAPQKQSAEEDELAALQAEMAL

SEQ ID NO: 10457 - protein, 220 aa, Vinca minor
MFTKIFGKPKQESNAVATLDKLNETLEMLEKKEKVLQKKASAEVEKAKEFTRAKNKKAAIQCLKRKRLYEQQIEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATTAPAAPVHVPAAAGRQQARPVPQKQSAEEDELAALQAEMAL

SEQ ID NO: 10458 - protein, 164 aa, Flaveria ramosissima
MFSRVFGKPKQEANAVTTLDKLNETLEMLEKKEKVLLKKASAEVEKAKEYTKAHNKRAAIQCLKRKKLYEQQVEQLGNFQLRIHDQMIMLEGAKATTETVDALRTGAAAMKAMQKATNIDDVDKTMDEINEQTENMKQIQEALATPLVQLLILMRMNWKLNLKN

SEQ ID NO: 10459 - protein, 132 aa, Sarracenia psittacina
MILLEGAKATTETVDALRTGAAAMKAMQKATNIDDVDMTMDEINEQTENMKQIQEALATPIGAAADFDEDELEAELEELEGAELEEQLLQPATTAPAAPVQVPAGRLPARAAPQKRTAEEDELAALQAEMAL

SEQ ID NO: 10460 - protein, 218 aa, Flaveria ramosissima
MFSRVFGKPKQEANAVTTLDKLNETLEMLEKKEKVLLKKASAEVEKAKDYTKAKNKRAAIQCLKRKKLYEQQIEQLGNFQLRIHDQMIMLEGAKATTETVDALRTGAAAMKAMQKATNIDDVDKTMDEINEQTENMKLIQEALATPMGAAADFDEDELEAELEELEGAELEEQLLQPATTAPAAPVHVPAGKQPTRPAPQKNTAEEDELAALQAEMAL

SEQ ID NO: 10461 - protein, 218 aa, Flaveria ramosissima
MLARMFGKPKQEANAVTTLDKLNETLEMLEKKEKVLLKKASAEVEKAKEFTRAKNKRAAIQCLKRKRLYEQQIEQLGNFQLRIHDQMIMLEGAKATTETVDALRTGAKAMKAMQKAVNIDDVDKTMDEINEQTENMKQIQEALSAPIGAAADFDEDELEAELEELEGAELEEQLLQPATTAPAAPVYVPAGKQPTRPAQHQNKAEEDELAALQAEMAL

SEQ ID NO: 10462 - protein, 218 aa, Flaveria ramosissima
MLARMFGKPKQEANAVTTLDKLNETLEMLEKKEKVLLKKASAEVEKAKEFTRAKNKRAAIQCLKRKRLYEQQIEQLGNFQLRIHDQMIMLEGAKATTETVDALRTGAKAMKAMQKAVNIDDVDKTMDEINEQTENMKQIQEALSAPIGAAADFDEDELEAELEELEGAELEEQLLQPATTAPAAPVHVPAGKQPTRPAQHQNKAEEDELAALQAEMAL

SEQ ID NO: 10463 - protein, 218 aa, Flaveria ramosissima
MFTRVFGKPKQEANAVTTLDKLNETLEMLEKKEKVLLKKASAEVEKAKDYTKAKNKRAAIQCLKRKKLYEQQIEQLGNFQLRIHDQMIMLEGAKATTETVDALRTGAAAMKAMQKATNIDDVDKTMDEINEQTENMKLIQEALATPMGAAADFDEDELEAELEELEGAELEEQLLQPATTTPAAPVHVPAGKQSTRPAPQKNTAEEDELAALQAEMAL

SEQ ID NO: 10464 - protein, 218 aa, Citrullus lanatus
MFNRLFGKPKQEANALATLEKLSETLEMLEKKENVLVKKAAAEVERAKEFTRVKNKRAAIQCLKRKRLYEQQIEQLGNFQLRIHDQMIMLEGAKATTETVDALRTGASAMKAMQKATNIDDVDKTMDEINEQTENMKQIQEALSAPIGAAADFDEDELEAELDDLESAELEEQLLQPASTAPAGPVSVPAGRVPARPAPQKRTAEEDELAALQAEMAL

SEQ ID NO: 10465 - protein, 213 aa, Arabidopsis thaliana
MFMNRLFGKPKQETSTLQTLDKLNETLEMLEKKENVLLKKATGEVEKAKEFSRAKNKRAAIQCLKRKRLYEQQVEQLGNFQLRIHDQMIMLEGAKATTETVDALRTGASAMKAMQKATNIDDVDKTMDEINEQTENMKQIQEALSAPFGANDFDEDELEAELDELEGAELEEQLLQPVPIHVPQGNKPARAPAQKQPTAEEDELAALQAEMAL

SEQ ID NO: 10466 - protein, 218 aa, Cucumis sativus
MFNRLFGKPKQEANALATLEKLSETLEMLEKKENVLVKKAAAEVERAKEFTRGKNKRAAIQCLKRKRLYEQQIEQLGNFQLRIHDQMIMLEGAKATTETVDALRTGASAMKAMQKATNIDDVDKTMDEINEQTENMKQIQEALSAPIGAAADFDEDELEAELEDLESAELEEQLLQPASTAPAAPVSVPGGRVPARPAPQKRTAEEDELAALQAEMAL

SEQ ID NO: 10467 - protein, 218 aa, Arachis hypogaea
MFTRIFGKPKQEANTLTTLDKLTETLEMLEKKEKVLVKKAAAEVEKAKEFTKAKNKRAAIQCLKRKRLYEQQIEQLGNFQLRIHDQMIMLEGAKATTETVDALRVGAATMKAMQKATNIDDVDKTMDEINEQTENMKQIQEALSAPIGSAADFDEDELEAELEELEGAELEEQLLQPATTAPAAPVHVPAGRQPNRPFPAKPTAEEDELAALQAEMAL

SEQ ID NO: 10468 - protein, 218 aa, Helianthus annuus
MLSRVFGKPKQEANAVTTLDKLNETLEMLEKKEKVLLKKASAEVEKAKEYTKAHNKRAAIQCLKRKKLYEQQVEQLGNFQLRIHDQMIMLEGAKATTETVDALRTGAAAMKAMQKATNIDDVDKTMDEINEQTENMKQIQEALATPLGAAADFDEDELEAELEELEGAELEEQLLQPATTAPAAPVHVPAGKQPTRPAPRQNKAEEDELAALQAEMAL

SEQ ID NO: 10469 - protein, 218 aa, Ambrosia trifida
MFSRMFGKPKPEATTVTTLDKLNETLEMLEKKEKVLLKKAAAEVEKAKEFTRAKNKRAAIQCLKRKRLYEQQIEQLGNFQLRIHDQMIMLEGAKATTETVDALRTGANAMKAMQKAVNIDDVDKTMDEINEQTENMKQIQEALSAPIGAAADFDEDELEAELEELEGAELEEQLLQPATTAPAAPVYVPAGKQPTRPAPRQNTAEEDELAALQAEMAL

SEQ ID NO: 10470 - protein, 218 aa, Ambrosia trifida
MLTRVFGKPKQQPNAVTSLDKLNETLEMLEKKEKVLLKKASAEVEKAKDYTKAKNKRAAIQCLKRKKLYEQQIEQLGNFQLRIHDQMIMLEGAKATTETVDALRTGASAMKAMQKATNIDDVDKTMDEINEQTENMKLIQEALATPMGAAADFDEDELEAELEELEGAELEEQLLQPATTAPAAPVHVPTGRQQTRPAPRQNTAEEDELAALQAEMAL

SEQ ID NO: 10471 - protein, 218 aa, Flaveria ramosissima
MFSRVFGKPKQEANAVTTLDKLNETLEMLEKKEKVLLKKASAEVEKAKEYTKAHNKRAAIQCLKRKKLYEQQVEQLGNFQLRIHDQMIMLEGAKATTETVDALRTGAAAMKAMQKATNIDDVDKTMDEINEQTENMKQIQEALATPLGAAADFDEDELEAELEELEGAELEEQLLQPATTAPVAPVHVPTGGQPTRPAPHQNKAEEDELAALQAEMAL

SEQ ID NO: 10472 - protein, 218 aa, Flaveria ramosissima
MFSRVFGKPKQEANAVTTLDKLNETLEMLEKKEKVLLKKASAEVEKAKEYTKAHNKRAAIQCLKRKKLYEQQVEQLGNFQLRIHDQMIMLEGAKATTETVDALRTGAATMKAMQKATNIDDVDKTMDEINEQTENMKQIQEALATPLGAAADFDEDELEAELEELEGAELEEQLLQPATTAPAAPVHVPTGRQPTRPDPHQNKAEEDELAALQAEMAL

SEQ ID NO: 10473 - protein, 218 aa, Malus domestica
MFTRIFGKPRQENSALTTLDKLNETLEMLEKKEKVLQKKAAGEVDRAKDFTRAKNKRAAIQCLKRKRLYEQQIEQLGNFQLRIHDQMIMLEGAKATTETVDALRTGAAAMKAMQKATNIDDVDKTMDEINEQTENMKQIQEALSTPIGAVADFDEDELEAELEELEGAELEEQLLQPATQAPAAPVQVPAGRQPTRPAPQRRTEEEDELAALQAEMAL

SEQ ID NO: 10474 - protein, 218 aa, Malus domestica
MFTRIFGKPKQENSALTTLDKLNETLEMLEKKEKVLQKKAAAEVDRAKDFTKAKNKKAAIQCLKRKRLYEQQIEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATQAPAAPVQVPAGRQPTRPAPQRRTEEEDELAALQAEMAL

SEQ ID NO: 10475 - protein, 211 aa, Gossypium hirsutum
KPKQETNALTTLDKLNETLEMLEKKEKVLAKKAAAEVEKAKELAKARNKRAAVQCLKRKRLYEQQIEQLGNFQLRIHDQMIMLEGAKATTETVDALRTGASAMKAMQKATNIDDVDKTMDEINEQTENMKQIQDALSTPIGAAADFDEDELEAELEELEGAELEEQLLQPATTAPAAPVQVPAGRQPARPVPQKHTAEEDELAALQAEMAL

SEQ ID NO: 10476 - protein, 218 aa, Nuphar advena
  misc_feature (58)..(58): Xaa can be any naturally occurring amino acid
MFNRIFGKPKQETNALTTLDKLNETLDMLEKKEKVLQKKAAAEVERAKEFTRAKNKRXAIQCLKRKRMYEAQIETLGNFQLRIHDQMILLEGAKATTETVDALRSGAAAMKAMQKATNIDDVDKTMDEINEQTENMKQIQEALSAPIGPAADFDEDELEAELEELEGAELEEQLLQPATTAPAVPVQYVPAGKQPVRPTPQKTSEDEELAALQAEMAL

SEQ ID NO: 10477 - protein, 218 aa, Helianthus annuus
MFARMFGKPKQEANAVTTLDKLNETLEMLEKKEKVLNKKASAEVEKAKEFTRAKNKRAAIQCLKRKRLYEQQIEQLGNFQLRIHDQMIMLEGAKATTETVDALRTGAKAMKDMQKAVNIDDVDKTMDEINEQTENMKQIQEALATPIGAAADFDEDELEAELEELEGAELEEQLLQPATTAPAAPVYVPAGKQPTRPAQRQNTAEEDELAALQAEMAL

SEQ ID NO: 10478 - protein, 223 aa, Flaveria ramosissima
MLARMFGKPKQEANAVTTLDKLNETLEMLEKKEKVLLKKASAEVEKAKEFTRAKNKRAAIQCLKRKRLYEQQIEQLGNFQLRIHDQMIMLEGAKATTETVDALRTGAKAMKAMQKAVNIDDVDKTMDEINEQTENMKQIQEALSAPIGAAADFDEDELEAELEELEGAELEEQLLQPATTAPAAPVYVPAGKHRHVQLSTRTKLRKMNLLHCRQKWHFKVHPG

SEQ ID NO: 10479 - protein, 69 aa, Flaveria ramosissima
MFSRVFGKPKQEANAVTTLDKLNETLEMLEKKEKVLLKKASAEVEKAKDYTKAKNKRDGDTMLKEKETL

SEQ ID NO: 10480 - protein, 214 aa, Arabidopsis lyrata
MFMNRLFGKPKQETNTLQTLDKLSETLEMLEKKENVLMKKANGEVEKAKEFSRVKNKRAAIQCLKRKRLYEQQVEQLGNFQLRIHDQMIMLEGAKATTETVDALRTGASAMKAMQKATNIDDVDKTMDEINEQTENMKQIQEALSAPFGTAADFDEDELEAELEELEGAELEEQLLQPVPIHVPHGNKPNRAPAQKQPTAEEDELAALQADMAL

SEQ ID NO: 10481 - protein, 213 aa, Orobanche aegyptiaca
MFTRIFGKPKQETNALATLDKLNETLEMLEKKEKVLLKKASSEVEKAKEFTRAKNKRAAIQCLKRKKLYEQQIEQLGNFQLRIHDQMIMLEGAKATTETVDALRTGAAAMKAMQKATNIDDVDKTMDEINEQTENMKQIQEALSTPIGAADFDEDELEAELEELEGAELEEQLLQPATTTPAAPVRVPAGKQPAYKAEDEDDELAELQREMAL

SEQ ID NO: 10482 - protein, 214 aa, Salvia sclarea
MFTRIFGKPKQETNALATLDKLNETLEMLEKKEKVLLKKAAAEVERAKEFTRAKNKRAAIQCLKRKRLYEQQIEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATTAPAAPVRVPAGRQPVKNVEDEDDELAELHREMAL

SEQ ID NO: 10483 - protein, 215 aa, Eutrema halophilum
MLNRLFGKPKQETNTLQTLDKLNETLEMLEKKENVLLKKAAGEVERAKEFSRVKNKRAAIQCLKRKRLYEQQVEQLGNFQLRIHDQMIMLEGAKATTETVDALRTGASTMKAMQKATNIDDVDKTMDEINEQTDNMKQIQEALSAPFGYGADFDEDELEAELEELEGAELEEQLLQPTGPAQNGIPQKQPARPATQKQQTADEDELAALQAEMAL

SEQ ID NO: 10484 - protein, 212 aa, Eutrema parvulum
MLNRLFGKPKPETNTLQTLDKLNETLEMLEKKENVLLKKAAGEVERAKEFSRVKNKRAAIQCLKRKRLYEQQVEQLGNFQLRIHDQMIMLEGAKATTETVDALRTGASAMKAMQKATNIDDVDKTMDEINEQTDNMKQIQDALSAPFGSAADFDEDELEAELEELEGAELEEQLLQPVRPVPNLPERKQPATQKQQTAEEDELAALQAEMAL

SEQ ID NO: 10485 - protein, 220 aa, Catharanthus roseus
  misc_feature (147)..(149): Xaa can be any naturally occurring amino acid
  misc_feature (151)..(152): Xaa can be any naturally occurring amino acid
MFTRIFGKPKQESNAVATLDKLNETLEMLEKKEKVLQKKASAEVEKAKEFTRAKNKRAAIQCLKRKRLYEQQIEQLGNFQLRIHDQMIMLEGAKATTETVDALRTGAAAMKAMQKATNIDDVDKTMDEINEQTENMKQIQEALSTPXXXAXXFDEDELEAELEELEGAELEEQLLQPATTAPAAPVHVPAPAGRQQARPAPQKQTAEEDELAALQAEMAL

SEQ ID NO: 10486 - protein, 62 aa, Ambrosia trifida
MFSRMFGKPKPEATTVTTLEKLNETLEMLEKKEKVLLKKAAAEVEKAKEFTRAKINGRQYNV

SEQ ID NO: 10487 - protein, 103 aa, Flaveria ramosissima
MFSRMFGKPKPEANTVTTLDKLNETLEMLEKKEKVLLKKAAAEVERAKEFTRAKNKRAAIQCLKRKRLYEQQIEQLGNFQLRIHDQMIMLEGAKATTETRWMP

SEQ ID NO: 10488 - protein, 218 aa, Phaseolus coccineus
MFSRMFGKPKQETNAVATLDKLNETLEMLEKKEKVLLKKVSAEVEKAKEFTKGKNKRAAIQCLKRKRLYEQQIEQLGNFQLRIHDQMIMLEGAKATTETVDALRTGAATMKAMQKATNIDDVDKTMDEINEQTENMKMIQDALSAPIGAAADFDEDELEAELEELEGAELEEQLLQPATTTPAAPVHVPAGRQPTRPVAAKPTPEEDELAALQAEMAL

SEQ ID NO: 10489 - protein, 218 aa, Unknown
  Sequence found in Organisms: Castanea mollissima, Quercus alba
MFQRMFGKPKQETNALTTLDKLNETLEMLEKKENVLLKKASAEVEKAKEFTRAKNKKAAIQCLKKKKLYEQQIEQLGNFQLRIHDQMILLEGAKATTETVDALRTGAAAMKQMHKATNIDDVDKTMDEINEQTENMKQIQEALSAPIGAAADFDEDELEAELEELEGAELEEQLLQPATTAPAAPVNVPAGRQPTRPVAQKNKAEEDELAALQAEMAL

SEQ ID NO: 10490 - protein, 218 aa, Helianthus annuus
MFTRVFGKPKQEPNAVTSLDKLNETLEMLEKKEKVLIKKASAEVEKAKDYTKAKNKRAAIQCLKRKKLYEQQIEQLGNFQLRIHDQMIMLEGAKATTETVDALRTGASAMKAMQKATNIDDVDKTMDEINEQTENMKLIQEALATPMGAAADFDEDELEAELEELEGAELEEQLLQPATTAPAAPVHVPAGKQPTRPAPRQNTAEEDELAALQAEMAL

SEQ ID NO: 10491 - protein, 218 aa, Juglans hindsii x Juglans regia
  misc_feature (32)..(32): Xaa can be any naturally occurring amino acid
  misc_feature (175)..(175): Xaa can be any naturally occurring amino acid
MFQRVFGKPKQETNALTTLDKLNETLEMLEKXENVLLKKASAEVEKAKEFTRAKNKKAAIQCLKKKKLYEQQIEQLGNFQLRIHDQMILLEGAKATTETVDALRTGAAAMKAMHKATNIDDVDKTMDEINEQTENMKQIQEALSAPIGASADFDEDELEAELEELEGAELEEQLXQPATTAPAAPVHVPAGRQPSRPFPRKNTAEEDELAALQAEMAL

SEQ ID NO: 10492 - protein, 217 aa, Artemisia annua
MFQRMFGKPKQESNAVVTLDKLNETLEMLEKKEKVLLKKASAEVEKAKEYTRAKNKRSAIQCLKRKRLYEQQIEQLGNFQLRIHDQMIMLEGAKATTETVDALRTGAQAMKAMQKAVNIDDVDKTMDEINEQTENMKQIADALAAPIGASADFDEDELEAELEELEGAELEEQLLQPPAQTPPQYVPPGRQPTRPPPRKNTAEEDELAELQAEMALS

SEQ ID NO: 10493 - protein, 211 aa, Utricularia gibba
MLNRLFGKPKQEANALQTLDKLNETLEMLEKKEKVLLKKAADEVERAKEFTRAKNKTAAIRCLKRKKLYEQQIEHLGNFQLRIHDQMIMLEGAKATTETVDALRTAASTMKAMQKATNIDDVDKTMDEINEQTENMKQITEALATPIGAAADFDEDELEAELEELEGAELEEQLLQPATKAPSAPIRQPPKKERVDEHEDELAELQREMAL

SEQ ID NO: 10494 - protein, 219 aa, Cichorium intybus
MLTRVFGKPKKETSNAVATLDKLNETLEMLEKKERVLLKKASAEVEKAKDYTRAKNKKAAIQCLKRKKLYEQQIEQLGNFQLRIHDQMIMLEGAKATTETVDALRTGAAAMKAMQKATNIDDVDKTMDEINEQTENMKQIQEALATPMGAAADFDDDELEAELEELEGAELEEQLLQPATTAPAATVHVPAGRQPLRPAPRQNKAEEDELAALQAEMAL

SEQ ID NO: 10495 - protein, 219 aa, Lactuca sativa
MFTRVFGKPKQESSNTVTSLDKLNETLEMLEKKERVLLKKASAEVEKAKDYTRAKNKKAAIQCLKRKKLYEQQVEQLGNFQLRIHDQMIMLEGAKATTETVDALRTGAAAMKAMQKATNIDDVDKTMDEINEQTENMKLIQEALATPMGAAADFDDDELEAELEELEGAELEEQLLQPATTAPAAPVQVPAGRQPPRPAPQKNTAEEDELAALQAEMAL

SEQ ID NO: 10496 - protein, 218 aa, Fagopyrum esculentum
MFTRMFGKPKQETSTVATLDKMAETLELLEKKESVLSKKAAEEVEKAKAFTRAKNKRAAIQCLKRKRLYEQQIEQLGNFQLRIHDQMIMLEGAKATTETVDALRTGAAAMKAMQKATNIDDVDKTMDEINEQTENMKQIQEALSAPIGAAADFDEDELEAELEELEGAELEEQLLQPMFPTPLPTVKDQSGKQAARPTPQRQTAEEDELAALQAEMAL

SEQ ID NO: 10497 - protein, 218 aa, Flaveria ramosissima
MFTRLFRKPKQDANAVTTLDKLNETLDMLEKKESVLLKKAAAEVERAKEFTRAKNKRAAIQCLKRKKLYEQQVEQLGNFQLRIHDQMIMLEGAKATTETVDALRTGAQTMKAMQKAMNIDDVDKTMDEINEQTEDMKQIQEALSTPIGAAADFDEDELEAELEELEGAELEEQLLQPATTAHAVPMYVPAGKQPARPAQRQNTAEEDELAALQAEMAL

SEQ ID NO: 10498 - protein, 218 aa, Flaveria ramosissima
MLTRLFRKPKQDANAVTTLDKLNETLDMLEKKESVLLKKAAAEVERAKEFTRAKNKRAAIQCLKRKKLYEQQVEQLGNFQLRIHDQMIMLEGAKATTETVDALRTGAQTMKAMQKAMNIDDVDKTMDEINEQTEDMKQIQEALSTPIGAAADFDEDELEAELEELEGAELEEQLLQPATTAHAVPLYVPAGKQPARPAQRQNTAEEDELAALQAEMAL

SEQ ID NO: 10499 - protein, 215 aa, Flaveria ramosissima
MFSRMFGKPKPEANTVTTLDKLNETLEMLEKKEKVLLKKAAAEVERAKEFTRAKNKRAAIQCLKRKRLYEQQIEQLGNFQLRIHDQMIMLEGAKATTETVDALRTGAKAMKAMQKAVNIDDVDKTMDEINEQTENMKQIQEALSAPIGAAADFDEDELEAELEELEGAELEEQLLQPATTAPAAPVYVPAGSQPSRPAPRKNTAEEDELAALQAE

SEQ ID NO: 10500 - protein, 223 aa, Centaurea maculosa
  misc_feature (219)..(219): Xaa can be any naturally occurring amino acid
MFTRVFGKPKQEANAVTTLDKLNETLEMLEKKEKVLLKKASAEVEKAKDYTRAKNKRAAIQCLKRKKLYEQQIEQLGNFQLRVHDQMIMLEGAKATTETVDALRTGAAAMKAMQKATNIDDVDKTMDEINEQTENMKQIQEALATPIGAAADFDEDELEAELEELEGAELEEQLLQPATTAPAAPVQAPAGRQPTRPAPRQNTAEEDELAALQAEMALXKTDH

SEQ ID NO: 10501 - protein, 223 aa, Sequoia sempervirens
MFSRIFGRPKQDTSTLSTLDKLNETLEMLEKKEKVLQKKIQGEVEKAKEFTRAKNKRAAIQCLKRKRLYEVQVEQLGNFQLRIHDQMIMLEGAKATTETVDALRTGASAMKAMQKATNIDDVDKTMDEINEQTENMKQIQEALSTPIGAAADFDEDELEAELEELEGAELEEQLLQPATTTPAMPAQYVPAGKQPTRPAPQKMRPQNTAEEDELAALQAEMAM

SEQ ID NO: 10502 - protein, 218 aa, Glycine max
MFTRIFGKPKPEVNTLTALDELNDKLEMLEKKEKVLLKKAAAEVEKAKEFTRAKNKRAAIQCLKRKRLYEQQIEQLGNFQLRIHDQMIMLEGAKATTETVDALRTGAAAMRAMQKETNIDDVDKTMDEINEQTENMKQIQEALSTPIGAAADFDEDELEAELEELEGAELEEQLLQPATTAPAAPVHVPAGWQPTRPVSSKPTAEEDELAALQAEMAL

SEQ ID NO: 10503 - protein, 218 aa, Triphysaria pusilla
MFSRILGKPKQETNALVTLDKLNETLEMLEKKEGVLQKKATAEVEKAKTYTKAKNKRAAIQCLKRKKLYEEQIGQLANFQLRIHDQMILLEGAKATTETVDALRSGAAAMKAMQKATNIDDVDKTMDEINEQTENMKQIQEALSTPIGAAADFDEDELEAELEELESAELEEQLLQPATTAPAAPFKAGAGRVPTRPVPQKRTEEEDELAALQAEMAL

SEQ ID NO: 10504 - protein, 214 aa, Triphysaria pusilla
MFTRIFGKPKQETNALATLDKLNETLEMLEKKEKVLLKKASSEVEKAKEFTKVKNKRAAIQCLKRKRLYEQQIEQLGNFQLRIHDQMIMLEGAKATTETVDALRTGAAAMKAMQKATNIDDVDKTMDEINEQTENMKQIQEALSAPIGAAADFDEDELEAELEELEGAELEEQLLQPATTAPAAPVRAPAGRQPVMKVGDDDDELAELQREMAL

SEQ ID NO: 10505 - protein, 62 aa, Lippia dulcis
MFTRIFGKPKQETNALATLDKLNETLEMLEKKEKVLLKKAAGEIEKAKEFTKAKNKGLLYNV

SEQ ID NO: 10506 - protein, 69 aa, Lippia dulcis
AKVHRRCLQEFSVKPKQETNALATLDKLNETLEMLEKKEKVLLKKAASEVERAKEFTRAKNKKGLQYNV

SEQ ID NO: 10507 - protein, 218 aa, Arnica chamissonis
MFKRVLGKPKQEANAVTSLDKLNETLEMLEKKEKVLLKKASAEVEKAKDYTKAKNKRAAIQCLKRKKLYEQQIEQLGNFQLRIHDQMIMLEGAKATTETVDALRTGAAAMKAMHKATNIDDVDKTMDEINEQTENMKLIQEALATPMGAAADFDEDELEAELEELEGAELEEQLLQPATTAPAAPVHVPAGKQPARPAPRQNTAEEDELAALQAEMAL

SEQ ID NO: 10508 - protein, 230 aa, Guizotia abyssinica
RVFGKPKQEANAVTSLDKLNETLEMLEKKEKVLLKKGGAEVEKAKEDTKAKNKRAAIQCLKRKKLYEQQIEQLGNFQLRIHDQMIMLEGAKATTETVDALRTGAAAMKAMQKATNIDDVDKTMDEINEQTENMKLIQEALATPMGAAADFDEDELEAELEELEGAELEEKLLQPGTTGPAAPVHMPAGSYQHVQLHAKTLLRKMNLLHCKQKWHFKDVNLQMAGDVLKAT

SEQ ID NO: 10509 - protein, 223 aa, Cephalotaxus harringtonia
MFSRVFGRPKQDTSTLTTLDKLNETLEMLEKKEKVLQKKIQGEVEKAKEFTRAKNKRAAIQCLKRKRLYEVQVEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATTAPAMPAQYTPAGKQPTQPAPQRMRPQNTAEEDELAALQAEMAL

SEQ ID NO: 10510 - protein, 223 aa, Distylium racemosum
MFSRLFGRPKQDTSPLTTLDKLNETLEMLEKKEKVLQKKIQAEVERAKEFTRAKNKRAAIQCLKRKKLYEVQVEQLGNFQLRIHDQMIMLEGAKATTETVDALRTGASAMKAMQKATNIDDVDKTMDEINEQTENMKQIQEALSTPIGAAADFDEDELEAELEELEGAELEEQLLQPATTTPAMPTQYIPAGKQPTRPAPQKARPQNTAEEDELAALQAEMAL

SEQ ID NO: 10511 - protein, 223 aa, Sciadopitys verticillata
MFSRLFGRPKQDTSALTTLDKLNETLEMLEKKEKVLQKKIQGEVEKAKEFTRAKNKRAAIQCLKRKRLYEVQVEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATTAPAMPAQYIPSGKQPTQPAPQKARPQNTAEEDELAALQAEMAL

SEQ ID NO: 10512 - protein, 218 aa, Fagopyrum esculentum
MFSRLFGKPKQGVSAVETLDKLAEALELLEKKEHVLTKKAADEVEKAKAFTRAKNKRAAIQCLKRKRLYEQQVEQLGNFQLRLHDQMILLEGAKATTETVDALRTGAAAMKAMQTAMNIDDVDKTMDEINEQTENMKQIQEALSTPIGAAADFDEDELEAELEELEGAELEEELLQPITQTSLPSTQVPAGTQPARPVPQRRTAEEDELEALQAEMAL

SEQ ID NO: 10513 - protein, 224 aa, Podocarpus macrophillus
MFSRLFGRPKQDTSTLTTLDKLNETLEMLEKKEKVLQKKIQAEVEKAKEFTRAKNKRAAIQCLKRKRLYEVQVEQLGNFQLRIHDQMIMLEGAKATTETVDALRTGASAMKAMQKATNIDDVDKTMDEINEQTENMKQIQEALSTPIGAAADFDEDELEAELEELEGAELEEQLLQPATTAPAMPTQKYNPAGKQTTQPAPQKARPQHTAEEDELAALQAEMAL

SEQ ID NO: 10514 - protein, 62 aa, Taxus baccata
MFSRIFGRPKQDTSALSTLDKLNETLEMLEKKERSCKRRFKERLRRPRSSHEQRIRERQYNA

SEQ ID NO: 10515 - protein, 216 aa, Fagopyrum esculentum
MFSRLFGKPKQGVSAVETLDKLAEALELLEKKEHVLTKKAADEVEKAKAFTRAKNKRAAIQCLKRKRLYEQQVEQLGNFQLRLHDQMILLEGAKATTETVDALRTGAAAMKAMQTAMNIDDVDKTMDEINEQTENMKQIQEALSTPIGAAADFDEDELEAELEELEGAELEEELLQPITQTSSTQVPAGTQPARPVPQRRTAEEDELEALQAEMAL

SEQ ID NO: 10516 - protein, 212 aa, Brassica napus
MFNRLFGKPKVETNTLHTLDKLNETLEMLEKKEGVLLKKAAGEVERAKEFSKAKNKRAAIQCLKRKRLYEQQVEQLGNFQLRIHDQMIMLEGAKATTETVDALRTGAATMKAMQKATNIDDVDKTMDEINEQTDNMKQIQDALSAPFGSAADFDEDELEAELEELEGLELEDQLLQPARPVPEGKQPARPLPQKQQSAHEDELAALQAEMAL

SEQ ID NO: 10517 - protein, 212 aa, Brassica napus
MFNRLFGKPKVETNTLHTLDKLNETLEMLEKKEGVLLKKAAGEVERAKEFSKAKNKRAAIQCLKRKRLYEQQVEQLGNFQLRIHDQMIMLEGAKATTETVDALRTGAATMKAMQKATNIDDVDKTMDEINEQTDNMKQIQDALSAPFGSAADFDEDELEAELEELEGLELEDQLLQPARPVPEGKQTARPLPQKQQSAHEDELAALQAEMAL

SEQ ID NO: 10518 - protein, 219 aa, Lippia dulcis
MFSRILGKPKQEPTALATLDKLNETLEMLEKKENVLQKKASAEVEKAKQYTKAKNKRAAIQCLKRKKLYEEQIGQLANFQLRVHDQMIMLEGAKATTETVDALRSGASAMKAMQKATNIDDVDKTMDEINEQTENMKQIQEALATPIGAAADFDEDELEAELEELEGAELEDQLLQPATTAPAASAPVPSGRVPARPAAPQRRTQEEEELAALQAEMAL

SEQ ID NO: 10519 - protein, 218 aa, Gossypium hirsutum
MFKGIFGKTKPETNALTTLDKLNETLEMLEKKESVLLKKTAAEVEKAKEYAKGRNKKAAIQCLKRKKLYEQQIEQLGNFQLRVHDQMIMLEGAKATTETVDALRTGATAMKAMQKATSIDDVDKTMDEINEQTENMKQIQEALSTPIGAAADFDEDELEAELEELEGAELEEQLLQPATTAPAAPVQVPASSQPARPVPQKHTAEEDELAALQAEMAL

SEQ ID NO: 10520 - protein, 218 aa, Triphysaria pusilla
MFSRILGKPKQETNALVTLDKLNETLEMLEKKEGVLQKKAYAEIEKAKTYTKAKNKRAAIQCLKKKKLYEEQIGQLANFQLRIHDQMILLEGAKATTETVDALRSGAAAMKAMQKATNIDDVDKTMDEINEQTENMKQIQEALSTPIGAAADFDEDELEAELEELEGAELEEQLLQPATTAPAAPVRTPSGGVPTRPVPRKRTEEEDELAALQAEMAL

SEQ ID NO: 10521 - protein, 223 aa, Cryptomeria japonica
  misc_feature (194)..(194): Xaa can be any naturally occurring amino acid
MFSRIFGRPKQDTSTLSTLDKLNETLEMLEKKEKVLQKKIQGEVEKAKEFTRAKNKRAAIQCLKRKRLYEVQVEQLGNFQLRIHDQMIMLEGAKATTETVDALRTGASAMKAMQKATNIDDVDKTMDEINEQTENMKQIQEALSTPIGAAADFDEDELEAELEELEGAELEEQLLQPATTTPAMPAQYIPAGKXPTQPAPQKMRPQNTAEEDELAALQAEMAM

SEQ ID NO: 10522 - protein, 215 aa, Fagopyrum esculentum
MFTRLFGKPKQEVSTVATLDKLSETLELLEKKENVLSKKAAEEVEKAKGFTRAKNKRAAIQCLKRKRLYEQQIEQLGNFQLRIHDQMIMLEGAKATTETVDALRTGAAAMKAMQKATNIDDVDKTMDEINEQTENMKMIQEALATPIGAAADFDEDELEAELEELEGAELEEQLLQPIQPSPLPPSRIPAQPNRPPPRQTAEDDELAALQAEMAL

SEQ ID NO: 10523 - protein, 215 aa, Fagopyrum esculentum
MFTRLFGKPKQEVSTVATLDKLSETLELLEKKENVLSKKAAEEVEKAKGFTRAKNKRAAIQCLKRKRLYEQQIEQLGNFQLRIHDQMIMLEGAKATTETVDALRTGAAAMKAMQKATNIDDVDKTMDEINEQTENMKMIQEALATPIGAAADFDEDELEAELEELEGAELEEQLLQPIHPSPLPPSRIPAQPNRPPPRQTAEDDELAALQAEMAL

SEQ ID NO: 10524 - protein, 222 aa, Cycas rumphii
MFSRLFGRPKQDPSPLSTLDKLNETLEMLEKKEKVLQKKAAVEVERAKEFTRAKNKRAAIQCLKRKRLYEAQVEQLGNFQLRIHDQMIMLEGAKATTETVDALRTGASAMKAMQKATNIDDVDKTMDEINEQTENMKQIQEALSTPIGAAADFDDDELEAELEELEGAELEEQLLQPAQKVPPVQLHAPPGKQPTRPLPQKGQQQNAAEEDELAALQAEMAL

SEQ ID NO: 10525 - protein, 217 aa, Ipomoea nil
MFSRIFGKPKQETNALSTLDKLNETLEMLEKKEKVLQKKASSEVERAKDFTKAKNKRAAIQCLKRKRLYEQQIEQLGNFQLRIHDQMIMLEGAKATTETVDALRTGAAAMKAMQKATNIDDVDKTMDEINEQTENMKMIQEALSTPMSAVDFDEDELEAELEELEGADLEEELLQPATTAPAAPVHVPAGKQAARPVPHRNTAEDDELEALQKEMAL

SEQ ID NO: 10526 - protein, 201 aa, Cucurbita pepo
MFNRLFGKPKQEANASATLEKLSETLEMLEKKENVLVKKASAEVEKAKEFTRVKNKRAAIQCLKRKRLYEQQVEQLGNFQLRIHDQMIMLEGAKATTETVDALRTGASAMKAMQKATNIDDVDKTMDEINEQTENMKQIQEALSTPIGAAADFDEDELEAELESWKVRRWKSNSPTGVNNSCCARFRPSGRYLHACLPSEC

SEQ ID NO: 10527 - protein, 216 aa, Pteridium aquilinum
MFSRLFGKPKQEPTTLATLEKLSETLEMLEKKEMVLQKKISMEVEKAKAYTKAKNKRAAIQCLKRKKLYEVQVEQLGNFQLRIHDQMILLEGAKATTETVDALRTGASAMKAMHKSTNIDDVDKTMDEINEQTENMKQIQEALSAPIGAAADFDEDELEAELEELEGAELEEQLLQPATSAPVSQLPSVPARPYKVPAQPNAEEDELAALQAEMAL

SEQ ID NO: 10528 - protein, 203 aa, Glycyrrhiza uralensis
MFTRIFGKPKQEANALSTLDKLNETLEMLEKKEKVLLKKAGAEVEKAKEFTRAKNKRAAIQCLKRKRLYEQQIEQLGNFQLRIHDQMIMLEGAKATTETVDALRTGASAMKAMQKATNIDDVDKTMDEINEQTENMKQIQEALSAPIGAAADFDEDELEAELEELEGAELEEQLLQPATTAPAAPVHVPAGRQPTHPVNAKPT

SEQ ID NO: 10529 - protein, 227 aa, Eucalyptus grandis
MFNRLFGKPKQETNALTTLDKLNETLEMLEKKEKVLIKKASQEVEKAKEFTRAKNKRAAIQCLKRKRLYEQQVEQLGNFQLRIHDQMIMLEGAKATTETVDALRTGAAAMKAMQKATNIDDVDKTMDEINEQTENMKQIQEALSTPIGAAADFDEDELEAELEELEGAELEEQLLQPATTAPAAPVHVPTGSWSASSPPCSLKGQPRRDELAALQAEDGTFEQGPAC

SEQ ID NO: 10530 - protein, 213 aa, Raphanus sativus
MFTRLFGKPKEETNTLHTLGKLNETLEMLEKKESVLLKKAAGEVERAKEFSKVKNKRAAIQCLKRKRLYEQQVEQLGNFQLRIHDQMIMLEGAKATTETVDALRTGAAAMKAMQKATNIDDVDKTMDEINEQTDNMKQIQDALSAPFGSAADFDEDELEAELDELEGLELEDQLLQPARPLPEGKLPARPLPQKKQTADEEDELAALQAEMAL

SEQ ID NO: 10531 - protein, 216 aa, Picea glauca
MFSRLFGRPKEEANPISTLDKLNETLEMLEKKEKVLQKKIQAEVEKAREFTRAKNKKAAIQCLKRKRLYEVQIEQLGNYQLRIHDQMIMLEGAKATTETVAALRTGASAMKAMQKATNIDDVDKTMDEINEQTENMKQIQEALATPIGAAADFDEDELEAELEELEGADLEEQLLQPAVTAPAVQYTPASQQLARPTRQQAREEDELAALQAEMAL

SEQ ID NO: 10532 - protein, 221 aa, Pinus pinaster
MFSRLFGRPKEEANPISTLDKLNETLEMLEKKEKVLQKKIQAEVEKAKEFTRAKNKKAAIQCLKRKRLYEVQIEQLGNYQLRIHDQMIMLEGAKATTETVAALRTGASAMKAMQKATNIDDVDKTMDEINEQTENMKQIQEALATPIGAAADFDEDELEAELEELEGAELEEQLLQPAVTAPAAQYTPASQQPIRPTPQQARPHNTAEEDELAALQAEMAL

SEQ ID NO: 10533 - protein, 220 aa, Vitis vinifera
MFSRVFRKGKEQSQTNAVATLDKLNETLEMLEKKERVLIKKASAEVEKAKEYTKAKNKRAAIQCLKRKRLYEQQIEQLGNFQLRIHDQMILLEGAKATTETVDALRTGAAAMKTMHKTTNIDDLDKTMDEINEQTENMKQIQEALSTPIGSAADFDEDELEAELEELEGAELEEQLLQPTTTAPAAPVSIPAARQPARPAPQKSTAEDDELAALQAELAL

SEQ ID NO: 10534 - protein, 219 aa, Cedrus atlantica
MFSRLFGRPKEEANPISTLDKLNETLEMLEKKEKVLQKKIQAEVEKAKEFTRSKNKKAAIQCLKRKRLYEVQIEQLGNYQLRIHDQMIMLEGAKATTETVAALRTGASAMKAMQKATNIDDVDKTMDEINEQTENMKQIQEALATPIGAAADFDEDELEAELEELEGAELEEQLLQPAVTAPAPNPTSQQPTRTTPQRTRPQNTAEEDELAALQAEMAL

SEQ ID NO: 10535 - protein, 219 aa, Silene vulgaris
MFTRVFGKPKEATTSAVVTLDKLSETLEMLEKKEQVLLKKASAEVEKAKEFTRAKNKRAAITCLKRKRLYEQQIEQLGNMQLRIHDQMILLEGAKATTETVDALRSGASAMKAMQKATNIDNVDKTMDEINEQTENLKQIQEALSAPIGASADFDEDELEAELEELEGAELEEQLLQPATTAPAAPVHVPGGKQPARHAAHNNTAEEDELAALQAEMAL

SEQ ID NO: 10536 - protein, 221 aa, Cryptomeria japonica
MFNRIFGKPKQEPTPLSTLDKLNETLEMLEKKEGVLQKRIAAEIEKAKEFTRAKNKRAAIQCLKRKRLYELQVEQLGNFQLRIHDQMIMLEGAKATTETVDALRTSAAAMKAMQKATNIDDVDKTMDEINEQTENMKQIQEALSTPIGAAADFDEDELEAELEELEGAELEEQLMQPATIAPTTKLPPIPGKQPTQPASQKATPSSAEEDELAALQAEMAL

SEQ ID NO: 10537 - protein, 221 aa, Abies balsamea
MFSRLFGRPKEEANPISTLDKLNETLEMLEKKEKVLQKKIQAEVDKAKEFTRAKNKKAAIQCLKRKRLYEVQIEQLGNYQLRIHDQMIMLEGAKATTETVAALRTGASAMKAMQKATNIDDVDKTMDEINEQTENMKQIQEALSTPIGAAADFDEDELEAELEELEGAELEEQLLQPAVTAPAPQYTPHNQQPTRPTPQQTRPHNTAEEDELAALQAEMAL

SEQ ID NO: 10538 - protein, 160 aa, Pteridium aquilinum
MLERKKLYEVQVEQLGNFQLRIHDQMILLEGAKATTETVDALRTGAAAMKAMHKSTNIDDVDKTMDEINEQTENMKQIQEALATPIGAAADFDEDELEAELEELEEAELEEQLLQPATTAPASQLPSVPPQRLPARPQRTPAQTSAEDDELAALQAEMAL

SEQ ID NO: 10539 - protein, 221 aa, Pinus taeda
MFSRLFGRPKEEANPISTLDKLNETLEMLEKKEKVLQKKIQAEVEKAKEFTRAKNKKAAIQCLKRKRLYEVQIEQLGNYQLRIHDQMIMLEGAKATTETVAALRTGASAMKAMQKATNIDDVDKTMDEINEQTENMKQIQEALATPIGAAADFDEDELEAELEELEGAELEEQLLQPAVTAPAAQYTPASQRPTRPTPQQARPHNTAEEDELAALQAEMAL

SEQ ID NO: 10540 - protein, 221 aa, Pseudotsuga menziesii
MFSRLFGRPKEESNPISTLDKLNETLEMLEKKEKVLQKKIQSEVEKAKDFTRAKNKKAAIQCLKRKRLYEVQIEQLGNYQLRIHDQMIMLEGAKATTETVAALRTGASAMKAMQKATNIDDVDKTMDEINEQTENMKQIQEALATPIGAAADFDEDELEAELEELEGAELEEQLLQPAVTAPAAQYIPAGQQPTRPTPQQARPHNAAEEDELAALQAEMAL

SEQ ID NO: 10541 - protein, 191 aa, Musa acuminata
MLEKKEKVLLKKAAAEVEKAKEFTRAKNKRAAIQCLKRKRLYEQQVEQLGNFQLRIHDQMIMLEGAKATTETVDALRTGAAAMKAMQKATNIDDVDKTMDEINEQTENMKQIQEALATPIGAAADFDEDELEAELEELEGAELEEQLLQPATTAPAAPVHVPAGRVPARPVPQKNTAEEDELAALQAEMAM

SEQ ID NO: 10542 - protein, 204 aa, Solanum tuberosum
MFKRLLGKPKQETNALATLDKLNETLEMLEKKESVLLKKATAEVERAKEFTRAKNKRAAIQCLKRKRLYEQQVEQLGNFQLRIHDQMILLEGAKATTETVDALRTGAAAMKAMQKATNIDDVDKTMDEINEQTENMKMIQEALSTPIGAAADFDEDELEAELEELEGAELEEHSFSLLLLPLLHLFICLLGSNKCVLLPTQQNG

SEQ ID NO: 10543 - protein, 205 aa, Cirsium arvense
MFTRLFGKPKQEANAVTTLDKLNETLEMLEKKEKVLLKKAAAEVERAKEFTRAKNKRAAIQCLKRKRLYEQQVEQLGNFQLRIHDQMIMIEGAKATTETVDALRTGAQAMKAMQKAVNIDDVDKTMDEINEQTENMKQIQEALSAPIGAAADFDEDELEAELEELEGAELEEQLLQPATTTPTTSVYAPAGKQPTRPAPRQNKAE

SEQ ID NO: 10544 - protein, 199 aa, Allium cepa
MFNRLFGKPKEQTNALATLDKLNETLEMLEKKENVLLKKAAAEVEKAKEFTKAKNRRAAIQCLKRKRLYEQQVEQLGNFQLRIHDQMIMLEGAKATTETVDALRTGASAMKAMQKATNIDDVDKTMDEINEQTENMKQIQEALSTPIGAAADFDEDELEAELEELEGAELEEQLLQPATSAPASSGYVPPGKQQTRPAA

SEQ ID NO: 10545 - protein, 217 aa, Physcomitrella patens
MFSRLFGKPKQEPSTLSTLDKLNETLEMLEKKEKVLQKKIAMEIEKAKEFTRLKNKRAAIQCLKRKRLYEVQVEQLGNFQLRIHDQMIMLEGAKATTETVDALRSGAAAMKAIQKATNIDDVDKTMDEINEQTENMKQIQEALSTPIGTAADIDEDELEAELEDLEGADLEEQLIQPSTHQLPQAQTYKPTSVPTKSPPTTNTEEDELAALQAEMAL

SEQ ID NO: 10546 - protein, 188 aa, Acacia harpophylla
MFTRIFGKPKQEANALTTLDKLNETLEMLEKKEKVLIKKAAAEVEKAKEFTRAKNKRATIQCLKRKRLYEQQVEQLGNFQLRIHDQMIMLEGAKATTETVDALRTGASAMKAMQKATNIDDVDKTMDEINEQTENMKQIQEALSTPIGAAADFDEDELEAELEELEGAELEEQLLQPCTTAPAAPVQV

SEQ ID NO: 10547 - protein, 201 aa, Petunia hybrida
MFSRIFGKPKEEANALTTLDKLNETLEMLEKKEKVLQKKATAEVEKAKEFTRSKNKRAAIQCLKRKRLYEQQIEQLGNFQLRIHDQMIMLEGAKATTETVDALRTGASAMKAMQKATNIDDVDKTMDEINEQTENMKQIQEALATPIGAAADFDEDELEAELEELEGAELEEQLLQPATTAPAAPVHVPAGRQPARPIPQK

SEQ ID NO: 10548 - protein, 220 aa, Marchantia polymorpha
MFARIFGKPKEEPSTLSTLDKLNETLEMLEKKEKVLQKKIAVEIEKARDYTRAKNKRAAIQCLKKKKLYEVQVEQLGNFQLRIHDQMIMLEGAKATTETVDALRSGASAMKNMQKATNIDDVDKTMDEINEQTENMKQIQEALSTPIGAAADFDDDELEAELEELEGAELEEALLQPATTPATQLPTVPTQSRPMSTPAQRQPAKTEDDELAALQAEMAL

SEQ ID NO: 10549 - protein, 172 aa, Brassica oleracea
  misc_feature (41)..(41): Xaa can be any naturally occurring amino acid
MSLASPIQCIRIINPSSSSSSSLTTSSSLRFSTSKPCVFIXRCSQAEGPLRRPSAPPTLREPSPPQKPVPPMPSSSPPPPQKAVAVDGKSVVTTVEFQRQKAKELQDYFKQKKLEAAGQGPFFGFQPKNEISNGRWAMFGFAVGMLTEYATGSDLVDQVKILLSNFGILDLE

SEQ ID NO: 10550 - protein, 172 aa, Brassica napus
MSLASPIQCIRIINPSSSSSSSLTTSSSLRFSTSKPCVFIIRCSQAEGPLRRPSAPPTLREPSPPQKPVPPMPSSSPTPPQKAVAVDGKSVVTTVEFQRQKAKELQDYFKQKKLEAAGQGPFFGFQPKNEISNGRWAMFGFAVGMLTEYATGSDLVDQVKILLSNFGILDLE

SEQ ID NO: 10551 - protein, 172 aa, Raphanus sativus
MSLASPIQCIRIINPSSSSSSLTTSSSLRFSTSKPCVFIIRCSQADGPLRRPSAPPTLREPTPPQKPAPPTPSTSPPPPPPQKAVAVDGKSVTTVEFQRQKAKELQDYFKQKKLEAAGQGPFFGFQPKNEISNGRWAMFGFAVGMLTEYATGSDLVDQVKILLSNFGILDLE

SEQ ID NO: 10552 - protein, 177 aa, Raphanus sativus
MSLASPIQCIRIINPSSSSSSSSLTASSSLRFSASKPCVFIIRCSQAEGPLRRPSAPPTLREPIPPQKPAPPTPSTSPPPPPPPPPQKAVAVDGKSVTTVEFQRQKAKELQDYFKQKKLEAAGQGPFFGFQPKNEISNGRWAMFGFAVGMLTEYATGSDLVDQVKILLSNFGILDLE

SEQ ID NO: 10553 - protein, 171 aa, Unknown
  Sequence found in Organisms: Brassica napus, Brassica rapa
MSLASPIQCIRILNPSSSSSTTSSSFRFSTIKPCVFVIRCSQAEGPLRRPSAPPTLREPSPPQKPVPPVPSSSPPPSPPLQKTVAVDGKGVVTVEFQRQKAKELQEYFKQKKLEAAGQGPFFGFQPKNEISNGRWAMFGFAVGMLTEYATGSDLVDQVKILLSNFGIIDLE

SEQ ID NO: 10554 - protein, 89 aa, Raphanus sativus
MSVASPIQCIRILNPYSSSSTTSSSFRFSTSKPCVFIIRCSQAEGPLRRPSAPPTLREPTPPQKTVPPTSSSLLLLHRCRKRWLLMVRV

SEQ ID NO: 10555 - protein, 177 aa, Eutrema parvulum
MSVASPIQCIRILNPSSSSSSSSSSLTTSSSFRFSTTKPCVFIIRCSQTEGPLRRPSAPPTLREPSPPQKPVPPTPSSSPPPPPPLQQSVAVDGKSVTTVEFQRQKAKELQEYFKKKKLEAAGQGPFFGFQPKNEISNGRWAMFGFAVGMLTEYATGSDLVDQVKILLSNFGILDLD

SEQ ID NO: 10556 - protein, 172 aa, Arabidopsis thaliana
MSVASPIQCIRILNPSSSSSSSTASSSFRFSTTTKPCVFIIRCSQTEGPLRRPSAPPTLREPQKPVPPSQPSSSPPPSPPPQKAVAVDGKSVTTVEFQRQKAKELQEYFKQKKLEAAGQGPFFGFQPKNEISNGRWAMFGFAVGMLTEYATGSDLVDQVKILLSNFGILDLE

SEQ ID NO: 10557 - protein, 167 aa, Brassica napus
MSLASPIQCIRILNPSSSSSTTSSSFRFSTIKPCVFVIRCSQAEGPLRRPSAPPTLREPSPPQKPVPPVPSSSPPPSPPLQKTVAVDGKGVVTVEFQRQKAKELQEYFKQKKLEAAGQGPFFGFQPKTRSPMEGGLCLVSRLECLQSMPQAQTLSTKLKSFSPTSEL

SEQ ID NO: 10558 - protein, 174 aa, Arabidopsis lyrata
MSVASPIQCIRILNPSSSSSSSSSTASSSFRFSSTTKPCVFIIRCSQTEGPLRRPSAPPTLREPQKPVPPSQPSSAPPPPPPPQKAVAVDGKSVTTVEFQRQKAKELQEYFKQKKLEAAGQGPFFGFQPKNEISNGRWAMFGFAVGMLTEYATGSDLVDQVKILLSNFGIVDLE

SEQ ID NO: 10559 - protein, 176 aa, Unknown
  Sequence found in Organisms: Thellungiella halophila, Eutrema halophilum
MSVASPIQCIRILNPSSSSSSSSCSSTTSSSFRFSATKPCVFVIRCSQTEGPLRRPSAPPTLREPSPSQKPVPPTPSSSPPPPPPQISVAVDGKSAITVEFQRQKAKELQDYFKQKKLEAAGQGPFFGFQPKNEISNGRWAMFGFAVGMLTEYATGSDLVDQVKILLSNFGIIDLE

SEQ ID NO: 10560 - protein, 342 aa, Brassica napus
MATLNPFDLLGDDAEDPSQIAVSIAADKPKKPAPVSAKSSAPSRQLPQPVREARSDAPRGGGRGGGGDRGSSRGRGGYNRDFRGGDGNSGGYNKPSEEGGVSKPFYEKRSVYGGAPRGGGRRGEAGEGERPRRTYERRSGTGRGGDFKREGAGRGNWGTPGEEVLVVETEEVAGAESEKPAGDEVAADAKKENTAEVEEQKEPEDKEMTLDEYEKILEEKKKSLQSQTTSERKVDTKVFESMQQLSNKKKSNDEIFIKLGSDKDKRKDDKEEKAKKAVSINEFLKPAEGENYYRGGGRGGGRGRGRGGRDRGVGSGGGFDGYRSEAAPAIGDTAQFPSLGGK

SEQ ID NO: 10561 - protein, 355 aa, Eutrema parvulum
MATLNPFDLLDDDAEDPSQLAVSIAADKPKKSAPVSGVPAKSAAPSKQLPPAQAVREARSDAPRGGGRGGGGDRGFSRGRGGPGGYNRDFRGGDGPGGNNGYSGGYSKPSEEGDVSKSSYERRGGGFGGPPRGGRRGGFSNEGGEGERPRRTFERRSGTGRGGDFKREGSGRGNWGTPGEEVLVGETEEVAGVETEKDAVEKPAADANKENTVDIEEQKEPEDKEMTLDEYEKIFEEKRKALQSQTTSERKVDTKVFESMQQLSNKKSNDEIFIKLGSEKDKRKDDKEEKAKKAVSINEFLKPAEGENYYRGGRGGRGRGGRDRGGVSRGGFGGNRGEAAPAIGDAAQFPSLGGK

SEQ ID NO: 10562 - protein, 335 aa, Brassica rapa
MATLNPFDLLDDDAEDPSQLAVSIAADKSRKPAPVSGLPAKSTPPSSKQPPPSQAVREARSDAPRGGGGGFSRGRGGYNRGGNNGYSGGYSKPSEEGDVSKPSYERRGGGGVGPPRGGRRGEAGEGERPRRAFERRSGTGRGGDFKREGAGRGNWGTPGEEVLAVETEEVAAGVENEKDVVEKPADDDANKENTTEVEEQKEPEVKEMTLDEYEKILEEKRKALQSQNTSERKVDTKVFESMQQLSNKKKSNDEIFIKLGSDKDKRKDDKEEKAKKAVSINEFLKPAEGENYYRGGRGGRGRGGRVSSGGGFSGNRSEAAPAIADTAQFPSLGGK

SEQ ID NO: 10563 - protein, 363 aa, Brassica napus
MPRWICCGGHRSGDSDISNDEKHLKTQWQQPDANKTRPQAVAKPEAPKEALPIEVPPLSVEEVEEKTDNFGSKSLIGEGSYGRVYYATLSDGKAVALKKLDVAPEAETNTEFLSQVSMVSRLKHDNFIQLVGYCVDENLRVLAYEFATMGSLHDVLHGRKGVQGAQPGPTLDWITRVKIAVEAARGLEYLHEKVQPPVIHRDVRSSNVLLFEDYQAKVADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKPPAPAPVPES

SEQ ID NO: 10564 - protein, 358 aa, Brassica napus
MPRWICCGGHRRGDSDISNDDHHLKTQWQQPDANKTRPQAVAKPEAPKEALPIEVPPLSVEEVEEKTDNFGSKSLIGEGSYGRVYYATLSDGKAVALKKLDVAPEAETNTEFLSQVSMVSRLKHENFIQLVGYCVDENLRVLAYEFATMGSLHDVLHGRKGVQGAQPGPTLDWITRVKIAVEAARGLEYLHEKVQPPVIHRDVRSSNVLLFEDYQAKVADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKPPAPA

SEQ ID NO: 10565 - protein, 364 aa, Brassica napus
MHRWICCGRSSGDSDVSNDEQHLKTQWQQSQAANNKPKPQAVAKPEAPKEALPIEVPLLSVEEVKEKTENFGSKSLIGEGSYGRVYYATLSDGKAVALKKLDVAPEAETNTEFLSQVSMVSRLKHENFIQLVGYCVDENLRVLAYEFATMGSLHDVLHGRKGVQGAQPGPTLDWITRVKIAVEAARGLEYLHEKVQPPVIHRDVRSSNVLLFEDYQAKVADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKTPAPVPVTEP

SEQ ID NO: 10566 - protein, 363 aa, Eutrema parvulum
MRRWICCGRKSGDSNLSNDEQHLKSQWQSDANHKNPTPQAVAKHEAQKEALPIEVPPLSVEEVKEKTDNFGSKSLIGEGSYGRVYYATLNDGKAVALKKLDVAPEAETNAEFLSQVSMVSRLKHENLIQLVGYCVDENLRVLSYEFATMGSLHDVLHGRKGVQGAQPGPTLDWITRVKIAVEAARGLEYLHEKVQPPVIHRDIRSSNVLLFEDYQAKIADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKPPAPVPVPES

SEQ ID NO: 10567 - protein, 364 aa, Arabidopsis lyrata
MRRWICCGEKRGDSDLSNEEVHLKSPWQQSDANQKNQKPQAVAKPEAQKEALPIEVPPLSVDEVKEKTDNFGSKSLIGEGSYGRVYYATLNDGKAVALKKLDVAPEAETNSEFLSQVSMVSRLKHENLIQLVGYCVDENLRVLAYEFATMGSLHDILHGRKGVQGAQPGPTLDWLTRVKIAVEAARGLEYLHEKVQPPVIHRDIRSSNVLLFEDYQAKVADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKPPAPAPVPES

SEQ ID NO: 10568 - protein, 364 aa, Eutrema halophilum
MRRWICCGRKTGDSDLSNNEEHVKTQWQQSDANHKNSKPQAVTKPEVQKEALPIEVPPLSVDEVKEKTDNFGSKSLIGEGSYGRVYYATLSDGKAVALKKLDVAPEAETNAEFLSQVSMVSRLKHENLIQLVGYCVDENLRVLAYEFATMGSLHDVLHGRKGVQGAQPGPTLDWITRVKIAVEAARGLEYLHEKVQPPVIHRDIRSSNVLLFEDYQAKVADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKAPAPAPAPES

SEQ ID NO: 10569 - protein, 365 aa, Raphanus sativus
  misc_feature (50)..(50): Xaa can be any naturally occurring amino acid
MHRWICCGRSSGDSDVSNDEQHLKTQPQQSDAANNKPKPQAAAAKPEAPXEALPVEVPPLSVEEVKEKTDNFGSKSLIGEGSYGRVYYATLSDGKAVALKKLDVAPEAETNSEFLSQVSMVSRLKHENFVQLVGYCVDENLRVLAYEFATMGSLHDVLHGRKGVQGAQPGPTLDWITRVKIAVEAARGLEYLHEKVQPPVIHRDVRSSNVLLFEDYQAKVADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKTPAPVPAAES

SEQ ID NO: 10570 - protein, 369 aa, Brassica napus
MRRWICCGRISGGDSGLSNDEQHLKTQWQQQQQPDAANQKLRPQPAAKPDAPKEALPIEVPPLSVEEVKEKTDNFGSKSLIGEGSYGRVYYATLNDGKAVALKKLDVAPEAETNSEFLSQVSMVSRLKHDNLIQLVGYCVDEDLRVLAYEFATMGSLHDVLHGRKGVQGAQPGPTLDWITRVKIAVEAARGLEYLHEKVQPPVIHRDVRSSNVLLFEDYQAKIADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKPPAPAAPTPES

SEQ ID NO: 10571 - protein, 368 aa, Brassica napus
MRRWICCGRISGDSDLSNDEQHLKTQWQQQQQPDAANQKLKPQPATKPDVPKEALPIEVPPLSVEEVKEKTDNFGSKSLIGEGSYGRVYYATLNDGKAVALKKLDVAPEAETNAEFLSQVSMVSRLKHDNLIQLVGYCVDEDLRVLAYEFATMGSLHDVLHGRKGVQGAQPGPTLDWITRVKIAVEAARGLEYLHEKVQPPVIHRDVRSSNVLLFEDYQAKIADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKPPAPAAPTPES

SEQ ID NO: 10572 - protein, 366 aa, Arabidopsis thaliana
MRRWICCGDKKGDSDLSNEEVHLKSPWQNSEANQKNQKPQAVVKPEAQKEALPIEVPPLSVDEVKEKTDNFGSKSLIGEGSYGRVYYATLNDGKAVALKKLDVAPEAETNTEFLNQVSMVSRLKHENLIQLVGYCVDENLRVLAYEFATMGSLHDILHGRKGVQGAQPGPTLDWLTRVKIAVEAARGLEYLHEKVQPPVIHRDIRSSNVLLFEDYQAKVADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKPPAPAPAPVPES

SEQ ID NO: 10573 - protein, 106 aa, Vitis vinifera
MAKVFALFLLALLAISMLHTTVLASHGHGGHHYDQKNYGPGSLKSFQCPSQCSRRCGKTQYHKPCMFFCQKCCKKCLCVPPGYYGNKAVCPCYNNWKTKEGGPKCP

SEQ ID NO: 10574 - protein, 106 aa, Euphorbia peplus
MAKSFALFFLALIAISMLQTMVMASNGHGGHHNNQNGYGPGSLKSYQCPSQCTRRCGRTQYHKPCMFFCQKCCNKCLCVPPGYYGNKAVCPCYNNWKTKEGGPKCP

SEQ ID NO: 10575 - protein, 107 aa, Medicago truncatula
MARLVVVFILVLIAISMLQTVVMASHGHGGHHYNDKKKYGPGSLKSYQCPSQCSRRCKNTQYHKPCMFFCQKCCNKCLCVPPGYYGNKAVCPCYNNWKTQQGGPKCP

SEQ ID NO: 10576 - protein, 107 aa, Arachis hypogaea
MAKFFAAFILALIAISMLQTMVMAANGQGGHFYDNKSQYGPGSVKSYQCPSQCSRRCGKTQYHKPCMFFCQKCCRKCLCVPPGYYGNKAVCPCYNNWKTKEGGPKCP

SEQ ID NO: 10577 - protein, 107 aa, Pisum sativum
MAKLLGALILILIAISMLQTMVMASHGHGGHHYNDKTKYGPGSLKSYQCPSQCSRRCKMTQYHKPCMFFCQKCCNKCLCVPPGYYGNKAICPCYNSWKTQQGGPKCP

SEQ ID NO: 10578 - protein, 106 aa, Primula obconica
MAKSVALFLLVLLAISMLQTLVYASHGHGGHHKHKKGYGPGSLKSFQCPSECSRRCGRTQYHKPCMFFCQKCCSKCLCVPPGYYGNKALCPCYNNWKTKEGGPKCP

SEQ ID NO: 10579 - protein, 111 aa, Cyamopsis tetragonoloba
MASASAKFFAALLLALIAISMLQTVVMAANGQGGKVLDNKSNYGPGSLKSYQCPSQCSRRCGKTQYHKPCMFFCQKCCRKCLCVPPGYYGNKAVCPCYNNWKTKEGGPKCP

SEQ ID NO: 10580 - protein, 110 aa, Glycine max
MAVANKLLSVLIIALIAISMLQTVVMASHGHGGHHYNDKKKYGPGSLKSFQCPSQCSRRCGKTQYHKPCMFFCQKCCRKCLCVPPGYYGNKAVCPCYNNWKTKEGGPKCP

SEQ ID NO: 10581 - protein, 106 aa, Prunus persica
MAKFFAALMLALLAISMLQTTVMANNGHGGHHGGNNAYGPGSLKSYQCPSQCSRRCGQTQYHKPCMFFCQKCCKKCLCVPPGYYGNKGVCPCYNNWKTQQGGPKCP

SEQ ID NO: 10582 - protein, 151 aa, Saccharum officinarum
TNSAPAARSSRPWRAPTWRRPPRGSCWLLAYPPPAAAAASSGRVSFASAPNRLGGRLVVRADPEAAAEPAEGEGAVATKPKAEKPPPIGPKRGAKVKILRRESYWYNGIGNVVTVDQDPNTRYPVVVRFNKVNYAGVSTNNYALDEIQEVK

SEQ ID NO: 10583 - protein, 136 aa, Zea mays
MASTNMASATSRFMLAAGVPTGSSGGRVNFASAPNRLGRRLVARADNEAAAAEAAEGEGAVATKPKAEKPPPIGPKRGAKVKILRRESYWYNGIGNVVTVDQDPNTRYPVVVRFNKVNYAGVSTNNYALDEVLEVK

SEQ ID NO: 10584 - protein, 142 aa, Sorghum bicolor
MASTNMASATSRFMLAAGVPTAGSGSGSSGRVSFAPAPNQLGRRLVVRADPEAPAEPAEGEGAVATKPKAEKPPPIGPKRGTKVKILRRESYWYNGIGNVVTVDQDPNTRYPVVVRFNKVNYAGVSTNNYALDEVQEVNEQK

SEQ ID NO: 10585 - protein, 142 aa, Setaria italica
MASTNMASATSRFMLAAGVPATGISGNGSGRVSFAPVPNRLGRRLVVRAEEEAAAPAEPAAEGEGAVATKTKAEKPPPIGPKRGAKVKILRRESYWYNGIGNVVTVDQDPNTRYPVVVRFNKVNYAGVSTNNYALDEIQEVK

SEQ ID NO: 10586 - protein, 142 aa, Pennisetum glaucum
MASTNMASATSRFMLAAGVPAAGMSGNGSGRVSFAAVPNRLGKRLVVRAEEEAAAEPAPAAEAEGGVATKTKADKPPPIGPKRGAKVKILRRESYWYNGIGNVVTVDQDPNTRYPVVVRFNKVNYAGVSTNNYALDEIQEVK

SEQ ID NO: 10587 - protein, 130 aa, Cenchrus ciliaris
MLAAGVPAPGMSAASGGVSFAAVPTTNRLERRLVVRPEEEPPAEPAPAAEAEAGVATKTKAEKPPPIGPKRGAKVKILRRESYWYNGIGNVVTVDQDPNTRYPVVVRFNKVNYAGVSTNNYALDEIQEVK

SEQ ID NO: 10588 - protein, 314 aa, Trigonella foenum-graecum
MATVVVHSQTSPVQDAEALRLAFKGWGADNKAIIAILGHRNVHQRQEIRKAYEELFEEDLIKRLESEISGDFERAVYRWMLEPADRDAVLINVAIRNGNKDYHVVAEISSVLSTEELLAVRRAYHNRYKRSIEEDVSAHTTGHLRQLLVGLVSSFRYEGDEINPKLAQTEANIIHESVKEKKGNNEEVIRILTTRSKTQLVATFNRYRDEHGISISKKLLDQTSDDFQKTLHTAIRCINDHKKYYEKVLRNAIKKFGTDEDGLSRVIVTRAEKDLRDIKELYYKRNSVHLEDAVSKETSGDYKKFILTLLGKHD

SEQ ID NO: 10589 - protein, 315 aa, Cicer arietinum
MATIVVHNQASPAEDAEALRLAFKGWGADDKTIIAILGHRNVYQRQQIRKAYEELFQEDLIKRLESEISGDFERAVYRWMLEPADRDAVLINVAVRNGSKDYHVVAEIASVLSAEELLAVRRAYHNRYKRSIEEDVAAHTTGHLRQLLVGLVSSFRYEGDEINAKLAQNEANIIHESVKEKKGNNEEEVIRILTTRSKTQLVATFNRYRDDHGTSISKKLLDQTFDDFHKALHTVIRCINDHTKYYEKVLRNAIKKFGTDEDGLNRVIVTRAEKDLRDIKELYYKRNSVHLEDAVSKEISGDYKKFILTLLGKQD

SEQ ID NO: 10590 - protein, 314 aa, Cyamopsis tetragonoloba
MATLVVYNQTSPAQDAEALRHAFKGWGADDKAIIAILGHRNVHQRQQIRKAYAELFNEDLIKRLESEISGDFERAVYRWMLEPAERDAVLANVAIRNGNKDFHVIAEIASVLSAEELLAVRRAYHVRYKRSLEEDVAANTTSHLRQLLVGLVSSFRYEGDEINAKLAQSEANILHEIVKEKKGNYEEVIRILTTRSKTQLVATFNRYRDEHGISISKKLLDQAPDDFHKVLHTAIRCINDHKKYYEKVLRNSMKKLGTDEDGLSRVVVTRAEKDLKEIKELYYKRNSVHLEDAVSKEISGDYKKFILTLLGKQD

SEQ ID NO: 10591 - protein, 312 aa, Glycine max
MATLVVHNQTSSAQDAEALQQAFKGWGADDKAIIAILGHRNVHQRQEIRKAYEEIYQEDLIKRLESEISGDFERAMYRWMLQPADRDAVLVNVAIKNGTKDYHVIAEIACVLSAEELLAVRRAYHRRYKCSLEEDVAANTTGNLRQLLVGLVTSYRYEGDEINVKFSQTEANVLHESVKEKKGNSEEVIRILTTRSKTQLVATFNRYRDEHGISISKKLLDQTSDDFHKVLHTAIRCINDHKKYYEKVLRNAVKKFGTDEDGLSRVIVTRAEKDLKDIKELYYKRNSVHLEDEVSKETSGDYKKFLLTLLGK

SEQ ID NO: 10592 - protein, 314 aa, Cajanus cajan
MATLIAPSHHSRVEDAEALRNAFKGWGSDGKAIIAILGHRNVHQRQEIRKAYEEIYQEDLIKRLESEISGDFERAVYRWMLGPADRDAVIVNVAIKNGSKEYPVIAEIACVLSAEELLALRRAYHNRYKRSLEEDVAAHTTGHLRQLLVGLVSSYRYEGDEINVKLAQTEANILHETVKEKKGNYEEAIRILTTRSKTQLVATFNRYRDEHGISISKKLLDHASDDLLKVLHTAIRCINDHKKYYEKVLRNAMKKFGTDEEGVSRVIVTRAEKDLKDIKELYYKRNSVHLEDEVSKETSGDYKKFILALLGKHD

SEQ ID NO: 10593 - protein, 322 aa, Arachis hypogaea
MATLIAPSNHSSAEDAEALQKAFKGWGADDKTIIAILGHRNVHQRQQIRKAYEELHQEDLIKRLESEISGDFERAMYRWMLEPADRDAVLANVAIRNGKKDFHVIAEIACVLSAEELLAVRRAYRHRYKRSLEEDVAANTTGHLRQLLVGLVSSYRYEGDEINARLAQSEANILHETVKEKKGNYEEAIRILTTRSKTQLVATFNRYRDEHAISISKKLLDNQASDDFYKALHTAIRCINDHKKYYEKVLRNAIKKVGTDEDALSRVVVTRAEKDLRDIKELYYKRNSVHLEDAVAKELQGTTRSSFSHCWENRTENINTSN

SEQ ID NO: 10594 - protein, 239 aa, Lotus japonicus
MATLVAPNQISAAEDAQALRQAFKGWGADDKAIIAILGHRNVYQRQEIRKAYEELFQEDLIKRLESEISGDFERAMFRWMLEPADRDAVLANVAIRNGNKDYHAVAEIACVLSAEELLAVRRAYHNRYKRSLEEDVAAHTTGLHRQHLAGLVTSFRYEGDEINAKLAQTEANILHEAVQEKKGIYEEVIRILTTRSRHNLWQLSTATKMSMASPSVRNCWMKHLMTSETCTQLFVASRP

SEQ ID NO: 10595 - protein, 314 aa, Vigna unguiculata
MATLVLHHQTSPAQDAEALHQAFKGWGSDGKAIIAILGHRNVHQRQEIRRAYEEIYQENLIKRLESEISGDFERAVYRWMLEPADRDAVLMNVAIKNGPKEYNVIAEIASVLSAKELLAVRCAYHDRYKRSLEEDVAAHTTGHLRQLLVGLVSSYRYEGDEINVKLAQTEANILHESIKEKKTNYEEVTRILTTRSKTQLVATFNRYRDEHGISISKKLVDQSSDDFVKVLHTVIRCVNDHKKYYEKVLRNAIKKFGTDEDGLTRVIVTRAEKDLKDIKEVYYKRNSVHLEDAVSKEISGDYKRFMLALLGNQD

SEQ ID NO: 10596 - protein, 314 aa, Phaseolus coccineus
MATLVLHHQTSPAEDAEVLHQAFKGWGSDGKAIIAILGHRNVHQRQEIRKAYEEIYQENLIKRLESEISGDFERAVYRWMLEAADRDAVLINVAIKNGPKEYHVIAEISSVLSAKELLAVRSAYHDRYKRSMEEDVAAHTTGHLRQLLVGLVSSYRYEGDDIHAKLAQTEANILHESIKEKKANHEEVIRILTTRSKTQLVATFNRYRDEHGISITKKLVDQSSDDFVKVLHTVIRCINDPRKYYEKVLRNAMKKFGTDEDGLTRVIVTRAEKDLKDIKEIYYKRNSVHLEDDVSKEISGDYKRFILTLLGNQD

SEQ ID NO: 10597 - protein, 313 aa, Trigonella foenum-graecum
MATLVTIKSSPVEDAEALQKAFKGWGTDEKSVITILGHRNVYQRQQIRKSYQEIYQEDILKRLESELSGDFEKAVYRWMLEPAERDAVLANVAIKDGNKGYHVIIEIVSVLSPEEVLAMRRAYHNRYKHSLEEDVAAHTTGHLRQLLVGLVSSFRYGGNEINPKLAKTEADILHESIKEKKGNHEEAIRILTTRSKTQLLATFNRYRDDHGISITKKLLDNASDDFHKALHTTIRCINDHKKYYEKILRSALKKVGTDEDGLTRVVVTRAEKDLRDIKEVYYKRNSVHLEDAVAKEISGDYKKFILTLLGKQD

SEQ ID NO: 10598 - protein, 314 aa, Lotus japonicus
MATLIATTQHSPVADAEALRNAFQGWGTDEKTVIAILGHRSVHQRQQIRKAYEELYQEDIIKRLESELSGDIEKAVYRWMLEPTDRDAVLANVAIKSGGKGYNVIVEIATVLSPEEVLAVRRAYHNRYKRSLEEDVAAHTTGDLRQLLVGLVSSFRYGGDEINARLAKTEADILHESIKQKKGNNEEAITILTTRSKTQLVATFNRYRDDHGISITKKLLDNASDDFHKALHTAIRCINDHQKYYEKVLRNALKRVGSDEDGLTRVVVTRAEKDLKEIKELYYKRNSVHLEDAVAKELSGDYKKFILTLLGKQD

SEQ ID NO: 10599 - protein, 314 aa, Glycine max
MATLVAPNQKSPVEDVEALHKAFKGWGTDEKTVIAILGHRNVHQRQQIRKIYEEIYQEDLIKRLESELSGDFERAVYRWMLEPADRDAVLANVAIKNGSKGYHVIVEIACVLSAEEVLAVKRAYHNRYKRSLEEDVATNTTGDIRQLLVGLVTAYRYGGDEINAKLAKTEADILHESIKEKKGNHEEAIRILTTRSKTQLLATFNRYRDDHGASITKKLLDNASTDFQKALHTAIRCINDHKKYYEKVLRNALKNVGTDEDALTRVVVSRAEKDLRDIKERYYKRNSVHLEDAVAKEISGDYKKFILTLLGKED

SEQ ID NO: 10600 - protein, 314 aa, Vigna unguiculata
MATLIAPITFSPGADAEALNKAFKGWGTDEKTVIAILGHRNVYQRQQIRKVYEEMYQEDLIKRLESELTGDFERSVYRWMLEPADRDAVLANVAIKDGSKGYHVIVEIACVLSSEELLAARRAYHHRYKRSLEEDVAANTSGDLRQLLVGLVTSYRYGGDEINARLAKTESDILHSSIKEKKGNHEEAIRILTTRSKTQLLATFNRYRDDHGASITKKLLDDASDDFRKALHTAIRCINDHKKYYEKVLRNAMKRVGTDEDALTRVVVSRAEKDLRNIAELYYKRNSVHLEDAVAKEISGDYKKFILTLLGKDV

SEQ ID NO: 10601 - protein, 314 aa, Glycine max
MATLIAPITFSPGLDAEALRKAFQGWGTDEKTVIAILGHRNVHQRQQIRKVYEEIYQEDLIKRLESELSGDFERAVYRWMLEPADRDAVLANVAIKNGSKGYHVIVEIACVLSADEVLAVKRAYHNRYKRSLEEDVATNTTGDIRQLLVGLVTAYRYDGDEVNAKLAKTEADILHESIKEKKGNHEEAIRILTTRSKTQLLATFNRYRDDHGASITKKLLDNASTDFQKALHTAIRCINDHKKYYEKVLRNAIKGVGTDEDALTRVVVSRAEKDLRDIKELYYKRNSVHLEDAVAKEISGDYKKFILTLLGKED

SEQ ID NO: 10602 - protein, 217 aa, Phaseolus coccineus
MATLIAPITFSPGADAEDLHKAFKGWGTDEKTVIAILGHRNVYQRQQIRKIYEEIYQEELLKRLESELTGDFERSVYRWMLEPADRDAVLANVAIKSGSKGYHVIVEIACVLSSEELLAARRAYHNRYKRSLEEDVATHTSGDLRQLLVGLVTSYRYGGDEINARLAKTEADILHSSIKEKKGNHEEAIRILTTRSKTQLLATFNRYRDDHGTSITK

SEQ ID NO: 10603 - protein, 295 aa, Trigonella foenum-graecum
MDMRKRGRPEHGFNNNGGFKRSRQEMESLSTGVGSKSKPCTKFFSTSGCPFGESCHFLHHVPGGYNAVSQMMNLTPAAPPAPRNVAAPRNAHAPNGSAQSAVKSRICSKFNTAEGCKFGDKCHFAHGEWELGKPVAPSFDDHRHMGPPNAGRFGGHRMEPPPVPAASFGANATAKISVEASLAGAIIGKGGVNSKQICRQTGAKLAIRDHESDPNLRNIELEGTFEQIKDASNMVKDLLLTLQMSAPPKTNQGGHGAPGHHGNNLKTKLCENFAKGSCTFGDRCHFAHGAAELRK

SEQ ID NO: 10604 - protein, 295 aa, Glycine max
MDIRKRGRPEPGFSLNGGFKKSKQEMESLSTGVGSKSKPCTKFFSTAGCPFGEGCHFLHYVPGGYNAVAHMMNLTPAAPLPPTRNVAALPHVPNGSAPSAVKTRICNKFNTAEGCKFGDKCHFAHGEWELGKHIAPSFDDHRAMGPPGAGRLAGRMEPPGPAASFGANSTAKISVEASLAGAIIGKGGVNSKQICRQTGAKLSIREHESDPNLRNIELEGSFEQIKEASNMVKDLLLTLQMSAPPKTTPGVPGAPASHGSNFKTKLCENFAKGSCTFGDRCHFAHGASELRKSGV

SEQ ID NO: 10605 - protein, 295 aa, Glycine max
MDIRKRGRHETGFSLNGGFKRSKQEMESLSTGVGSKSKPCTKFFSTAGCPFGEGCHFLHYVPGGYNAVAHMMNLTPAAPPPPSRNVAALPHVPNGSAPSAVKTRICNKFNTAEGCKFGDKCHFAHGEWELGKHIAPSFDDHHAMGPPGAGRLAGRMEPPGPAASFGANSTAKISVEASLAGAIIGKGGVNSKQICRQTGAKLSIREHESDPNLRNIELEGSFEQIKEASNMVKDLLLTLQMSAPPKTTPGVPGAPASHGSNFKTKLCENFAKGSCTFGDRCHFAHGASELRKSGV

SEQ ID NO: 10606 - protein, 295 aa, Glycine max
MDTRKRGRPEPGFSLNGGFKKSKQEMESLSTGVGSKSKPCTKFFSTAGCPFGEGCHFLHYVPGGYNAVAHMMNLTPAAPPASRNVAALPPVPNGSAPPAVKTRICNKFNTAEGCKFGDKCHFAHGEWELGKHIAPSFDDHRTMGPTGVGRLAGRMEPPPGPAASFGANATAKISVEASLAGAIIGKGGVNSKQICRQTGAKLSIREHESDPNLRNIELEGSFEQIKEASNMVKDLLLTLQMSAPPKTTPGVPGAPASHGSNFKTKLCENFTKGSCTFGDRCHFAHGAAELRKSGV

SEQ ID NO: 10607 - protein, 130 aa, Zea mays
MPGRHHHHQQQQQLAAVAPKGCVTVRVGLEGEEQRRFAVPLGHLKHPLFGALLEEAEREYGFRHQGALAIPCRVDRFVQVEHLIGQDLRGTSCAQHLVDLDGALASGGGAHHHHQHHHLHLPRFVGCFRA

SEQ ID NO: 10608 - protein, 126 aa, Setaria italica
MHGKQQQQQQQMVPVAPKGCVTVRVGAEGEEQRRFAVPLGHLKHPLFGALLEEAEREYGFRHQGAIAIPCRVDRFVQVEHLIDQDLHGSCAQHLVDLDSAAAPPHHHHHHHHHHLHLPRFVGCFRA

SEQ ID NO: 10609 - protein, 328 aa, Saccharum officinarum
MDRPAGASYQRFPRVRIRDLKDDYAKFELRDTDASMANALRRVMIAEVPTVAIDLVEIEVNSSVLNDEFIAHRLGLIPLTSAAAMQMRFSRDCDACDGDGSCEYCSVEFHLAARATDSDQTLEVTSNDLRSMDPKVCPVDQARAYQQALGGTDPFGANTSNENRGILIVKLRRGQELRLRAIARKGIGKDHAKWSPAATVTFMYEPDIRINEELMETLTVEERKSLIESSPTKVFKLDSANQVVVDNAEAYTYDDEVIKHAEAMGKPGLIEINAKEDSFIFTVETTGAITAYELIMNAITVLRQKLDAVRLQDDDGDLGELGAHLGGP

SEQ ID NO: 10610 - protein, 328 aa, Zea mays
MDRPSGTSYQRFPRVRIRELKDDYAKFELRDTDASMANALRRVMIAEVPTVAIDLVEIEVNSSVLNDEFIAHRLGLIPLTSAAAMQMRFSRDCDACDGDGSCEYCSVEFHLSVHATDSDQTLEVTSNDLRSMDPKVCPVDQARAYQHALGGTDPFGANASNENRGILIVKLRRGQELRLRAIARKGIGKDHAKWSPAATVTFMYEPDIRINEELMETLTVEERISLIESSPTKVFELDSANQVVVKNAEAYTYDDEVIKHAEAIGKPGLVEITAKEDSFVFTVETTGAITAYELIMNAITVLRQKLDAVRLQDDDGDLGELGAHLGGP

SEQ ID NO: 10611 - protein, 330 aa, Oryza sativa
MERAAGGVSYQRFPRVRIRELKDDYAKFELRDTDASMANALRRVMIAEVPTVAIDLVEIEVNSSVLNDEFIAHRLGLIPLTSAAAMAMRFSRDCDACDGDGSCEYCSVEFHLAARATDSDQTLEVTSNDLRSTDPKVCPVDQARAYQHALGGTEPFDTAAAADQRGILIVKLRRGQELRLRAIARKGIGKDHAKWSPAATVTFMYEPEIRINEELMETLTLEEKRNLVESSPTKVFNIDPNTQQVVVEDAEAYTYDDEVIKKADAMGKPGLIEINAKEDSFIFTVETTGAITAYELIMNAITVLRQKLDAVRLQDDDADLGELGAHLVGG

SEQ ID NO: 10612 - protein, 327 aa, Panicum virgatum
MDRPAAGASYQRFPRVRIRELRDDYAKFELRDTDASIANALRRVMIAEVPTVAIDLVEIEVNSSVLNDEFIAHRLGLIPLTSAAAMQMRFSRDCDACDGDGSCEHCSVEFLLSARATDSDQTLEVTSNDLRSADPKVCPVDQARAYQQALNADFESTAGEHRGILIVKLRRGQELRLRAIARKGIGKDHAKWSPAATVTFMYEPDIHINEELMDTLTLDEKISWVESSPTKVFNLDPITKQVTVCDAEAYTYDDEVIKKAEAMGKPGLVEINAKEDSFIFTVETTGAITAYELIMNAITVLRQKLDAVRLQDDDGDLGELGAHLGGP

SEQ ID NO: 10613 - protein, 325 aa, Cenchrus ciliaris
MDHPAAGASYQRFPRVRIRELKDDYAKFELRDTDASIANALRRVMIAEVPTVAIDLVEIEVNSSVLNDEFIAHRLGLIPLTSAAAMQMRFSRDCDACDGDGSCEYCSVEFNLSARATDSDQTLEVTSNDLTSGDPKVCSVDQARAYQSALSGNVFDPNNERGILIVKLRRGQELRLRAIARKGIGKDHAKWSPAATVTFMYEPDIRINEELMDTLTFDEKRSWVESSPTKVFELSANGKVTVCDAEAYTYDDEVIKKAEAMGKPGLVEINAKEDSFIFTVETTGAITAYELIMNAITVLRQKLDAIRLQDDDGDLGELGAHLGGP

SEQ ID NO: 10614 - protein, 325 aa, Pennisetum glaucum
MDRPAAGASYQRFPRVRIRELKEDYAKFELRDTDASIANALRRVMIAEVPTVAIDLVEIEVNSSVLNDEFIAHRLGLIPLTSAAAMQMRFSRDCDACDGDGSCEYCSVEFNLSARATDSDQTLEVTSNDLTSTDPKVCSVDQARAYQLALSGNGYDPNNERGILIVKLRRGQELRLRAIARKGIGKDHAKWSPAATVTFMYEPDIRINEELMDTLTFDEKRSWVESSPTKVFELSANGKVTVCDGEAYTYDDEVIKKAEAMGKPGLVEINAKEDSFIFTVETTGAITAYELIMNAITVLRQKLDAVRLQDDDGDLGELGAHLGGP

SEQ ID NO: 10615 - protein, 325 aa, Setaria italica
MDRPAAGSSYQRFPRVRIRELKDDYAKFELRDTDASIANALRRVMIAEVPTVAIDLVEIEVNSSVLNDEFIAHRLGLIPLTSAAAMQMRFSRDCDACDGDGSCEYCSVEFNLSARATDSDQTLEVTSNDLRSADPKVCPVDQARAYQLALSGNDYDPNAERGILIVKLRRGQELRLRAIARKGIGKDHAKWSPAATVTFMYEPDILINEELMDTLTFDEKRSWVESSPTKVFDLSANGKVTVCDAEAYTYDDEVIKKAEAMGKPGLVEINAKEDSFIFTVETTGAITAYELIMNAITVLRQKLDAIGLQDDDGDLGELGAHLGGP

SEQ ID NO: 10616 - protein, 331 aa, Leymus cinereus x Leymus triticoides
MERPAAGASYQRFPRVRIRELKDEYAKFELRDTDASMANALRRVMIAEVPTVAIDLVEIESNSSVLNDEFIAHRLGLIPLTSSAAMSMRFSRDCDACDGDGSCEYCSVEFHLAARATDSGQTLEVTSTKDLRSTDPKVCPVDQARELQQALGNGDMYEPDAAGDHRGILIVKLRRGQELRLRAIARKGIGKDHAKWSPAATVTFMYEPDIRINQELMETLTLEEKQSWVESSPTKVFDIDPVTQQVMIVDPEAYTYDDEVIKKAEAMGKPGLVEINAKEDSFVFTVETTGAITAYELIMNAITVLRQKLDAVRLQDDDGDLGELGAHLIGG

SEQ ID NO: 10617 - protein, 331 aa, Triticum aestivum
MERSAAGASYQRFPRVRIRELKDEYAKFELKDTDASMANALRRVMIAEVPTVAIDLVEIESNSSVLNDEFLAHRLGLIPLTSSAAMSMRFSRDCDACDGDGSCEYCSVEFHLAARATDSGQTLEVTSTKDLRSTDPKVCPVDQQREYQQALGNVDAYEPDAAGDHRGILIVKLRRGQELRLRAIARKGIGKDHAKWSPAATVTFMYEPDIRINQELMETLTLEEKQSWVESSPTKVFDIDPVTQQVTIVDPEAYTYDDEVIKKAEAMGKPGLVEINAKEDSFVFTVETTGAITAYELIMNAITVLRQKLDAVRLQDDDGDLGELGAHLIGG

SEQ ID NO: 10618 - protein, 331 aa, Hordeum vulgare
MERSAAGASYQRFPRVRIRELKDEYAKFELKDTDASMANALRRVMIAEVPTVAIDLVEIESNSSVLNDEFLAHRLGLIPLTSSGAMSMRFSRDCDACDGDGSCEHCSVEFHLAARATDSGQTLEVTSTKDLRSTDPKVCPVDQQREYQQALGNVDAYEPDAAGDHRGILIVKLRRGQELRLRAIARKGIGKDHAKWSPAATVTFMYEPDIRINQELMETLTLEEKQSWVESSPTKVFDIDPVTQQVTIVDAEAYTYDDEVIKKAEAMGKPGLVEINAKEDSFVFTVETTGAITAYELIMNAITVLRQKLDAVRLQDDDGDLLDLGAHLTGG

SEQ ID NO: 10619 - protein, 330 aa, Brachypodium distachyon
MDRSAAGVSYQRFPRVRIRELKDDYAKFELRDTDASMANALRRVMIAEVPTVAIDLVEIESNSSVLNDEFIAHRLGLIPLTSSGAMGMRFSRDCDACDGDGSCEHCSVEFHLAARATDANKTLEVTSNDLRSTDPKVCPVDQAMAYQQAIGTADPYDTSTASDHRGILIVKLRRGQELRLRAIARKGIAKDHAKWSPAATVTFMYEPDIRINEELMETLTLEEKTSWVESSPTKVFDIDPNTQQVVVVDREAYTYDDEVIKKAEAMGKPGLIEISAKEDSFVFTVETTGAITAYELIINAITVLRQKLDAVRLQEEDGDFTGLDAHLGVA

SEQ ID NO: 10620 - protein, 408 aa, Zea mays
MYGAPLPKDLNLPAALPQPTRTPPQQQMGSPGLLRYRSAPSTLLGEVMCGGDQDFPAAGGAGHGPPDHAAADNVLARFLAGHHSETRDCKPPRPAAAAHFMDEAAVASMAASQQQQLMYQSQQEQQMAAMEGLYRNVSSGGTEHGAAVGAGNNSLIRQSSSPAGFLNHLNMDNGYGSMLRVGMGGGGFRNGVSDARLKGQLSFSSRQGSVMSQISEVGSEELDGGGGSGSPEAAGSNASGAARGYSGIPGYPMGGLASGAWPDEASPSPTSGAKRPRDSGPALQQPLAPQLSLPSGKNKGGRAASAEMAAIEKFLQFQDAVPCKIRAKRGCATHPRSIAERVRRTKISERIRKLQELVPNMEKQTNTADMLDLAVDYIKDLQKQVKVLNDGRASCTCSAGELQGQFTR

SEQ ID NO: 10621 - protein, 406 aa, Zea mays
MYGAPVPKDLNLPAALPQPTRAGARTPPQQQQQMSSAGLLRYRSAPSTLLGEVMCGDQDFPATDGGGGHGPPDHAATDNVLALFLAGHHSEARDCKPPRPAAAAHFMDEAAASQQQQLMYQSQQQQQMAAMEGLYHNVSSGGTEHGAGVGAGNNSLIRQSSSPAGFLTNGYGGMLRAGMGMAGGFRNGVSDARLKGQLSFPSRQGSVMSQISEVGSEELDGGGGGSPEAAGSNASGAPRGYVGIPGYPMGGGTSGAWSDEPSPSPTSGAKRRPRDSGPAPQNVQQQPLAPQLSLPSGGKPASAEMAAIEKFLQFQDAVPCKIRAKRGCATHPRSIAERVRRTKISERIRKLQELVPNMEKQTNTADMLDLAVDYIKDLQKQVKVLNDGRANCTCSGGGKLQDPFTS

SEQ ID NO: 10622 - protein, 397 aa, Setaria italica
MYGSPVPKDLNLPAAQPQPTRTPPPPQMSSPGLLRYRSAPSTLLGEVMCGDQEFPGAAGHGPDHAAADSVLARFLAGHHPEIPDCKPPRPVAAAHFMEDAASMAASQQQQQLMYQSQQQMAAMEGLYRSVSSGCTEPGATVGAGNSLLRQSSSPAGFLNHLNMDNGYGNMLRAGMAGAGGFRNGVSDARLKGQLSFSSRQGSVMSQISEVGSEELDGGSSPEAAGSNGAPRSYSGIPGGYPMGAWPDESSPTSSGAKRPRDSGGPAPQNGQRQPLAPQLSVPGGSNGTGKPASAEMAAIEKFLQFQDAVPCKIRAKRGCATHPRSIAERVRRTKISERIRKLQELVPNMEKQTNTADMLDLAVDYIKDLQKQVKVLNDGRISCTCSAGKLLQNQFAS

SEQ ID NO: 10623 - protein, 116 aa, Setaria italica
MDNVESAPDSPAQAPPSSASSLPKEQSQVELELRLLQALEFYPPSKLKGVHRHFVLYGLMEYLRKSLDRQFSADEVLQLLDRFFNLEMLKPEDDEKDNFSQGEEFSLPESFFNKEE

SEQ ID NO: 10624 - protein, 116 aa, Zea mays
MDNVESAPDSPAQAPPSSASSLPKEQSQVELELRLLQALEFYPPSKLKGVHRHFVLYGLMEYLRKSLDRQFSSDEVLQLLDRFFNLEMLKPEDDEKDNFRQGEEFSLPESFLNKEE

SEQ ID NO: 10625 - protein, 116 aa, Saccharum officinarum
MDNVESAPDSPAQAPPSSASSLPKEQSQVELELRLLQALEFYPPSKLKGIHRHFVLYGLMEYLRKSLDRQFSSDEVLQLLDRFFNLEMLKPEDDEKDNFNQGEEFSLPENFLNKEE

SEQ ID NO: 10626 - protein, 116 aa, Panicum virgatum
MDNVESAPDSPVQAPPSSASSLPKEQSQVELELRLLQALEFYPPSKLKGVHRHFVLYGLMEYLRKCLDRQFSSDEVLQLLDRFFNLEMLKPEDDEKDNFSQGGEFSLPESFLNKEE

SEQ ID NO: 10627 - protein, 88 aa, Pennisetum glaucum
MDNVESAPDSPAHAPPSSASSLPKEQSQVELELRLLQALEFYPPSKLKGVHRHFVLYGLMEYLRKSLDRQFSADEILQLLDRFFNLEC

SEQ ID NO: 10628 - protein, 122 aa, Oryza sativa
MEAAADEEQEGISAQSPAQAPPSSASSLPKEQSQVELELRVLQALEFYPPSKLKGIHRHFVIYGLMEYLRKSLDRQFSADEVLQLLDRFFNLEMLKPEDDEKDNFTQGEEFSLPESFFNKDE

SEQ ID NO: 10629 - protein, 120 aa, Brachypodium distachyon
MEAAADEEQEGLSAQAPPSSASSLPKEQSQVELELRLLQALEFYPPSKLKGIHRHFVLYGLMEYLRKSLDRQFSADEVLQLLDRFFNLEMLKPDDDEKDSFSQAEFSLPDKFFKKEKKEE

SEQ ID NO: 10630 - protein, 71 aa, Glycine max
MAGAAPKQLFGFGVVAMLATLILALFMPAAVQAQSASPAPAPTSDGTSLDQGIAYVLMLLALVLTYIIHSP

SEQ ID NO: 10631 - protein, 81 aa, Cajanus cajan
MQGPKYSFGFGVVAMLATLILALFLMPAAVHAQIQAPAPAPTSDGPSLDQGIAYVLMLLALVLTYIIHTAEIPLQLLSLLS

SEQ ID NO: 10632 - protein, 65 aa, Phaseolus coccineus
MDSQVKHALVVKVMGRTGSRGQVTQVRVKFLDDQNRHIMRNVKGPVREGDILTLLESEREARRLR

SEQ ID NO: 10633 - protein, 65 aa, Cyamopsis tetragonoloba
MESQVKHALVVKVMGRTGSRGQVTQVRVKFLDDQNRFIMRNVKGPVREGDILTLLESEREARRLR

SEQ ID NO: 10634 - protein, 65 aa, Unknown
  Sequence found in Organisms: Glycyrrhiza uralensis, Cajanus cajan
MESQVKHAIVVKVMGRTGSRGQVTQVRVKFLDDQNRHIMRNVKGPVREGDILTLLESEREARRLR

SEQ ID NO: 10635 - protein, 81 aa, Vigna unguiculata
KAAAATPSLFLFLNIRMESQVKHAIVVKVMGRTGSRGQVTQVRVKFLDDQNRHIMRNVKGPVREGDILTLLESEREARRLR

SEQ ID NO: 10636 - protein, 65 aa, Cucurbita pepo
MESQIKHALVVKVMGRTGSRGQVTQVRVKFLDDQNRYIMRNVKGPVREGDILTLLESEREARRLR

SEQ ID NO: 10637 - protein, 65 aa, Unknown
  Sequence found in Organisms: Cicer arietinum, Medicago truncatula, Trigonella foenum-graecum
MESQIKHAVVVKVMGRTGSRGQVTQVRVKFLDDQNRHIMRNVKGPVREGDILTLLESEREARRLR

SEQ ID NO: 10638 - protein, 65 aa, Phaseolus coccineus
MDSQVKHAIVVKVMGRTGSRGQVTQVRVKFLDDQNRHIMRNVKGPVREGDILTLLESEREARRLR

SEQ ID NO: 10639 - protein, 65 aa, Unknown
  Sequence found in Organisms: Castanea mollissima, Quercus alba, Juglans hindsii x Juglans regia
MESQVKHAVVVKVMGRTGSRGQVTQVRVKFLDDQNRFIMRNVKGPVREGDILTLLESEREARRLR

SEQ ID NO: 10640 - protein, 65 aa, Lotus japonicus
MESQVKHAIVVKIMGRTGSRGQVTQVRVKFLDDQNRHIMRNVKGPVREGDILTLLESEREARRLR

SEQ ID NO: 10641 - protein, 65 aa, Unknown
  Sequence found in Organisms: Rosa hybrid cultivar, Fragaria vesca
MESTVKHALVVKVMGRTGSRGQVTQVRVKFLDDQNRFIMRNVKGPVREGDILTLLESEREARRLR

SEQ ID NO: 10642 - protein, 65 aa, Unknown
  Sequence found in Organisms: Cucumis sativus, Cucurbita pepo, Cucumis melo, Momordica charantia, Citrullus lanatus
MESQIKHAVVVKVMGRTGSRGQVTQVRVKFLDDQNRYIMRNVKGPVREGDILTLLESEREARRLR

SEQ ID NO: 10643 - protein, 65 aa, Unknown
  Sequence found in Organisms: Fagopyrum esculentum, Tripterygium wilfordii
MDSQIKHALVVKVMGRTGSRGQVTQVRVKFLDDQNRFIMRNVKGPVREGDILTLLESEREARRLR

SEQ ID NO: 10644 - protein, 65 aa, Linum usitatissimum
MESQTKHALVVKVMGRTGSRGQVTQVRVKFLDDPNRFIMRNVKGPVREGDILTLLESEREARRLR

SEQ ID NO: 10645 - protein, 65 aa, Humulus lupulus
MESQIKHAVVVKVMGRTGSRGQVTQVRVKFLDDQNRFIMRNVKGPVREGDILTLLESEREARRLR

SEQ ID NO: 10646 - protein, 65 aa, Acacia harpophylla
MESQVKHAVVVKVMGRTGSRGQVTQVRVKFLDDHNRYIMRNVKGPVREGDILTLLESEREARRLR

SEQ ID NO: 10647 - protein, 65 aa, Panax ginseng
MESQLKHALVVKVMGRTGSRGQVTQVRVKFLDDQNRFIMRNVKGPVREGDVLTLLESEREARRLR

SEQ ID NO: 10648 - protein, 64 aa, Lotus japonicus
MESQVKHAIVVKIMGRTGSRGQVTQVRVKFLDDQNRHIMRNVKGPVREDILTLLESEREARRLR

SEQ ID NO: 10649 - protein, 65 aa, Lotus japonicus
MESQVKHAIVVKIMGRTGPRGQVTQVRVKFLDDQNRHIMRNVKGPVREGDILTLLESEREARRLR

SEQ ID NO: 10650 - protein, 65 aa, Vitis vinifera
MESGVKHAVVVKVMGRTGSRGQVTQVRVKFLDDQNRFIMRNVKGPVREGDILTLLESEREARRLR

SEQ ID NO: 10651 - protein, 82 aa, Cyamopsis tetragonoloba
MQNEEGQTTELYIPRKCSATNRLITSKDHASVQINIGHLDENGVYNGHFSTFALCGFIRAQGDADSALDRLWQKKKVETKQQ

SEQ ID NO: 10652 - protein, 87 aa, Vitis vinifera
SEAAVSAPSLSSSRRLLSSQCKMESGVKHAVVVKVMGRTGSRGQVTQVRVKFLDDQNRFIMRNVKGPVREGDILTLLESEREARRLR

SEQ ID NO: 10653 - protein, 68 aa, Phaseolus coccineus
MDSQVKHALVVKVMGRTGSRGQVTQVRVKFLDDQNRHIMRNVKGPVREGDILTLLESEREARRLRYMV

SEQ ID NO: 10654 - protein, 130 aa, Ambrosia trifida
MATAVMSSLPQFTGLKATSSSSSPVQSMVSLKPMKPKGKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 10655 - protein, 52 aa, Phaseolus coccineus
MGRTGSRGQVTQVRVKFLDDQNRPIMRNVKGPVREGDILTLLESEREARRLR

SEQ ID NO: 10656 - protein, 444 aa, Mesembryanthemum crystallinum
MVTIKCVKARQIYDSRGNPTVEADIHLDDGTYARAAVPSGASTGVYEALELRDGGKDYMGKGVYKAVKNVNEIIGPALVGKDPTQQTAIDNFMVQQLDGTVNEWGWCKQKLGANAILAVSLAVCKAGAQVKKIPLYQHIAEIAGNKNMVLPVPAFNVINGGSHAGNKLAMQEFMILPTGASSFKEAMKMGSEVYHNLKSVIKKKYGQDATNVGDEGGFAPNIQENKEGLELLKTAIEKAGYTGKVVIGMDVAASEFYKEDKSYDLNFKEENNDGSQRISGEALKDLYKSFVAEYPIVSIEDPFDQDDWEHYAKMTAECGEKVQIVGDDLLVTNPKRVKKAIDENSCNALLLKVNQIGSVTESIEAVKMSKKAGWGVMASHRSGETEDTFIADLSVGLSTGQIKTGAPCRSERLAKYNQLLRIEEELGDKAVYAGANFRRPVEPY

SEQ ID NO: 10657 - protein, 68 aa, Cajanus cajan
MVSQDSVKQCLFLWLVSRRHYFYYSGSILYSYCDLSFDVIELPEFSVKLCFEFYILLYLFCSVFSKIM

SEQ ID NO: 10658 - protein, 65 aa, Unknown
  Sequence found in Organisms: Ambrosia trifida, Arnica chamissonis, Artemisia annua, Centaurea maculosa, Cichorium intybus, Cirsium arvense, Cynara scolymus, Taraxacum officinale, Gerbera hybrid cultivar, Lactuca sativa, Helianthus annuus
MESQIKHAVVVKVMGRTGSRGQVTQVRVKFLDDQNRFIMRNVKGPVREGDVLTLLESEREARRLR

SEQ ID NO: 10659 - protein, 65 aa, Unknown
  Sequence found in Organisms: Amorphophallus konjac, Liriodendron tulipifera, Nuphar advena
MDSQVKLAVVVKVMGRTGSRGQVTQVRVKFLDDQNRLIMRNVKGPVREGDILTLLESEREARRLR

SEQ ID NO: 10660 - protein, 65 aa, Unknown
  Sequence found in Organisms: Cannabis sativa, Humulus lupulus
MDSQVKHAVVVKIMGRTGSRGQVTQVRVKFLDDQNRFIMRNVKGPVREGDILTLLESEREARRLR

SEQ ID NO: 10661 - protein, 65 aa, Unknown
  Sequence found in Organisms: Citrus sinensis, Citrus clementina, Citrus sinensis
MDSQIKHAVVVKVMGRTGSRGQVTQVRVKFLDDQNRFIMRNVKGPVREGDILTLLESEREARRLR

SEQ ID NO: 10662 - protein, 65 aa, Cucurbita pepo
MESQIKHAVVVKVMGRTGSRGQVTQVRVKFIDDQNRYIMRNVKGPVREGDILTLLESEREARRLR

SEQ ID NO: 10663 - protein, 65 aa, Euonymus alatus
MDSQIKHALVVKVMGRTGSRGQVTQVRVKFIDDQNRFIMRNVKGPVREGDILTLLESEREARRLR

SEQ ID NO: 10664 - protein, 65 aa, Sarracenia psittacina
MESQIKHAIVVKVMGRTGSRGQVTQVRVKFVDDQNRHIMRNVKGPVREGDVLTLLESEREARRLR

SEQ ID NO: 10665 - protein, 65 aa, Unknown
  Sequence found in Organisms: Scabiosa columbaria, Valeriana officinalis
MESQIKHAIVVKVMGRTGSRGQVTQVRVKFLDDQNRFIMRNVKGPVREGDVLTLLESEREARRLR

SEQ ID NO: 10666 - protein, 65 aa, Unknown
  Sequence found in Organisms: Brassica juncea, Theobroma cacao
MDSQIKHAVVVKVMGRTGSRGQVTQVRVKFLDDQNRYIMRNVKGPVREGDILTLLESEREARRLR

SEQ ID NO: 10667 - protein, 65 aa, Phaseolus coccineus
MDSQVKHALVVKVMGRTGSRGQVPQVRVKFLDDQNRPIMRNVKGPVREGDILPLLESEREARRLR

SEQ ID NO: 10668 - protein, 65 aa, Phaseolus coccineus
MDSQVKHALVVKVMGRTGSRGQVTQVRVKFLDDQNRPIMRNVKGPVREGDIFPLLESEREARRLR

SEQ ID NO: 10669 - protein, 65 aa, Actinidia deliciosa
MESQIKHAIVVKVMGRTGSRGQVTQVRVKFLDDQNRYIMRNVKGPVREGDVLTLLESEREARRLR

SEQ ID NO: 10670 - protein, 65 aa, Prunus persica
MDSTVKHAVVVKVMGRTGSRGQVTQVRVKFLDDQNRFIMRNVKGPVREGDILTLLESEREARRLR

SEQ ID NO: 10671 - protein, 65 aa, Prunus persica
MESTIKHAVVVKVMGRTGSRGQVTQVRVKFLDDQNRFIMRNVKGPVREGDILTLLESEREARRLR

SEQ ID NO: 10672 - protein, 73 aa, Sarracenia psittacina
SSFSPAAAHPLFLPLIIYDLVRCVSLVRMESQIKHAIVVKVMGRTGSRGQVTQVRVKFVDDQNRHIMRNVKGP

SEQ ID NO: 10673 - protein, 52 aa, Phaseolus coccineus
MGRTGSRGQVPQVRVKFLDDQNRPIMRNVKGPVREGDILPLLESEREARRLR

SEQ ID NO: 10674 - protein, 52 aa, Phaseolus coccineus
MGRSGSRGQVTQVRVKFLDDQNRPIMRNVKGPVREGDILPLLESEREARRLR

SEQ ID NO: 10675 - protein, 55 aa, Eschscholzia californica
MLKGRFVKVTFSHSSSLKEKQGGFDEVTYISVCYMILDIYKFDWGFVFLKLEPLS

SEQ ID NO: 10676 - protein, 84 aa, Zingiber officinale
  misc_feature (18)..(19): Xaa can be any naturally occurring amino acid
FWSLDRRQRPREQRAANXXMDSQAKLAVVVKVMGRTGSRGQVTQVRVKFLDDQNRLIMRNVKGPVREGDILTLLESEREARRLR

SEQ ID NO: 10677 - protein, 87 aa, Nicotiana benthamiana
TPPLTLLLSSKISFCFSEGIKAMESATKHAIVVKVMGRTGSRGQVTQVRVKFLDDQNRFIMRNVKGPVREGDVLTLLESEREARRLR

SEQ ID NO: 10678 - protein, 89 aa, Carica papaya
LHSSNRRISAFSSSLAISCDLRHKMDSQIKHAVVVKVMGRTGSRGQVTQVRVKFLDDQNRFIMRNVKGPVREGDVLTLLESEREARRLR

SEQ ID NO: 10679 - protein, 610 aa, Oryza sativa
MGLSISYPPDDYLPTEEDTDQMFVRSLSSDNLSTIETFESPPALLDSLSSQRPIIKESFNFKKSEGDPFHVETTVSLMSPKPGKEKSCTHKRTILPRYGSMEYLPPHSPVVGMISPKHQAAAVRVQKVYKSFRTRRQLADCAVLVEQRWWKLIDFALLKHNSVSFFEEEKPESALSRWSRARTKAAKVGKGLSKDEKAQKLALQHWLEAIDPRHRYGHNLHYYYQHWLHCESKQPFFYWLDVGEGKDVSMEDHCPRWKLLQQCIRYLGPKEREFYEVVIENKKLLYKMSRKIVDTSEGPKNSKWIFVLSTTRVLYIGTKSKGTFQHSSFLAGGATSAAGRLVVDNGILKAVWPHSGHYRPTEANFREFMMYLKKRNVDLANIKLSPSEDEEDECLRSRSGRSQLEPTEPGKPEKEEDATADDNGTTTVAAQAAPPSTTGGEPATPVMKRSSSGNRLQRKRPPRLTLDKSRLAKGVAEQDAGSFGDRLDFCKVNLFRGGEEAEEAVVVPQEKILRRLNSRMTMNSYQLGKQLSLRWTTGAGPRIGCVRDYPPELQFRVMEQISLTPRGGAGPLRLGSTATPRQSPCAPLPSPAPLYAAAGTPTSLLQHGAA

SEQ ID NO: 10680 - protein, 89 aa, Secale cereale
CARAAASVVVAEATTPRRQPAEQSMDTQVKLAVVVKVMGRTGSRGQVTQVRVKFLDDQNRLIMRNVKGPVREGDILTLLESEREARRLR

SEQ ID NO: 10681 - protein, 84 aa, Euphorbia esula
  misc_feature (4)..(4): Xaa can be any naturally occurring amino acid
NLRXSAALSLGVLLSHSSRMDSTIKHALVVKVMGRTGSRGQVTQVRVKFLDDQNRFIMRNVKGPVREGDVLTLLESEREARRLR

SEQ ID NO: 10682 - protein, 109 aa, Triticum aestivum
PRVRDCSTRTLTWTEGVETLLSPLPAPPPPSVVAEAACAASSVVPSPTAEESMDTQVKLAVVVKVMGRTGSRGQVTQVRVKFLDDQNRLIMRNVKGPVREGDILTLLRV

SEQ ID NO: 10683 - protein, 65 aa, Malus domestica
MESTIKHAVVIKVMGRTGSRGQVTQVRVKFLDDQNRFIMRNVKGPVREGDILTLLESEREARRLR

SEQ ID NO: 10684 - protein, 64 aa, Arnica chamissonis
ESQIKHAVVVKVMGRTGSRGQVTQVRVKFLDDQNRFIMRNVKGPVREGDVLTLLESEREARRLR

SEQ ID NO: 10685 - protein, 65 aa, Cannabis sativa
MDSQIKHAVVVKIMGRTGSRGQVTQVRVKFLDDQNRFIMRNVKGPVREGDILTLLESEREARRLR

SEQ ID NO: 10686 - protein, 65 aa, Unknown
  Sequence found in Organisms: Ricinus communis, Coffea canephora, Hevea brasiliensis, Jatropha curcas
MDSQIKHAVVVKVMGRTGSRGQVTQVRVKFLDDQNRFIMRNVKGPVREGDVLTLLESEREARRLR

SEQ ID NO: 10687 - protein, 65 aa, Euphorbia peplus
MDSTIKHALVVKVMGRTGSRGQVTQVRVKFLDDQNRFIMRNVKGPVREGDVLTLLESEREARRLR

SEQ ID NO: 10688 - protein, 64 aa, Unknown
  Sequence found in Organisms: Euphorbia peplus, Euphorbia esula
ESHIKHAVVVKVMGRTGSRGQVTQVRVKFLDDQNRYIMRNVKGPVREGDILTLLESEREARRLR

SEQ ID NO: 10689 - protein, 65 aa, Flaveria ramosissima
MESQIKHAVVVKIMGRTGSRGQVTQVRVKFLDDQNRFIMRNVKGPVREGDVLTLLESEREARRLR

SEQ ID NO: 10690 - protein, 65 aa, Linum usitatissimum
MESGIKHALVVKVMGRTGSRGQVTQVRVKFIDDPNRFIMRNVKGPVREGDILTLLESEREARRLR

SEQ ID NO: 10691 - protein, 65 aa, Unknown
  Sequence found in Organisms: Zea mays, Pennisetum glaucum, Oryza sativa, Sorghum bicolor, Persea americana, Hordeum vulgare, Cynodon dactylon, Setaria italica and additional organisms as disclosed in Tables 53 and 54
MDTQVKLAVVVKVMGRTGSRGQVTQVRVKFLDDQNRLIMRNVKGPVREGDILTLLESEREARRLR

SEQ ID NO: 10692 - protein, 65 aa, Vitis vinifera
MESGVKHAMVVKVMGRTSSRGQVTQMRVKFLDDQNRFIMRNVKGPVREGDILTLLESEREARRLR

SEQ ID NO: 10693 - protein, 65 aa, Platanus occidentalis
MDSQVKLAVVVKVMGRTGSRGQVTQVRVKFLDDQNRLIMRNVKGPVREGDVLTLLESEREARRLR

SEQ ID NO: 10694 - protein, 65 aa, Pteridium aquilinum
MDSQIKHAVVVKVMGRTGSRGQVTQVRVKFLDDQNRYIMRNVKGQVREGDILTLLESEREARRLR

SEQ ID NO: 10695 - protein, 65 aa, Vinca minor
MDSTTKHAIVVKVMGRTGSRGQVTQVRVKFLDDQNRFIMRNVKGPVREGDILTLLESEREARRLR

SEQ ID NO: 10696 - protein, 65 aa, Amborella trichopoda
MDTQVKLAVVVKVMGRTGSRGQVTQVRVKFLDDQNRFIMRNVKGPVREGDILTLLESEREARRLR

SEQ ID NO: 10697 - protein, 65 aa, Unknown
  Sequence found in Organisms: Antirrhinum majus, Mimulus guttatus, Salvia sclarea
MESQIKHAVVVKVIGRTGSRGQVTQVRVKFIDDQNRFIMRNVKGPVREGDILTLLESEREARRLR

SEQ ID NO: 10698 - protein, 65 aa, Artemisia annua
MESQIKHAVVVTVMGRTGSRGQVTQVRVKFLDDQNRFIMRNVKGPVREGDVLTLLESEREARRLR

SEQ ID NO: 10699 - protein, 65 aa, Phaseolus coccineus
MDSQVKHALVVKVMGRTGSRGQVPQVRVKFLDDQNRPLMRNVKGPVREGDILPLLESEREARRLR

SEQ ID NO: 10700 - protein, 65 aa, Phaseolus coccineus
MDFQVKHALVVKVMGRTGSRGQVPQVRVKFLDDQNRPIMRNVKGPVREGDILPLLESEREARRLR

SEQ ID NO: 10701 - protein, 65 aa, Phaseolus coccineus
MDSQVKHALVVKVMGRTGSRGQVPQVRVKFLDDQNRPIMRNVKGPVREGAILPLLESEREARRLR

SEQ ID NO: 10702 - protein, 65 aa, Phaseolus coccineus
  misc_feature (14)..(14): Xaa can be any naturally occurring amino acid
  misc_feature (37)..(37): Xaa can be any naturally occurring amino acid
MDSQVKHALVVKVXGRTGSRGQVPQVRVKFLDDQNRXIMRNVKGPVREGDILPLLESEREARRLR

SEQ ID NO: 10703 - protein, 65 aa, Phaseolus coccineus
MDFQVKHAFVVKVMGRTGSRGQVPQVRVKFLDDQNRHIMRNVKGPVREGDIFTLLESEREARRLR

SEQ ID NO: 10704 - protein, 65 aa, Unknown
  Sequence found in Organisms: Beta vulgaris, Mesembryanthemum crystallinum
MESQIKHAVVIKCMGRTGSRGQVTQVRVKFLDDQNRFIMRNVKGPVREGDILTLLESEREARRLR

SEQ ID NO: 10705 - protein, 65 aa, Unknown
  Sequence found in Organisms: Bruguiera gymnorhiza, Rhizophora mangle
MDSGIKHAVVVKVMGRTGSRGQVTQVRVKFLDDQNRFIMRNVKGPVREGDILTLLESEREARRLR

SEQ ID NO: 10706 - protein, 65 aa, Cyamopsis tetragonoloba
HEAQVKHAVVVKVMGRTGSRGQVTQVRVKFLDDQNRFIMRNVKGPVREGDVLTLLESEREARRLR

SEQ ID NO: 10707 - protein, 65 aa, Solanum melongena
MESQIKHAIVVKIMGRTGSRGQVTQVRVKFMDDQNRFIMRNVKGPVREGDILTLLESEREARRLR

SEQ ID NO: 10708 - protein, 65 aa, Zingiber officinale
MDSQAKLAVVVKVMGRTGSRGQVTQVRVKFLDDQNRLIMRNVKGPVREGDILTLLESEREARRLR

SEQ ID NO: 10709 - protein, 65 aa, Vitis vinifera
MDAGVKHAVVVKVMGRTGSRGQVTQVRVKFLDDQNRFIMRNVKGPVREGDILTLLESEREARRLR

SEQ ID NO: 10710 - protein, 65 aa, Heritiera littoralis
MDSQIKHAVVVKIMGRTGSRGQVTQVRVKFLDDQNRYIMRNVKGPVREGDILTLLESEREARRLR

SEQ ID NO: 10711 - protein, 65 aa, Unknown
  Sequence found in Organisms: Ipomoea batatas, Ipomoea nil, Camellia sinensis
MESQIKHAIVVKVMGRTGSRGQVTQVRVKFIDDQNRFIMRNVKGPVREGDVLTLLESEREARRLR

SEQ ID NO: 10712 - protein, 65 aa, Actinidia deliciosa
  misc_feature (62)..(62): Xaa can be any naturally occurring amino acid
MESQIKHAVVVKVMGRTGSRGQVTQVRVKFLDDQNRYIMRNVKGPVREGDVLTLLESEREAXRLR

SEQ ID NO: 10713 - protein, 65 aa, Unknown
  Sequence found in Organisms: Eragrostis curvula, Ananas comosus
MDAQVKLAVVVKVMGRTGSRGQVTQVRVKFLDDQNRLIMRNVKGPVREGDILTLLESEREARRLR

SEQ ID NO: 10714 - protein, 65 aa, Unknown
  Sequence found in Organisms: Nicotiana benthamiana, Orobanche aegyptiaca, Nicotiana tabacum
MESATKHAIVVKVMGRTGSRGQVTQVRVKFLDDQNRFIMRNVKGPVREGDVLTLLESEREARRLR

SEQ ID NO: 10715 - protein, 65 aa, Arachis hypogaea
MDTGIKHAIVVKVMGRTGSRGQVTQVRVKFLDDQNRHIMRNVKGPVREGDILTLLESEREARRLR

SEQ ID NO: 10716 - protein, 65 aa, Capsicum annuum
MESCTKHAVVVKIMGRTGSRGQVTQVRVKFLDDQNRFIMRNVKGPVREGDILTLLESEREARRLR

SEQ ID NO: 10717 - protein, 65 aa, Podocarpus macrophillus
MDSQVKLAVVVKVIGRTGSRGQVTQVRVKFLDDQNRLIMRNVKGPVREGDILTLLESEREARRLR

SEQ ID NO: 10718 - protein, 65 aa, Prunus persica
MDSTIKHAVVVKVMGRTGSRGQVTQVRVKFLDDQNRFIMRNVKGPVREGDILTLLESEREARRLR

SEQ ID NO: 10719 - protein, 65 aa, Carthamus tinctorius
MESLIKHAVVVKVMGRTGSRGQVTQVRVKFLDDQNRFIMRNVKGPVREGDVLTLLESEREARRLR

SEQ ID NO: 10720 - protein, 65 aa, Salvia sclarea
MESQIKHTVVVKVIGRTGSRGQVTQVRVKFLDDQNRFIMRNVKGPVREGDILTLLESEREARRLR

SEQ ID NO: 10721 - protein, 65 aa, Senecio madagascariensis
MESQIKHAVVIKVMGRTGSRGQVTQVRVKFLDDQNRFIMRNVKGPVREGDVLTLLESEREARRLR

SEQ ID NO: 10722 - protein, 65 aa, Solanum phureja
MESVTKHAIVIKVMGRTGSRGQVTQVRVKFLDDQNRFIMRNVKGPVREGDILTLLESEREARRLR

SEQ ID NO: 10723 - protein, 65 aa, Helianthus annuus
MESQIKHAVVVKVMGRTGSRGQVTQVRVKFLDDQNRFIMRNVKGPVREGDVLTLLEAEREARRLR

SEQ ID NO: 10724 - protein, 65 aa, Tragopogon dubius
MESQIKHAVVVKVMGRTGSRGQVTQVRVKFIDDQNRFIMRNVKGPVREGDVLTLLESEREARRLR

SEQ ID NO: 10725 - protein, 65 aa, Aquilegia formosa
MDSQVKNAVVVKVMGRTGSRGQVTQVRVKFIDDQNRLIMRNVKGPVREGDILTLLESEREARRLR

SEQ ID NO: 10726 - protein, 66 aa, Carica papaya
RMDSQIKHAVVVKVMGRTGSRGQVTQVRVKFLDDQNRFIMRNVKGPVREGDVLTLLESEREARRLR

SEQ ID NO: 10727 - protein, 65 aa, Unknown
  Sequence found in Organisms: Amsonia hubrichtii, Catharanthus roseus, Lippia dulcis, Tabernaemontana elegans
MDSQIKHAIVVKVMGRTGSRGQVTQVRVKFIDDQNRFIMRNVKGPVREGDVLTLLESEREARRLR

SEQ ID NO: 10728 - protein, 65 aa, Malus domestica
MENTIKHAIVIKVMGRTGSRGQVTQVRVKFLDDQNRFIMRNVKGPVREGDILTLLESEREARRLR

SEQ ID NO: 10729 - protein, 65 aa, Distylium racemosum
MDSQVKLAVVVKVIGRTGSRGQVTQVRVKFLDDQNRLIMRNVKGPVREGDVLTLLESEREARRLR

SEQ ID NO: 10730 - protein, 65 aa, Eucalyptus grandis
MDSQIKHAVVVKVMGRTGSRGQVTQVRVKFLDDMNRFIMRNVKGPVREGDVLTLLESEREARRLR

SEQ ID NO: 10731 - protein, 65 aa, Flaveria ramosissima
MDSQIKHAVVVKIMGRTGSRGQVTQVRVKFLDDQNRFIMRNVKGPVREGDVLTLLESEREARRLR

SEQ ID NO: 10732 - protein, 65 aa, Phalaenopsis aphrodite
MDSQVKLAVVVKVMGRTGSRGQVTQVRVKFMDDPNRLIMRNVKGPVREGDILTLLESEREARRLR

SEQ ID NO: 10733 - protein, 65 aa, Lippia dulcis
MDSTIKHAIVVKVMGRTGSRGQVTQVRVKFMDDQNRFIMRNVKGPVREGDILTLLESEREARRLR

SEQ ID NO: 10734 - protein, 65 aa, Unknown
  Sequence found in Organisms: Lippia dulcis, Salvia sclarea
MESQIKHAVVIKVIGRTGSRGQVTQVRVKFIDDQNRFIMRNVKGPVREGDILTLLESEREARRLR

SEQ ID NO: 10735 - protein, 65 aa, Platanus occidentalis
MDNQVKLAVVVKVMGRTGSRGQVTQVRVKFLDDQNRLIMRNVKGPVREGDVLTLLESEREARRLR

SEQ ID NO: 10736 - protein, 65 aa, Silene vulgaris
MDSATKHAVVVKIMGRTGSRGQVTQVRVKFLDDQNRFIMRNVKGPVREGDILTLLESEREARRLR

SEQ ID NO: 10737 - protein, 65 aa, Unknown
  Sequence found in Organisms: Solanum lycopersicum, Solanum phureja
MESVTKHAIVIKIMGRTGSRGQVTQVRVKFLDDQNRFIMRNVKGPVREGDILTLLESEREARRLR

SEQ ID NO: 10738 - protein, 65 aa, Utricularia gibba
MDSQIKHAIVVKVIGRTGSRGQVTQVRVKFVDDQNRFIMRNVKGPVREGDILTLLESEREARRLR

SEQ ID NO: 10739 - protein, 65 aa, Unknown
  Sequence found in Organisms: Antirrhinum majus, Mimulus guttatus, Salvia sclarea
MESQIKHAIVVKVIGRTGSRGQVTQVRVKFIDDQNRFIMRNVKGPVREGDVLTLLESEREARRLR

SEQ ID NO: 10740 - protein, 65 aa, Musa acuminata
MDAQAKLAVVVKVMGRTGSRGQVTQVRVKFLDDQNRLIMRNVKGPVREGDILTLLESEREARRLR

SEQ ID NO: 10741 - protein, 65 aa, Musa acuminata
MDTQAKLAVVVKVMGRTGSRGQVTQVRVKFLDDQNRLIMRNVKGPVREGDILTLLESEREARRLR

SEQ ID NO: 10742 - protein, 65 aa, Phaseolus coccineus
  misc_feature (17)..(17): Xaa can be any naturally occurring amino acid
MDSQVKHALVVKVMGRXGSRGQVPQVRVKFLDDQNRPLMRNVKGPVREGDILPLLESEREARRLR

SEQ ID NO: 10743 - protein, 65 aa, Phaseolus coccineus
  misc_feature (37)..(37): Xaa can be any naturally occurring amino acid
  misc_feature (56)..(56): Xaa can be any naturally occurring amino acid
MDSQVKHALVVKVRGRTGSRGQVPQVRVKFLDDQNRXIMRNVKGPVREGDILPLLXSEREARRLR

SEQ ID NO: 10744 - protein, 65 aa, Phaseolus coccineus
  misc_feature (9)..(9): Xaa can be any naturally occurring amino acid
MDFQVKHAXVVKVMGRTGSRGQVPQVRVKFLDDQNRPIMRNVKGPVREGDILPLLESEREARRLR

SEQ ID NO: 10745 - protein, 65 aa, Phaseolus coccineus
MDSQVKHAFVVKVMGRTGSRGQVPQVRVKFLDDQNRPIMRNVKGPVREGDIFPLLESEREARRLR

SEQ ID NO: 10746 - protein, 65 aa, Phaseolus coccineus
MDFQVKHAFVVKVMGRTGSRGQVPQVRVKFLDDQNRPIMRNVKGPVREGDILPLLESEREARRLR

SEQ ID NO: 10747 - protein, 65 aa, Phaseolus coccineus
MDSQVKHALVVKVMGRTGSRGQVPQVRVKFLDDQNRPLMRNVKGPVREGAILPLLESEREARRLR

SEQ ID NO: 10748 - protein, 65 aa, Brachypodium distachyon
MDTQVKLAVVVKVMGRTGSRGQVTQVRVKFLDDQNRLIMRNVKGPIREGDILTLLESEREARRLR

SEQ ID NO: 10749 - protein, 65 aa, Bruguiera gymnorhiza
MDSQIKHAVVVKVMGRTGSRGQVTQVRVKFIDDQNRFIMRNVKGPVREGDVLTLLESEREARRLR

SEQ ID NO: 10750 - protein, 65 aa, Manihot esculenta
MDTQIKHAVVVKVMGRTGSRGQVTQVRVKFLDDQNRFIMRNVKGPVREGDVLTLLESEREARRLR

SEQ ID NO: 10751 - protein, 65 aa, Manihot esculenta
MDTQLKHAVVVKVMGRTGSRGQVTQVRVKFLDDQNRFIMRNVKGPVREGDVLTLLESEREARRLR

SEQ ID NO: 10752 - protein, 65 aa, Gossypium hirsutum
MDSQIKFAVVVKIMGRTGSRGQVTQVRVKFLDDQNRFIMRNVKGPVREGDILTLLESEREARRLR

SEQ ID NO: 10753 - protein, 65 aa, Eucalyptus grandis
MDSQIKHAVVVKVMGRTGSRGQVTQVRVKFLDDMNRHIMRNVKGPVREGDVLALLESEREARRLR

SEQ ID NO: 10754 - protein, 65 aa, Eucalyptus grandis
MDSQIKHAVVVKVMGRTGSRGQVTQVRVKFLDDINRHIMRNVKGPVREGDVLALLESEREARRLR

SEQ ID NO: 10755 - protein, 65 aa, Linum usitatissimum
MESGIKHALVVKVMGRTGSRGQVTQVRVKFIDDPNRFIMRNVKGPVREGDILTLLEFEREARRLR

SEQ ID NO: 10756 - protein, 65 aa, Gnetum gnemon
MDSGVKLAIVVKVIGRTGSRGQVTQVRVKFLDDQNRLIMRNVKGPVREGDILTLLESEREARRLR

SEQ ID NO: 10757 - protein, 65 aa, Jatropha curcas
MDSQIKHAVVVKFMGRTGSRGQVTQVRVKFLDDQNRFIMRNVKGPVREGDVLTLLESEREARRLR

SEQ ID NO: 10758 - protein, 65 aa, Marchantia polymorpha
METQVKLAIVMKVIGRTGSRGQVTQVRVKFLDDQNRLIMRNVKGPVREGDILTLLESEREARRLR

SEQ ID NO: 10759 - protein, 65 aa, Mimulus guttatus
MESQIKRAVVVKVIGRTGSRGQVTQVRVKFIDDQNRFIMRNVKGPVREGDILTLLESEREARRLR

SEQ ID NO: 10760 - protein, 65 aa, Tropaeolum majus
MENQVKHALVMKIIGRTGSRGQVTQVRVKFVDDQNRLIMRNVKGPVREGDILTLLESEREARRLR

SEQ ID NO: 10761 - protein, 65 aa, Elaeis guineensis
MDTQVKLAVVVKVMGRTGSRGQVTQVRVKFLDDQNRLIMRNVKGPVREGDVLTLLESEREARRLR

SEQ ID NO: 10762 - protein, 65 aa, Arachis hypogaea
MDSGIKHAVVVKVIGRTGSRGQVTQVRVKFLDDQNRHIMRNVKGPVREGDVLTLLESEREARRLR

SEQ ID NO: 10763 - protein, 65 aa, Petunia hybrida
MESAIKHAIVVKVMGRTGSRGQVTQVRVKFMDDQNRYIMRNVKGPVREGDVLTLLESEREARRLR

SEQ ID NO: 10764 - protein, 65 aa, Populus trichocarpa
MDSQIKHAVVVKIMGRTGSRGQVTQVRVKFIDDQNRFIMRNVKGPVREGDILTLLESEREARRLR

SEQ ID NO: 10765 - protein, 65 aa, Papaver somniferum
MDSGVKLAIVVKVMGRTGSRGQVTQVRVKFLDDQNRLIMRNVKGPVREGDYLTLLESEREARRLR

SEQ ID NO: 10766 - protein, 64 aa, Senecio madagascariensis
MESQIKHAVVIKVMGRTGSRGQVTQVRVKFLDDQNRFIMRNVKGPVREGDVLTLLESEREARRL

SEQ ID NO: 10767 - protein, 65 aa, Saccharum officinarum
MDTQVKLAVVVKVMGRTGSRGQVTQVRVKFLDDQNRLIMRNVKGPVREGDILTLLESDREARRLR

SEQ ID NO: 10768 - protein, 65 aa, Camellia sinensis
MESQIKHAIVVKVMGRTGSRGQVTQVRVKFIDDQNRFITRNVKGPVREGDVLTLLESEREARRLR

SEQ ID NO: 10769 - protein, 65 aa, Zostera marina
MDTQVKLAVVVKIMGRTGSRGQVTQVRVKFLDDQNRLIMRNVKGPVREGDILTLLESEREARRLR

SEQ ID NO: 10770 - protein, 148 aa, Utricularia gibba
SLVGSLSVMSVKALGIALKLTFNGTNQLFYPQTWVFALVVLVCVLTQMNYLNKALDTFNTAVVSPIYYVMFTSLTIIASVIMFKDWDRQNPTQIVTEMCGFVTILSGTFLLHKTKDMADGSISFVIRAMKQAENSEEDIPLTLRRQET

SEQ ID NO: 10771 - protein, 389 aa, Malus domestica
MDLSFAPSSSPRFPAISPHCSTSSYIPPISANPTTAKSAAFLSSCRTNLYSIGLSRSCSKSLLSCRKKRNSIWACSQVGAAESNPVLTKVSDFKDACWRFLRPHTIRGTVLGSTALVTRALIENSNLIKWSLLFKAFSGLFALLCGNGYIVGINQIYDIKIDKVNKPYLPIAAGDLSVKSAWLLVVFFAVTGLLIVGLNFGAFITSLYCLGLFLGTIYSVPPLRMKRFPVAAFLIIATVRGFLLNFGVYYATRAALALQFEWSSAVAFITTFVTLFALVIAITKDLPDVEGDRKFEISTFATKLGVRNIAFLGSGLLLLNYVGSIFAASLMPEAFRRSLMIPMHAILALSLVFQTWVLEQANYTKEAIASYYRFIWNLFYAEYLLFPFI

SEQ ID NO: 10772 - protein, 52 aa, Phaseolus coccineus
MGRSGSRGQVPQVRVKFLDDQNRPIMRNVKGPVREGDILPLLESEREARRLR

SEQ ID NO: 10773 - protein, 52 aa, Phaseolus coccineus
  misc_feature (11)..(11): Xaa can be any naturally occurring amino acid
  misc_feature (39)..(39): Xaa can be any naturally occurring amino acid
MGRTGSRGQVXQVRVKFLDDQNRPIMRNVKGPVREGDIXPLLESEREARRLR

SEQ ID NO: 10774 - protein, 52 aa, Phaseolus coccineus
  misc_feature (39)..(39): Xaa can be any naturally occurring amino acid
MGRTGSRGQVPQVRVKFLDDQNRPIMRNVKGPVREGDIXPLLESEREARRLR

SEQ ID NO: 10775 - protein, 52 aa, Phaseolus coccineus
  misc_feature (11)..(11): Xaa can be any naturally occurring amino acid
MGRTGSRGQVXQVRVKFLDDQNRPIMRNVKGPVREGDILPLLESEREARRLR

SEQ ID NO: 10776 - protein, 86 aa, Cichorium intybus
GIELFRCCCRSQSTLTPATERWSLRSCTPILVKVMGRTGSRGQVTQVRVKFLDDQNRFIMRNVKGPVREGDVLTLLESEREARRLR

SEQ ID NO: 10777 - protein, 77 aa, Pennisetum glaucum
MDTQVKLAVVVKVMGRTGSRGQVTQVRVKFLDDQNRLIMRNVKGPVRRVTSSPCSSPRGRPGGCAEAVGFHGGSCME

SEQ ID NO: 10778 - protein, 89 aa, Elaeis guineensis
SCRIRHEFQLSSRLPLEASSHLESMDTQVKLAVVVKVMGRTGSRGQVTQVRVKFLDDQNRLIMRNVKGPVREGDVLTLLESEREARRLR

SEQ ID NO: 10779 - protein, 78 aa, Pteridium aquilinum
LELLQAQHYRALRNGYTCEACNSGESYGRTGSRGQVTQVRVKFLDDQNRLIMRNVKGPVREGDILTLLESEREARRLR

SEQ ID NO: 10780 - protein, 71 aa, Sarracenia psittacina
MESAVKLAIVMKVIGRTGSRGQVTQVRVKFLDDQNRLIMRNVKGPVREGDILTLLESERGGGEVAVKTGGT

SEQ ID NO: 10781 - protein, 52 aa, Phaseolus coccineus
  misc_feature (24)..(24): Xaa can be any naturally occurring amino acid
  misc_feature (33)..(33): Xaa can be any naturally occurring amino acid
MGRTGSRGQVPQVRVKFLDDQNRXIMRNVKGPXREGDIFPLLESEREARRLR

SEQ ID NO: 10782 - protein, 52 aa, Phaseolus coccineus
  misc_feature (25)..(25): Xaa can be any naturally occurring amino acid
  misc_feature (37)..(37): Xaa can be any naturally occurring amino acid
MGRTGSRGQVPQVRVKFLDDQNRPXMRNVKGPVREGXILPLLESEREARRLR

SEQ ID NO: 10783 - protein, 52 aa, Phaseolus coccineus
MGRTGSRGQVPQVRVKFLDDQNRPIMRNVKGPVREGDIFPLLESEREARRLR

SEQ ID NO: 10784 - protein, 110 aa, Carica papaya
ESSKIPGVYIQSFIIHILILHSSRNPNSALLLLQSPSSSLLIQRHMDSQIKLAVVVKVMGRTGSRGQVTQVRVKFLDDQNRFIIRNVKGPVREGDVLTLLESEREARRLR

SEQ ID NO: 10785 - protein, 65 aa, Catharanthus roseus
MDSQIKHAIVVKVMGRTGSRGQVTQVRVKSIDDQNRFIMRNVKGPVREGDVLTLLESEREARRLR

SEQ ID NO: 10786 - protein, 65 aa, Unknown
  Sequence found in Organisms: Cephalotaxus harringtonia, Taxus baccata
MDTGVKLAVVVKVIGRTGSRGQVTQVRVKFLDDQNRLIMRNVKGPVREGDILTLLESEREARRLR

SEQ ID NO: 10787 - protein, 65 aa, Unknown
  Sequence found in Organisms: Fraxinus spp, Olea europaea
MDSQIKHAIVVKIMGRTGSRGQVTQVRVKFIDDQNRFIMRNVKGPVREGDVLTLLESEREARRLR

SEQ ID NO: 10788 - protein, 65 aa, Primula obconica
MESQIKHAVVEKIMGRTGSRGQVTQVRVKFMDDTNRFIMRNVKGPVREGDILTLLESEREARRLR

SEQ ID NO: 10789 - protein, 65 aa, Silene vulgaris
MDSAIKHAVVIKIMGRTGSRGQVTQVRVKFLDDQNRFIMRNVKGPVREGDILTLLESEREARRLR

SEQ ID NO: 10790 - protein, 65 aa, Trigonella foenum-graecum
MESQIKTALVVKVMGRTGSRGQVTQVRVQLRDDQNRFIMRNVKGPVREGDVLTLLESEREARRLR

SEQ ID NO: 10791 - protein, 63 aa, Vinca minor
SQIKHAIVVKVMGRTGSRGQVTQVRVKFIDDQNRFIMRNVKGPVREGDVLTLLESEREARRLR

SEQ ID NO: 10792 - protein, 63 aa, Vinca minor
TQIKHAIVVKVMGRTGSRGQVTQVRVKFVDDQNRFIMRNVKGPVREGDILTLLESEREARRLR

SEQ ID NO: 10793 - protein, 65 aa, Aristolochia fimbriata
MDSQVKLAVVVKVMGRTGSRGQVTQVRVKFIDDMNRLIMRNVKGPVREGDVLTLLESEREARRLR

SEQ ID NO: 10794 - protein, 65 aa, Musa acuminata
MDTQAKLAVVVKVMGRTGSRGQVTQVRVKFLDDQNRLIMRNGKGPVREGDILTLLESEREARRLR

SEQ ID NO: 10795 - protein, 65 aa, Phaseolus coccineus
MDSQVKHAFVVKVMGRTGSRGQVPQVRVKFLDDQNRPIMRNVKGPVREGAIFPLLESEREARRLR

SEQ ID NO: 10796 - protein, 65 aa, Phaseolus coccineus
  misc_feature (58)..(58): Xaa can be any naturally occurring amino acid
MDSQVKHAFVVKVRGRTGSRGQVPQVRVKFLDDQNRPIMRNVKGPVREGDILPLLESXREARRLR

SEQ ID NO: 10797 - protein, 65 aa, Phaseolus coccineus
MDFQVKHAFVVKVRGRTGSRGQVTQVRVKFLDDQNRPIMRNVKGPVREGAILPLLESEREARRLR

SEQ ID NO: 10798 - protein, 65 aa, Phaseolus coccineus
MASQGKHALVVKVRGRTGSRGQVPQVRVKFLDDQNRPIMRNVKGPVREGDIFPLLESEREARRLR

SEQ ID NO: 10799 - protein, 65 aa, Phaseolus coccineus
MDSQVKHALVVKVRGRSGSRGQVPQVRVKFLDDQNRPIMRNVKGPVREGDIFPLLESEREARRLR

SEQ ID NO: 10800 - protein, 65 aa, Unknown
  Sequence found in Organisms: Ceratodon purpureus, Physcomitrella patens
MDSAVKLAIVMKVIGRTGSRGQVTQVRVKFLDDQNRLIMRNVKGPVREGDILTLLESEREARRLR

SEQ ID NO: 10801 - protein, 65 aa, Cryptomeria japonica
MDAGVKMAVVVKVIGRTGSRGQVTQVRVKFLDDQNRLIMRNVKGPVREGDILTLLESEREARRLR

SEQ ID NO: 10802 - protein, 65 aa, Cycas rumphii
MDTPVKLAVVVKVIGRTGSRGQVTQVRVKFLDDQNRLIMRNVKGPVREGDILTLLESEREARRLR

SEQ ID NO: 10803 - protein, 65 aa, Solanum melongena
MESVTKHAIVIKIMGRTGSRGQVTQVRVKFLDDQNRFIMRNVKGPVREGDVLTLLESEREARRLR

SEQ ID NO: 10804 - protein, 65 aa, Solanum melongena
MESVTKHAVVIKIMGRTGSRGQVTQVRVKFLDDQNRFIMRNVKGPVREGDVLTLLESEREARRLR

SEQ ID NO: 10805 - protein, 65 aa, Adiantum capillus-veneris
MDSPVKLAIVVKVMGRTGSRGQVTQVRVKFVDDQNRLIMRNVKGPVREGDILALLESEREARRLR

SEQ ID NO: 10806 - protein, 65 aa, Mimulus guttatus
MDTQIKHAIVVKVIGRTGSRGQVTQVRVKFVDDQNRFIMRNVKGPVREGDILTLLESEREARRLR

SEQ ID NO: 10807 - protein, 65 aa, Tropaeolum majus
MDNQVKHVLVVKIIGRTGSRGQVTQVRVKFVDDQNRLIMRNVKGPVREGDILTLLESEREARRLR

SEQ ID NO: 10808 - protein, 65 aa, Capsicum annuum
MDCQIKHAIVVKVMGRTGSRGQVTQVRVKFMDDQNRFIMRNVKGPIREGDILTLLESEREARRLR

SEQ ID NO: 10809 - protein, 65 aa, Sciadopitys verticillata
MDAQVKLAAVVKVIGRTGSRGQVTQVRVKFLDDPNRLIMRNVKGPVREGDILTLLESEREARRLR

SEQ ID NO: 10810 - protein, 63 aa, Senecio madagascariensis
MESQIKHAVVIKVMGRTGSRGQVTQVRVKFLDDQNRFIMRNVKGPVREGDVLTLLESEREARR

SEQ ID NO: 10811 - protein, 65 aa, Tamarix hispida
MDSAIKHAIVVKVMGRTGSRGQVTQVRVKFMDDQNRFIMRNVKGPVREGDVLTLLESEREARRLR

SEQ ID NO: 10812 - protein, 65 aa, Taxus baccata
MDAGVKLAVVVKVIGRTGSRGQVTQVRVKFLDDQNRLIMRNVKGPVREGDILTLLESEREARRLR

SEQ ID NO: 10813 - protein, 65 aa, Triticum aestivum
  misc_feature (48)..(48): Xaa can be any naturally occurring amino acid
MDTQVKLAVVVKVMGRTGSRGQVTQVRVKFLDDQNRLIMRNVKGPVRXGDILTLLESEREAKRLR

SEQ ID NO: 10814 - protein, 65 aa, Zamia vazquezii
MDAPVKLAVVVKVIGRTGSRGQVTQVRVKFLDDQNRLIMRNVKGPVREGDILTLLESEREARRLR

SEQ ID NO: 10815 - protein, 65 aa, Zostera marina
MDTQVKLAVVVKIMGRTGSRGQVTQVRVKFLDDQNRLIMRNIKGPVREGDILTLLESEREARRLR

SEQ ID NO: 10816 - protein, 65 aa, Abies balsamea
MDTGVKLAVVVKVVGRTGSRGQVTQVRVKFLDDQNRLIMRNVKGPVREGDVLTLLESEREARRLR

SEQ ID NO: 10817 - protein, 64 aa, Unknown
  Sequence found in Organisms: Brassica napus, Brassica juncea, Brassica oleracea, Brassica rapa, Raphanus sativus, Thellungiella halophila, Eutrema halophilum, Eutrema parvulum
MDSQIKHAVVVKVMGRTGSRGQVTQVRVKFTDSDRFIMRNVKGPVREGDILTLLESEREARRLR

SEQ ID NO: 10818 - protein, 64 aa, Unknown
  Sequence found in Organisms: Arabidopsis thaliana, Brassica napus, Arabidopsis lyrata, Brassica juncea, Brassica oleracea, Brassica rapa, Cleome gynandra, Raphanus sativus
MDSQIKHAVVVKVMGRTGSRGQVTQVRVKFTDSDRYIMRNVKGPVREGDILTLLESEREARRLR

SEQ ID NO: 10819 - protein, 65 aa, Unknown
  Sequence found in Organisms: Cedrus atlantica, Pinus pinaster, Pinus taeda, Pseudotsuga menziesii, Picea glauca
MDTGVKLAVVVKVIGRTGSRGQVTQVRVKFLDDQNRLIMRNVKGPVREGDVLTLLESEREARRLR

SEQ ID NO: 10820 - protein, 65 aa, Plantago ovata
MDSQIKHAIVVKIIGRTGSRGQVTQVRVKFIDDQNRFIMRNVKGPVREGDVLTLLESEREARRLR

SEQ ID NO: 10821 - protein, 65 aa, Pteridium aquilinum
MDTPVKLAVVMKVMGRTGSRGQVTQVRVKFIDDQNRLIMRNVKGPVREGDILTLLESEREARRLR

SEQ ID NO: 10822 - protein, 65 aa, Phaseolus coccineus
MDSQVKHAFVVKVMGRTGSRGQVPQVRVKFLDDQNRPFMRNVKGPVREGAILPLLDSEREARRLR

SEQ ID NO: 10823 - protein, 65 aa, Phaseolus coccineus
  misc_feature (17)..(17): Xaa can be any naturally occurring amino acid
  misc_feature (28)..(28): Xaa can be any naturally occurring amino acid
  misc_feature (38)..(38): Xaa can be any naturally occurring amino acid
MDSQVKHALVVKVRGRXGSRGQVPQVRXKFLDDQNRPXMRNVKGPVREGDILPLLESEREARRLR

SEQ ID NO: 10824 - protein, 65 aa, Unknown
  Sequence found in Organisms: Ceratodon purpureus, Physcomitrella patens
MDTAVKLAIVMKVIGRTGSRGQVTQVRVKFLDDQNRLIMRNVKGPVREGDILTLLESEREARRLR

SEQ ID NO: 10825 - protein, 65 aa, Ceratodon purpureus
MDSAIKLAIVMKVIGRTGSRGQVTQVRVKFLDDQNRLIMRNVKGPVREGDILTLLESEREARRLR

SEQ ID NO: 10826 - protein, 65 aa, Medicago truncatula
MDSQIKNAVVVKVIGRTGSRGQVTQVRVKFNDDSNRHIMRNVKGPVREGDTLTLLESEREARRLR

SEQ ID NO: 10827 - protein, 65 aa, Mesostigma viride
MDAPVKLAIVMKVIGRTGSRGQVTQVRVKFLDDQNRLIMRNVKGPVREGDILTLLESEREARRLR

SEQ ID NO: 10828 - protein, 65 aa, Orobanche aegyptiaca
MDSGSKTALVVKVMGRTGSRGQVTQVRVKFNDDSNRFIMRNVKGPVREGDILTLMESEREARRLR

SEQ ID NO: 10829 - protein, 65 aa, Populus trichocarpa
MDSQIKHAVVMKIMGRTGSRGQVTQVRVKFLDDPNRFIMRNVKGPVREGDVLTLLESEREARRLR

SEQ ID NO: 10830 - protein, 65 aa, Fragaria vesca
MDSTAKHAVVVKVMGRTGSRGQVTQVRVRFLDDTNRLIMRNVKGPVREGDTLTLLESEREARRLR

SEQ ID NO: 10831 - protein, 65 aa, Triphysaria pusilla
MESQIKHAIVVKVMGRTGSRGQVTQVRVKFMDDTNRFIMRNVKGPIREGDVLTLMESEREARRLR

SEQ ID NO: 10832 - protein, 78 aa, Sarracenia psittacina
GSSAPTLLPPPSLSLKSRMESQIKHAIVVKVMGRTGSRGQVTQVRVKFVDDQNRHIMRNVKAVREGDVLTLLESDVGG

SEQ ID NO: 10833 - protein, 127 aa, Brassica juncea
SKLVSGADFYCFKHNIEPKWEDPICANGGKWTMNFPKEKSDKPWLYTLLALIGEQFDHGDEICGAVVNVRGKQERISIWTKNASNEAAQVSIGKQWKEFIDYNNSIGFIIHEDAKKLDRGAKSAYTA

SEQ ID NO: 10834 - protein, 88 aa, Brassica juncea
ASSLPVNVPDWSKILGEESPRRQTSNEEYDGDEVAACGGETRRVPPHELLASRRMASFSVHEGAGRTLKGRDLSRVRNTIFKIRGIED

SEQ ID NO: 10835 - protein, 82 aa, Brassica oleracea
GFLAESISRKAPAASFYRMDSQIKHAVVVKVMGRTGSRGQVTQVRVKFTDSDRFIMRNVKGPVREGDILTLLESEREARRLR

SEQ ID NO: 10836 - protein, 96 aa, Brassica rapa
LLWKLLGFLTLCLSPLSSLASANRGFYRSSSRMDSQIKHAVVVKVMGRTGSRGQVTQVRVKFTDSDRYIMRNVKGPVREGDILTLLESEREARRLR

SEQ ID NO: 10837 - protein, 139 aa, Brassica rapa
MANAASGMAVHDDCKLKFLELKAKRTFRFIVYKIEEQQKQVVVEKLGEPGQSHDDFAASLPADECRYAVFDFDFVTAESCQKSKIFFVAWSPDTARVRSKMIYASSKDRFKRELDGIQVELQATDPTEMDLDVFKSRAN

SEQ ID NO: 10838 - protein, 82 aa, Brassica rapa
VFLAESISRKAPAASFYRMDSQIKHAVVVKVMGRTGSRGQVTQVRVKFTDSDRFIMRNVKGPVREGDILTLLESEREARRLR

SEQ ID NO: 10839 - protein, 52 aa, Phaseolus coccineus
  misc_feature (26)..(26): Xaa can be any naturally occurring amino acid
MGRTGSRGQVPQVRVKFLDDQNRPFXRNVKGPVREGDILPLLDSEREARRLR

SEQ ID NO: 10840 - protein, 52 aa, Phaseolus coccineus
  misc_feature (4)..(4): Xaa can be any naturally occurring amino acid
  misc_feature (37)..(37): Xaa can be any naturally occurring amino acid
MGRXGSRGQVPQVRVKFLDDQNRPIMRNVKGPVREGXILPLLESEREARRLR

SEQ ID NO: 10841 - protein, 52 aa, Phaseolus coccineus
  misc_feature (11)..(11): Xaa can be any naturally occurring amino acid
MGRTGSRGQVXQVRVKFLDDQNRPIMRNVKGPVREGDIFPLLESEREARRLR

SEQ ID NO: 10842 - protein, 52 aa, Phaseolus coccineus
MGRTGSRGQVPQVRGKFLDDQNRPIMRNVKGPVREGAILPLLESEREARRLR

SEQ ID NO: 10843 - protein, 77 aa, Solanum tuberosum
MPTCNGSYFFSSVRDGRPSIMLNLLPVLLMCDFGYIGSFIRILKGIYPKKRKYCNVTKPSNLILLMHKFNIRLFLFS

SEQ ID NO: 10844 - protein, 86 aa, Raphanus sativus
LWKLGLLLLRFAAAKLFTFVYRMDSQIKHAVVVKVMGRTGSRGQVTQVRVKFTDSDRFIMRNVKGPVREGDILTLLESEREARRLR

SEQ ID NO: 10845 - protein, 91 aa, Raphanus sativus
GGFVTLRLSPLSSVASVKPSFLQVCSSMDSQIKHAVVVKVMGRTGSRGQVTQVRVKFTDSDRYIMRNVKGPVREGDILTLLESEREARRLR

SEQ ID NO: 10846 - protein, 88 aa, Raphanus sativus
GSSLEIRVLASSLAAAKHSPSFYRMDSQIKHAVVVKVMGRTGSRGQVTQVRVKFTDSDRFIMRNVKGPVREGDILTLLESEREARRLR

SEQ ID NO: 10847 - protein, 86 aa, Raphanus sativus
GARLDFTSKLLEHPPAASIFNRMDSQIKHAVVVKVMGRTGSRGQVTQVRVKFTDSDRFIMRNVKGPVREGDILTLLESEREARRLR

SEQ ID NO: 10848 - protein, 118 aa, Secale cereale
  misc_feature (56)..(56): Xaa can be any naturally occurring amino acid
  misc_feature (110)..(110): Xaa can be any naturally occurring amino acid
PFVLFSCAALSLPWRRRGRTRSSDPHRQQPKKGSMDTQVKLAVVVKVMGRTGSRGXVTQVRVKFLDDQNRLIMRNVKGPVREGDILTLLESEREARRCAKHFVSSPVGLXSTSTPKML

SEQ ID NO: 10849 - protein, 105 aa, Picea glauca
LIKLIPPPPRYLTSLGSRYLVELGQRFGAQSERIRLREESMDTGVKLAVVVKVIGRTGSRGQVTQVRVKFLDDQNRLIMRNVKGPVREGDVLTLLESEREARRLR

SEQ ID NO: 10850 - protein, 68 aa, Phaseolus coccineus
  misc_feature (20)..(20): Xaa can be any naturally occurring amino acid
  misc_feature (26)..(26): Xaa can be any naturally occurring amino acid
  misc_feature (48)..(48): Xaa can be any naturally occurring amino acid
  misc_feature (50)..(50): Xaa can be any naturally occurring amino acid
  misc_feature (63)..(63): Xaa can be any naturally occurring amino acid
MDSQVKHALVVKVMGRTGSXGQVTQXRVKFLDDQNRHIMRNVKGPVRXGXILTLLESEREARXLRYMV

SEQ ID NO: 10851 - protein, 63 aa, Abies balsamea
TGVKLAVVVKVVGRTGSRGQVTQVRVKFLDDQNRLIMRNVKGPVREGDVLTLLESEREARRLR

SEQ ID NO: 10852 - protein, 65 aa, Malus domestica
MESTIKHAIVIKVIRRTGSRGQVTQVRVKFLDDQNRFIMRNVKGPVREGDILTLLESKMEARRLR

SEQ ID NO: 10853 - protein, 65 aa, Chelidonium majus
MDSGVKLAVVIKVMGRTGSRGQVTQVRVKFLDDPNRLIMRNVKGPIREGDYLTLLESEREARRLR

SEQ ID NO: 10854 - protein, 65 aa, Primula obconica
MESQIKHAVVEKIMGRTGSRGQVTQVRVKFMDDTNRFIMRNVKGPVREGDIFTLFESEREARRLR

SEQ ID NO: 10855 - protein, 65 aa, Primula obconica
MDSQIKHAVVVKIMGRTGSRGQVTQVRVQFSDDHSRFIMRNVKGPVREGDILTLLESEREARRLR

SEQ ID NO: 10856 - protein, 65 aa, Silene vulgaris
MDTAIKHAVVIKIMGRTGSRGQVTQVRVKFIDDQNRFIMRNVKGPVREGDILTLLESEREARRLR

SEQ ID NO: 10857 - protein, 65 aa, Silene vulgaris
MDQPAKLAIVMKVIGRTGSRGQVTQVRVKFLDDQNRLIMRNVKGPVREGDILTLLESEREARRLR

SEQ ID NO: 10858 - protein, 64 aa, Eutrema parvulum
MDSQIKHAVVVKVMGRTGSRGQVTQVRVKFTDSDRFIMRNVKGPIREGDILTLLESEREARRLR

SEQ ID NO: 10859 - protein, 64 aa, Arabidopsis thaliana [sequence omitted]

SEQ ID NO: 10860 - protein, 60 aa, Artemisia annua
MESQIKHAVVVKVMGRTGSRGQVTQLDDQNRFIMRNVKGPVREGDVLTLLESEREARRLR

SEQ ID NO: 10861 - protein, 64 aa, Brassica juncea
MDSQIKHAVVVQVMGRTGSRGQVTQVRVKFTDSDRYIMRNVKGPVREGDILTLLESEREARRLR

SEQ ID NO: 10862 - protein, 65 aa, Unknown
  Sequence found in Organisms: Chlamydomonas reinhardtii, Volvox carteri
MDAPAKLAIVMKVIGRTGSRGQVTQVRVKFLDDQNRLIMRNVKGPVREGDILTLLESEREARRLR

SEQ ID NO: 10863 - protein, 64 aa, Cleome spinosa
MDSQIKHAVVVKVMGRTGSRGQVTQVRVKFTDSDRYIMRNVKGPVREGDVLTLLESEREARRLR

SEQ ID NO: 10864 - protein, 65 aa, Cryptomeria japonica
MDTGVKLAVVVKVIGRTGSRGQVTQVRVKFIDDQNRLIMRNVKGPVREGDVLTLLESEREARRLR

SEQ ID NO: 10865 - protein, 65 aa, Orobanche aegyptiaca
MDSGIKTAVVVKVMGRTGSRGQVTQVRVKFNDDSNRFIMRNVKGPVREGDILTLMESEREARRLR

SEQ ID NO: 10866 - protein, 65 aa, Pinus taeda
MDTGIKLAVVVKVIGRTGSRGQVTQVRVKFLDDQNRLIMRNVKGPVREGDVLTLLESEREARRLR

SEQ ID NO: 10867 - protein, 65 aa, Selaginella moellendorffii
MDQPVKLAIVTKVIGRTGSRGQVTQVRVKFLDDQNRLIMRNVKGPIREGDILTLLESEREARRLR

SEQ ID NO: 10868 - protein, 65 aa, Triphysaria pusilla
MESQIKHAIVVKVIGRTGSRGQVTQVRVKFMDDTNRFIMRNVKGPIREGDVLTLMESEREARRLR

SEQ ID NO: 10869 - protein, 52 aa, Phaseolus coccineus
  misc_feature (24)..(25): Xaa can be any naturally occurring amino acid
  misc_feature (39)..(39): Xaa can be any naturally occurring amino acid
MGRTGSRGQVPQVRVKFLDDQNRXXMRNVKGPVREGDIXPLLESEREARRLR

SEQ ID NO: 10870 - protein, 52 aa, Phaseolus coccineus
  misc_feature (4)..(4): Xaa can be any naturally occurring amino acid
  misc_feature (22)..(22): Xaa can be any naturally occurring amino acid
MGRXGSRGQVPQVRVKFLDDQXRPIMRNVKGPVREGDILPLLESEREARRLR

SEQ ID NO: 10871 - protein, 52 aa, Phaseolus coccineus
MGRSGSRGQVPQVRVKFLDDQNRPFMRNVKGPVREGDIFPLLESGREARRLR

SEQ ID NO: 10872 - protein, 73 aa, Allium cepa
ISRRELFDMDNQVKLAVVEQVMGRTGSRGQVTQVRVKFLDDENRRIMRNVKGPVRVGDFLTLLESEREARRLR

SEQ ID NO: 10873 - protein, 86 aa, Raphanus sativus
  misc_feature (9)..(9): Xaa can be any naturally occurring amino acid
  misc_feature (25)..(25): Xaa can be any naturally occurring amino acid
LWKLGLLLXRFAAAKLFTFVYRMYXQIKHAVAVKVMGRTGSRGQVTQVRVKFTDSDRFIMRNVKGPVREGDILTLLESEREARRLR

SEQ ID NO: 10874 - protein, 63 aa, Triticum aestivum
STLRRRLRRLSRSTDPHPQQPKKAWIRRCNLPLVVKVMGRTGSRGSGDPRDSQVPGRPTTVSS

SEQ ID NO: 10875 - protein, 65 aa, Aristolochia fimbriata
MDSQVKLAQVVKVIGRTGSRGQVTQVRVKFIDDPNRLIMRNVKGPIREGDCLTLMESEREARRLR

SEQ ID NO: 10876 - protein, 65 aa, Ocimum basilicum
MESVTKHAIVIKIMGRTGSRGQVTHVRVKFLDDRNMFIMTNVKGPVREGDILTLLESEREARRLR

SEQ ID NO: 10877 - protein, 65 aa, Tropaeolum majus
MDSQIKHAIVTKIIGRTGSRGQVTQVRVKFIDDPNRVIMRNVKGPVREGDYLTLLESEREARRLR

SEQ ID NO: 10878 - protein, 65 aa, Quercus alba
MNTDVKHAIVTKVVGRTGSRGQVTQVRVRFTDDANRQIMRNVKGPVREGDILTLLESEREARRLR

SEQ ID NO: 10879 - protein, 65 aa, Sequoia sempervirens
MDTGVKMAVVIKVIGRTGSRGQVTQVRVKFIDDQNRLIMRNVKGPVREGDVLTLLESEREARRLR

SEQ ID NO: 10880 - protein, 65 aa, Triticum aestivum
  misc_feature (17)..(17): Xaa can be any naturally occurring amino acid
  misc_feature (37)..(37): Xaa can be any naturally occurring amino acid
  misc_feature (47)..(47): Xaa can be any naturally occurring amino acid
  misc_feature (53)..(53): Xaa can be any naturally occurring amino acid
  misc_feature (61)..(61): Xaa can be any naturally occurring amino acid
MDTQVKLAVVVKVMGRXGSRGQVTQVRVKFLDDQNRXIMRNVKGPVXEGDILXLLEFEREXRRLR

SEQ ID NO: 10881 - protein, 65 aa, Trigonella foenum-graecum
MESQTKNVTVEKVIGRTGSRGQVTQVRVKFMDDPSRHIMRNVKGPVRVGDVLTLLESEREARRLR

SEQ ID NO: 10882 - protein, 65 aa, Cicer arietinum
MDSQVKYASVVKVIGRTGSRGQVTQVRVRFNDDHTRLITRNVKGPVREGDVLTLLESEREARRLR

SEQ ID NO: 10883 - protein, 65 aa, Ipomoea batatas
MESQIKHAIVVKVMGRTGSKGQVTQVRVKFIDDQNRFIMRNVKGPVRKGYVLTLLESQKEAKRLR

SEQ ID NO: 10884 - protein, 59 aa, Rosa hybrid cultivar
MLLWRKVMGRTGSRGQVTQVRVKFLDDQNRFIMRNVKGPVREGDILTLLESEREARRLR

SEQ ID NO: 10885 - protein, 62 aa, Helianthus annuus
PVKLAIVVKVLGRTGSRGQVTQVRVKFLYDQERQIMRNVKGPVREGDVLTLLESEREARRLR

SEQ ID NO: 10886 - protein, 63 aa, Sarracenia psittacina
MDTQVKLAIVVKVIGRTGSRGQVTQVRVKFLDAERLIMRNVKGPVREGDISRPSWSPSVRPGG

SEQ ID NO: 10887 - protein, 93 aa, Camellia sinensis
SSADCSTSLRQVSPTAPLLPCHNGVSDQACHRGESYGNGGSRGHVTQVRVKFIDDINRFIMRNVKGPVREGDVLPCSSLRGKRKVAMISFALF

SEQ ID NO: 10888 - protein, 92 aa, Fraxinus spp
HLIVELHLCILVFSQPSLSFILQNWISTNSKSIVHFVVKIMGRTGSRGQVTQVRVKFIDDQNRFIMRNVKGPVREGDVLTLLESEREARRLR

SEQ ID NO: 10889 - protein, 52 aa, Phaseolus coccineus
MGRTGSRGQVTQVRVKFLDDQIRPIMRNVKGPFREGAFFPLLDSEREPRRLR

SEQ ID NO: 10890 - protein, 52 aa, Phaseolus coccineus
  misc_feature (4)..(4): Xaa can be any naturally occurring amino acid
  misc_feature (25)..(25): Xaa can be any naturally occurring amino acid
  misc_feature (37)..(37): Xaa can be any naturally occurring amino acid
MGGXGSRGQVPQVRVKFLDDQNRPXMRNVKGPVREGXILPLLESEREARRLR

SEQ ID NO: 10891 - protein, 65 aa, Primula obconica
MDTQIKHAFVVKIMGRTGSRGQVTQVRVQFADDATRFIMRNVKGPVRVGDVLTLLESEREARRLR

SEQ ID NO: 10892 - protein, 65 aa, Aquilegia formosa
MDSGAKNAQVIKVIGRTGSRGQVTQVRVKFLDDTNRIIMRNVKGPVREGDVLCLLETEREARRLR

SEQ ID NO: 10893 - protein, 58 aa, Ostreococcus lucimarinus
AIVMKVIGRTGSRGQVTQVRVKFLDDQNRQIMRNVKGPVREGDILTLMESEREARRLR

SEQ ID NO: 10894 - protein, 65 aa, Salvia sclarea
MESQIKYASVDKVVGRTGSRGQVTQVRVKFHDDPSRLIMRNIKGPVKEGDIITLLESEREARRLR

SEQ ID NO: 10895 - protein, 65 aa, Pinus taeda
MDTGVKLAVVVKVIGRTGSRGQVTQVRVKFLDDQNRLIMRNVKGPVREGDVLTLLESEREGHHPL

SEQ ID NO: 10896 - protein, 64 aa, Arabidopsis lyrata
MDSQIKHAVVVKVMGRTGSRGQVTQVRVKFTDSDRLIVFNVKGPVREGDILTLLDFEREAIRLR

SEQ ID NO: 10897 - protein, 64 aa, Theobroma cacao
MESGVKNATVTKVIGRTGSRGQVTQVRVRFINDSREITRNVKGPVRVGDILTLLESEREARRLR

SEQ ID NO: 10898 - protein, 64 aa, Medicago truncatula
MESQIKHAQVEKVMGRTGSRGQVTQVRVKILHENRYIMRNVKGPIRKGDVIALLESEREARRLR

SEQ ID NO: 10899 - protein, 75 aa, Euphorbia esula
RFPPIFFVLKMDSTIKHALVVKVMGRTGSRGQVTQVRVKFLDDQNRFIMRNVKGPVREGDVLTLLESEREARRLR

SEQ ID NO: 10900 - protein, 65 aa, Triticum aestivum
  misc_feature (25)..(25): Xaa can be any naturally occurring amino acid
  misc_feature (58)..(58): Xaa can be any naturally occurring amino acid
  misc_feature (60)..(60): Xaa can be any naturally occurring amino acid
MDTQVKLAVVVKVMGRTGSKGQVTXVRVKFLDDQNRLIMRNVKGPVREGDILNLLQSXRXGKRLR

SEQ ID NO: 10901 - protein, 125 aa, Glycine max
MSRGGAVAAAKGKKKGATFTIDCAKPVEDKIMDIASLEKFLQERIKVGGKAGALGDSITVTREKTKIIVTSDSNFSKRYLKYLTKKYLKKHNVRDWLRVIASNKDRSVYELRYFNIAENEGEEED

SEQ ID NO: 10902 - protein, 124 aa, Vigna unguiculata
MSRGSAAGAKGKKKGATFTIDCAKPVEDKIMDIASLEKFLQERIKVGGKAGALGDSVTVTREKTKIIVTSDSNFSKRYLKYLTKKYLKKHNVRDWLRVIASNKDRNVYELRYFNIAENEGEEED

SEQ ID NO: 10903 - protein, 124 aa, Cajanus cajan
MSRGGAASAKGKKKGATFTIDCAKPVEDKIMDIASLEKFLQERIKVGGKAGALGDTVTVAREKTKIIVTSDSNFSKRYLKYLTKKYLKKHNVRDWLRVIASNKDRSVYELRYFNIAENEGEEED

SEQ ID NO: 10904 - protein, 124 aa, Phaseolus coccineus
MSRGSAAGAKGKKKGATFTIDCAKPVEDKIMDIASLEKFLQERIKVGGKAGALGDSVTVTREKTKIIVTSDSNFSKRYLKYLTKKYLKKHNVRDWLRVIASNKDRNIYELRYFNIAENEGEEED

SEQ ID NO: 10905 - protein, 124 aa, Glycyrrhiza uralensis
MSRGGAAGAKGKKKGATFTIDCAKPVEDKIMDIASLEKFLQERIKVGGKAGALGDSVTVTRDKTKITVTSDSNFSKRYLKYLTKKYLKKHNVRDWLRVIASNKDRSIYELRYFNIAENEGEEED

SEQ ID NO: 10906 - protein, 124 aa, Cajanus cajan
MSRGGAAGAKGKKKGATFTIDCAKPVEDKIMDIASLEKFLQERIKVAGKAGALGDTVNVTREKTKITVTSDSNFSKRYLKYLTKKYLKKHNVRDWLRVIASNKDRSVYELRYFNIAENEGEEED

SEQ ID NO: 10907 - protein, 124 aa, Glycine max
MSRGSATAAKGKKKGATFTIDCAKPVEDKIMDIASLEKFLQERIKVGGKAGALGDSITVVREKTKIIVTSDSNFSKRYLKYLTKKYLKKHNVRDWLRVIASNKDRSIYELRYFNIAENEGEEED

SEQ ID NO: 10908 - protein, 125 aa, Unknown
  Sequence found in Organisms: Citrus sinensis, Citrus clementina, Citrus sinensis
MSRGAAAAGVKGKKKGATFVIDCGKPVEDKIMDIASLEKFLQERIKVGGKAGALGDSVTVTREKTKITVTSDSNFSKRYLKYLTKKYLKKHNVRDWLRVIASNKDRSVYELRYFNIAENEGEEED

SEQ ID NO: 10909 - protein, 124 aa, Cannabis sativa
MSRGSAAAPKGKKKGATFTIDCAKPVEDKIMDIASLEKFLQERIKVGGKAGALGDSVTVTREKSKITVTSDSNFSKRYLKYLTKKYLKKHNVRDWLRVISSNKDRNVYELRYFNIAENEGEEED

SEQ ID NO: 10910 - protein, 124 aa, Gossypium hirsutum
MSRGTAAGPKGKKKGATFTIDCAKPVEDKIMDIASLEKFLQERIKVGGKAGALGDSVTVTRDKTKITVTSDSNFSKRYLKYLTKKYLKKHNVRDWLRVIASNKDRSVYELRYFNIAENEGEEEE

SEQ ID NO: 10911 - protein, 124 aa, Medicago truncatula
MSRGSAAGAKGKKKGATFTIDCAKPVEDKIMDIASLEKFLQERIKVGGKAGALGDSVSVTREKSKITVTSDSNFSKRYLKYLTKKYLKKHNVRDWLRVIASNKDRSIYELRYFNIAENEGEEED

SEQ ID NO: 10912 - protein, 124 aa, Glycine max
MSRGSATAAKGKKKGATFTIDCAKPVEDKIMDIASLEKFLQERIKVGGKAGALADTITVTREKTKIIVTSDSNFSKRYLKYLTKKYLKKHNVRDWLRVIASNKDRSIYELRYFNIAENEGEEED

SEQ ID NO: 10913 - protein, 125 aa, Cannabis sativa
MSRGSAAAPKGGKKKGATFTIDCAKPVEDKIMDIASLEKFLQERIKVGGKAGALGDSVTVTREKSKITVTSDSNFSKRYLKYLTKKYLKKHNVRDWLRVISSNKDRNVYELRYFNIAENEGEEED

SEQ ID NO: 10914 - protein, 105 aa, Humulus lupulus
MSRGSAAAPKGKKKGATFTIDCGKPVEDKIMDIASLEKFLQERIKVGGKAGALGDSVTVTREKSKITVTSDSNFSKRYLKYLTKKYLKKHNVRDLAPCDLIQQGS

SEQ ID NO: 10915 - protein, 124 aa, Euphorbia peplus
MSRGAAAVTKGKKKGATFTIDCAKPVEDKIMDIASLEKFLQERIKVGGKAGALGDSVTVSRDKSKITVTSDSNFSKRYLKYLTKKYLKKHNVRDWLRVIASNKDRSVYELRYFNIAENEGEEED

SEQ ID NO: 10916 - protein, 124 aa, Humulus lupulus
MSRGSAAAPKGKKKGATFTIDCGKPVEDKIMDIASLEKFLQERIKVGGKAGALGDSVTVTREKSKITVTSDSNFSKRYLKYLTKKYLKKHNVRDWLRVISSNKDRNVYELRYFNIAENEGEEED

SEQ ID NO: 10917 - protein, 124 aa, Trigonella foenum-graecum
MSRGSAAGAKGKKKGATFTIDCAKPVEDKIMDIASLEKFLQERIKVGGKAGALGDSVTVTRDKSKITVTSDSNFSKRYLKYLTKKYLKKHNVRDWLRVIASNKERSIYELRYFNIAENEGEEED

SEQ ID NO: 10918 - protein, 124 aa, Vigna unguiculata
MSRGGVTAAKGKKKGVTFTIDCAKPVEDKIMDIASLEKFLQERIKVAGKAGALGDTVAVAREKTKIIVTSDSNFSKRYLKYLTKKYLKKHNVRDWLRVIASNKDRSVYELRYFNIAENEGEEED

SEQ ID NO: 10919 - protein, 124 aa, Arachis hypogaea
MSRGGAVGAKGKKKGATFTIDCTKPVEDKIMDIASLEKFLQERIKVGGKAGALGDSVTVSREKNKITVTSDSNFSKRYLKYLTKKYLKKHNVRDWLRVIASNKDRNVYELRYFNIAENEGEEED

SEQ ID NO: 10920 - protein, 125 aa, Ricinus communis
MSRGSAAAGVKGKKKGATFTIDCAKPVEDKIMDIASLEKFLQERIKVGGKAGALGDSVTVTRGKSKITVASDSNFSKRYLKYLTKKYLKKHNVRDWLRVIASNKDRGVYELRYFNIAENEGEEED

SEQ ID NO: 10921 - protein, 367 aa, Ricinus communis
MSINVSFFLVLMMGSLFLLSCEAQDLKACKFDAIYQLGDSISDTGNSIVEIPPAFHSRLPYGETIGKATGRPSDGYLMIDFIAQSAGLPFLEPYENPNSKFTHGADFSVAGARAMSAEDLLKLNLDVGFTNSSLSVQLGWLKKVLSTVCNGPKDCQEKLKSSLFMVGLIGPNDLMAGLFKGDGIEKVKTTVLPAVLQTVIDGVQTVISYGASRVVVPGAYPLGCTPSLLTTYSVNKSAAYDSLGCLKDYNDFFAYYNTQLQIALENSRKANPNVIIIYSDFYSATQSILDNLSTLGFKAFRKACCGIGGEFNFTPTMQKTCGAKGVPVCPNPKEHVFWDGGHFSHHANMVLAEWLIKEMLPQLHCSA

SEQ ID NO: 10922 - protein, 124 aa, Humulus lupulus
MSRGSVAAPKGKKKGATFTIDCGKPVEDKIMDIASLEKFLQERIKVGGKAGALGDSVTVTREKSKITVTSDSNFSKRYLKYLTKKYLKKHNVRDWLRVISSNKDRNVYELRYFNIAENEGEEED

SEQ ID NO: 10923 - protein, 124 aa, Platanus occidentalis
MSRGSAAGTKGKKKGSTFTIDCAKPVEDKIMDIASLEKFLQERIKVGGKAGALGDSVTVAREKNKITVTSDSNFSKRYLKYLTKKYLKKHNVRDWLRVIASNKDRNVYELRYFNIAENEGEEED

SEQ ID NO: 10924 - protein, 124 aa, Tripterygium wilfordii
MSRGSAAVAKGKKKGATFTIDCGKPVEDKIMDIASLEKFLQERIKVGGKAGALGDSITVTREKSKITVTSDSNFSKRYLKYLTKKYLKKHNVRDWLRVIASNKDRNVYELRYFNIAENEAEEED

SEQ ID NO: 10925 - protein, 124 aa, Manihot esculenta
MSRGAAAGAKGKKKGASFVIDCAKPVEDKIMDIASLEKFLQERIKVGGKAGALGDTVTVTRDKTKITVTSDSNFSKRYLKYLTKKYLKKHNVRDWLRVIASNKDRNVYELRYFNIAENEGEEED

SEQ ID NO: 10926 - protein, 124 aa, Gossypium hirsutum
MSRGAAAGAKGKKKGASFTIDCAKPVEDKIMDIASLEKFLQERIKVGGKAGALGDSVTVTRDKTRITVTSDSNFSKRYLKYLTKKYLKKHNVRDWLRVIASNKDRNVYELRYFNIAENEGEEEE

SEQ ID NO: 10927 - protein, 124 aa, Vitis vinifera
MSRGSAAGAKGKKKGATFTIDCGKPVEDKIMDIASLEKFLQERIKVGGKAGALGDTVTVTREKSKITVTSESNFSKRYLKYLTKKYLKKHNVRDWLRVIASNKDRNVYELRYFNIAENEGEEED

SEQ ID NO: 10928 - protein, 124 aa, Vitis vinifera
MSRVSAAGAKGKKKGATFTIDCGKPVEDKIMDIASLEKFLQERIKVGGKAGALGDSVTVTREKSKIMVTSENNFSKRYLKYLTKKYLKKHNVRDWLRVIASNKDRNVYELRYFNIAENEGEEED

SEQ ID NO: 10929 - protein, 122 aa, Populus trichocarpa
MSRAAAAKGKKKGASFVIDCAKPVEDKIMDIASLEKFLQERIKVGGKAGALGDSVTVTREKNKITVTSDSNFSKRYLKYLTKKYLKKHNVRDWLRVISSNKDRNVYELRYFNIAENEGEEED

SEQ ID NO: 10930 - protein, 124 aa, Euphorbia esula
MSRGAAAGTKGKKKGATFTIDCAKPVEDKIMDIASLEKFLQERIKVGGKAGALGDSVTVSRDKNKITVTSDSNFSKRYLKYLTKKYLKKHNVRDWLRVIAANKDRSVYELRYFNIAENEGEEED

SEQ ID NO: 10931 - protein, 124 aa, Juglans hindsii x Juglans regia
MSRANAPGPKGKKKGATFTIDCAKPVEDKIMDIASLEKFLQERIKVGGKAGALGDTVTVTREKSKITVTSDSNFSKRYLKYLTKKYLKKHNVRDWLRVIASNKDRSVYELRYFNIAENEGEEED

SEQ ID NO: 10932 - protein, 127 aa, Linum usitatissimum
MSRGAAGGAAGAKGKKKGVTFTIDCGKPVEDKIMDIASLEKFLQERIKVGGKAGALGDSVTITREKNKITVTSDSNFSKRYLKYLTKKYLKKHNVRDWLRVIASNKDRSVYELRYFNIAENEGEEED

SEQ ID NO: 10933 - protein, 125 aa, Malus domestica
MSRGAAAGTKGGKKKGASFTIDCAKPVEDKIMDIASLEKFLQERIKVGGKAGALGDSVTVSREKNKITVTSDSNFSKRYLKYLTKKYLKKHNVRDWLRVIASNKDRNVYELRYFNIAENEGEEED

SEQ ID NO: 10934 - protein, 124 aa, Manihot esculenta
MSRGAVAGAKGKKKGAAFVIDCAKPVEDKIMDIASLEKFLQERIKVGGKAGALGDTVTVTRDKTKITVTSDSNFSKRYLKYLTKKYLKKHNVRDWLRVIASNKDRNVYELRYFNIAENEGEEED

SEQ ID NO: 10935 - protein, 123 aa, Castanea mollissima
MSRGAAGAKGKKKGATFVIDCAKPVEDKIMDIASLEKFLQERIKVGGKAGALGDSVTLSREKNKISVTSDSNFSKRYLKYLTKKYLKKHNVRDWLRVISSNKDRNVYELRYFNIAENEGEEED

SEQ ID NO: 10936 - protein, 124 aa, Lotus japonicus
MSRGGVAGAKGKKKSVSFTIDCAKPVEDKIMDIASLEKFLQERIKVGGKAGALGDAVTVAREKSKITVTSDSNFSKRYLKYLTKKYLKKHNVRDWLRVIASNKDRSVYELRYFNIAENEGEEED

SEQ ID NO: 10937 - protein, 127 aa, Linum usitatissimum
MSRGAAGGAAGAKGKKKGVTFTIDCGKPVEDKIMDIASLEKFLQERIKVGGKAGALGDSVTISREKNKITVTSDSNFSKRYLKYLTKKYLKKHNVRDWLRVIASNKDRSVYELRYFNIAENEGEEED

SEQ ID NO: 10938 - protein, 128 aa, Citrus sinensis
  misc_feature (73)..(73): Xaa can be any naturally occurring amino acid
MSRGSGGAAGGGAKGKKKGATFTIDCAKPVEDKIMDIASLEKFLQERIKVGGKAGALGDTVTVTRDKTKITVXSDSNFSKRYLKYLTKKYLKKHNVRDWLRVIASNKDRNVYELRYFNIAENEGEEED

SEQ ID NO: 10939 - protein, 126 aa, Scabiosa columbaria
MSRGGAAGGAKGGKKKGSTFTIDCGKPVEDKIMEIASLEKFLQERIKVGGKAGALGDSVTVTREKSKITVTSDSNFSKRYLKYLTKKYLKKNNVRDWLRVIASNKDRNVYELRYFNIAENEGEEED

SEQ ID NO: 10940 - protein, 126 aa, Ricinus communis
MSRGAAAGGAKGGKKRGATFTIDCAKPVEDKIMDIASLEKFLQERIKVGGKAGALGDTVSVSREKTKITVTSDSNFSKRYLKYLTKKYLKKHNVRDWLRVIASNKDRNVYELRYFNIAENEGEEED

SEQ ID NO: 10941 - protein, 125 aa, Beta vulgaris
MSRGSAVGGAKGKKKGASFTIDCAKPVEDKIMDIASLEKFLQERIKVGGKAGALGDSVTVTREKNKITVNSDSNFSKRYLKYLTKKYLKKHNVRDWLRVIASNKDRNVYELRYFNIAENEAEEED

SEQ ID NO: 10942 - protein, 125 aa, Bruguiera gymnorhiza
MSKGGAAGGAKAKKKGATFTIDCSKPVEDKIMDIASLEKFLQERIKVGGKAGALGDSVTVVREKSKIIVTSDSHFSKRYLKYLTKKYLKKHNVRDWLRVIAANKDRNVYELRYFNIAENEGEEED

SEQ ID NO: 10943 - protein, 124 aa, Euonymus alatus
MSRGSAAVAKGKKKGATFTIDCGKPVEDKIMDIASLEKFLKERIKVGGKAGALGDSITVTREKSKITVTSDSNFSKRYLKYLTKKYLKKHNVRDWLRVISSNKDRNVYELRYFNIAENEAEEED

SEQ ID NO: 10944 - protein, 124 aa, Platanus occidentalis
MSRGSAAGPKGKKKGSTFTIDCAKPVEDKIMDIASLEKFLQERIKVGGKAGALGDVVTVARDKNKITVTSDSNFSKRYLKYLTKKYLKKHNVRDWLRVIASNKDRNVYELRYFNIAENEGEEED

SEQ ID NO: 10945 - protein, 124 aa, Unknown
  Sequence found in Organisms: Cucumis sativus, Cucumis melo
MSRGGAAGPKGKKKGVTFTIDCSKPVEDKIMDIASLEKFLLERIKVGGKAGALGDSVSVTREKSKITVTSDSNFSKRYLKYLTKKYLKKHNVRDWLRVIAANKDRNVYELRYFNIAENEGEEED

SEQ ID NO: 10946 - protein, 124 aa, Cyamopsis tetragonoloba
MGRGSAAGAKGKKKSVTFTIDCAKPVEDKIMDIASLEKFLQERIKVGGKAGALGDTVSVTREKTKIIVTSDSDFSKRYLKYLTKKYLKKHNVRDWLRVIAANKDRNVYELRYFNIAENEGEEED

SEQ ID NO: 10947 - protein, 124 aa, Populus trichocarpa
MSKATAPGPKGKKKGATFTIDCAKPVEDKIMDIASLEKFLQERIKVGGKAGALGDAVTVTREKNKITVTSDSNFSKRYLKYLTKKYLKKHNVRDWLRVIASNKDRNVYELRYFNIAENEGEEED

SEQ ID NO: 10948 - protein, 124 aa, Prunus persica
MSRGAAAGTKGKKKGASFVIDCAKPVEDKIMDIASLEKFLQERIKVGGKAGALGDAVTVSREKNKITVTSDSNFSKRYLKYLTKKYLKKHNVRDWLRVIASNKDRGVYELRYFNIAENEGEEED

SEQ ID NO: 10949 - protein, 124 aa, Prunus persica
MSRGAAAGPKGKKKGVTFTIDCGKPVEDKIMDIASLEKFLQERIKVGGKAGALGDAVSVTREKSKITVTSDSNFSKRYLKYLTKKYLKKHNVRDWLRVIASNKDRNVYELRYFNIAENEGEEED

SEQ ID NO: 10950 - protein, 127 aa, Ricinus communis
MSKGGAAGGGGAKGKKKGATFTIDCAKPVEDKIMDIASLEKFLQERIKVGGKAGALGDSVTVTREKSKITVTSDSNFSKRYLKYLTKKYLKKHNVRDWLRVIASNKDRNVYELRYFNIAENEGDDEE

SEQ ID NO: 10951 - protein, 80 aa, Ricinus communis
MSQFISLQRNFVGFLCYFGIRKMNFLLEQPVILNVWVIEIFNFLIQKCLSQSYQPIHALILRLFELHLILYHLHIYCFYA

SEQ ID NO: 10952 - protein, 126 aa, Valeriana officinalis
MSRGGATGGAKGGKKKGSTFTIDCGKPVEDKIMEIASLEKFLQERIKVGGKAGALGDSVTVTREKSKITVTSDSNFSKRYLKYLTKKYLKKNNVRDWLRVIASNKDRNVYELRYFNIAENEGEEED

SEQ ID NO: 10953 - protein, 125 aa, Vinca minor
MSRGGAAGAKGGKKKGATFVIDCAKPVEDKIMEIASLEKFLQERIKVGGKAGALGDSVTVTRDKSKITVTSDSTFSKRYLKYLTKKYLKKHNVRDWLRVISSNKDRNVYELRYFNIAEGEGEEED

SEQ ID NO: 10954 - protein, 125 aa, Malus domestica
MSRGAAAGTKGGKKKGASFVIDCAKPVEDKIMDIASLEKFLQERIKVGGKAGALGESVTVSREKNKITVTSDSNFSKRYLKYLTKKYLKKHNVRDWLRVIASNKDRNVYELRYFNIAENEGEEED

SEQ ID NO: 10955 - protein, 125 aa, Malus domestica
MSRGTAAAGPKGKKKGVTFTIDCGKPVEDKIMDIASLEKFLQERIKVGGKAGALGDAVSVTREKSKITVTSDSNFSKRYLKYLTKKYLKKHNVRDWLRVIASNKDRNVYELRYFNIADNEGEEED

SEQ ID NO: 10956 - protein, 125 aa, Theobroma cacao
MSRGAAAGGAKGKKKGATFTIDCGKPVEDKIMDIASLEKFLQERIKVGGKAGNLGDSVTITREKSKITVTSDSAFSKRYLKYLTKKYLKKHNVRDWLRVIASNKDRNVYELRYFNIAENEAEEED

SEQ ID NO: 10957 - protein, 125 aa, Juglans hindsii x Juglans regia
MSRGAAAVGPKGKKKGATFVIDCAKPVEDKIMDIASLEKFLQERIKVGGKAGALGESITVVREKSKISVTSDSNFSKRYLKYLTKKYLKKHNVRDWLRVIASNKDRNVYELRYFNIAENEGEEED

SEQ ID NO: 10958 - protein, 124 aa, Chelidonium majus
MSRGTAAGPKGKKKVSTFTIDCAKPVEDKIMDIASLEKFLQERIKVGGKAGALGDAVTIAREKNKITVTSDSNFSKRYLKYLTKKYLKKHNVRDWLRVIASNKDRNVYELRYFNIAENEGEEED

SEQ ID NO: 10959 - protein, 124 aa, Cucurbita pepo
MSRGGAAGPKGKKKGVTFTIDCTKPVEDKIMDIASLEKFLLERIKVGGKAGALGDAVSVTREKSKITVTSDSNFSKRYLKYLTKKYLKKHNVRDWLRVIAANKDRNVYELRYFNIAENEGEEED

SEQ ID NO: 10960 - protein, 124 aa, Unknown
  Sequence found in Organisms: Cucurbita pepo, Momordica charantia, Citrullus lanatus
MSRGGAAGPKGKKKGVTFTIDCSKPVEDKIMDIASLEKFLLERIKVGGKAGALGDAVSVTREKSKITVTSDSNFSKRYLKYLTKKYLKKHNVRDWLRVIAANKDRNVYELRYFNIAENEGEEED

SEQ ID NO: 10961 - protein, 124 aa, Fagopyrum esculentum
MSRGAAGVAKGKKKGASFTLDCTKPVEDKIMDIASLEKFLQERIKVGGKAGALGDSVTVTREKNKITVTSDSNFSKRYLKYLTKKYLKKHNVRDWLRVIASNKDRNVYELRYFNIAENEAEEEE

SEQ ID NO: 10962 - protein, 124 aa, Malus domestica
MSRGTAAGPKGKKKGVTFTIDCGKPVEDKIMDIASLEKFLQERIKVGGKAGALGDAVSVTREKSKITVTSDSNFSKRYLKYLTKKYLKKHNVRDWLRVIASNKDRNVYELRYFNIADNEGEEED

SEQ ID NO: 10963 - protein, 124 aa, Theobroma cacao
MSRGVASGPKGKKKGASFTIDCAKPVEDKIMDIASLEKFLQERIKVGGKAGALGDSVTLTRDKSKITVTSDANFSKRYLKYLTKKYLKKHNVRDWLRVIASNKDRTVYELRYFNIAENEGEEEE

SEQ ID NO: 10964 - protein, 124 aa, Gossypium hirsutum
MSRGAAAGPKGKKKGASFTIDCSKPVEDKIMDIASLEKFLQERIKVGGKAGALGDSVTVTRDKSKITVSSDSNFSKRYLKYLTKKYLKKHNVRDWLRVIASNKDRTVYELRYFNIAENEGEEEE

SEQ ID NO: 10965 - protein, 123 aa, Mesembryanthemum crystallinum
MSRGAAVAKGKKKGASFTIDCTKPVDDKIMDIASLEKFLQERIKVGGKAGNLGDSVTVSREKNKITVTSDSNFSKRYLKYLTKKYLKKHNVRDWLRVIASNKDRNVYELRYFNIAENEAEEED

SEQ ID NO: 10966 - protein, 124 aa, Jatropha curcas
MSRGTATGTKGKKKGATFTVDCSKPVEDKIMDIASLEKFLQERIKVGGKAGALGDTVTVTREKSKITVTSESNFSKRYLKYLTKKYLKKHNVRDWLRVIASNKDRSIYELRYFNIAENEGEEED

SEQ ID NO: 10967 - protein, 124 aa, Lotus japonicus
MSRGVAAGAKGKKKAVTFTIDCAKPVEDKIMDIASLEKFLQERIKVGGKAGALGDVVSIARDKNKISVTSDSNFSKRYLKYLTKKYLKKHNVRDWLRVIASNKDRSVYELRYFNIAENEGEEED

SEQ ID NO: 10968 - protein, 124 aa, Rosa hybrid cultivar
MSRGAVAGAKGKKKGASFVIDCGKPVEDKIMDIASLEKFLQERIKVGGKAGALGDSVTVSREKNKITVTSDNTFSKRYLKYLTKKYLKKHNVRDWLRVIASNKDRNVYELRYFNIAENEGEEED

SEQ ID NO: 10969 - protein, 127 aa, Sarracenia psittacina
MSRGGSASGGGAKGKKKGATFTIDCAKPVEDKIMEVASLEKFLQERIKVGGKAGALGDSVTVTREKSKIVVTSDSNFSKRYLKYLTKKYLKKNNVRDWLRVIASNKDRNVYELRYFNIAENEGEDED

SEQ ID NO: 10970 - protein, 127 aa, Manihot esculenta
MSRGGAAGAGGAKGKKKGATFTIDCSKPVEDKIMDIASLEKFLQERIKVGGKAGALGDSVTVTREKFKVTVTCDSNFSKRYLKYLTKKYLKKHNVRDWLRVIASNKDRNVYELRYFNIAENEGEDEE

SEQ ID NO: 10971 - protein, 126 aa, Amsonia hubrichtii
MSRGAGAAGAKGGKKKGATFVIDCAKPVEDKIMEIASLEKFLQERIKVGGKAGALGDSVTVTRDKSKITVTSDSTFSKRYLKYLTKKYLKKHNVRDWLRVISSNKDRNVYELRYFNIAEGEGEEED

SEQ ID NO: 10972 - protein, 126 aa, Tabernaemontana elegans
MSRGAGAAGAKGGKKKGATFVIDCAKPVEDKIMEITSLEKFLQERIKVGGKAGALGDSVTVTRDKSKITVTSDSAFSKRYLKYLTKKYLKKHNVRDWLRVIASNKDRNVYELRYFNIAEGEGEEED

SEQ ID NO: 10973 - protein, 125 aa, Fagopyrum esculentum
MSRGAAAGVAKGKKKGVSFTLDCTKPVEDKIMDIASLEKFLQERIKVGGKAGALGDSVTVSREKNKITVTSDSNFSKRYLKYLTKKYLKKHNVRDWLRVIASNKDRSIYELRYFNIAENEAEEED

SEQ ID NO: 10974 - protein, 125 aa, Vitis vinifera
MSRGSATGGPKGKKKGATFTIDCAKPVEDKIMDIASLEKFLQERIKVGGKAGALGDSVTVTRDKSKITVTSESSFSKRYLKYLTKKYLKKHNVRDWLRVIASNKDRNVYELRYFNIAENEGEDED

SEQ ID NO: 10975 - protein, 125 aa, Arachis hypogaea
MSRGAGAGGAKGKKKGASFVIDCAKPVEDKIMDIASLEKFLQERIKVGGKAGALGDSVTVTRDKSKITVTSDSSFSKRYLKYLTKKYLKKHNVRDWLRVISSNKDRNVYELRYFNIAENEGEEEE

SEQ ID NO: 10976 - protein, 125 aa, Populus trichocarpa
MSKAAAAGGAKGKKKGASFVIDCAKPVEDKIMDIASLEKFLQERIKVGGKAGALGDTVTVTREKSKITVTSDSNFSKRYLKYLTKKYLKKHNVRDWLRVISSNKDRNVYELRYFNIAENEGEEED

SEQ ID NO: 10977 - protein, 125 aa, Rhizophora mangle
MSKGGAAGGAKIKKKGATFTIDCSKPVEDKIMDIASLEKFLQERIKVGGKAGALGDSITVVREKSKIIVTSDSPFSKRYLKYLVKKYLKKHNVRDWLRVIAANKDRNVYELRYFNIAENEGEEED

SEQ ID NO: 10978 - protein, 124 aa, Vitis vinifera
MSRGTASGPKGKKKSATFTIDCSKPVEDKIMDVASLEKFLQERIKVGGKAGALGDSVTVTREKSKITVTSDSNLSKRYLKYLTKKYLKKHNVRDWLRVIASNKDRNVYELRYFNIAENEGEEEE

SEQ ID NO: 10979 - protein, 124 aa, Tripterygium wilfordii
MSRGSATGAKGKKKEATFTIDCGKPVEDKIMDIASLEKFLQERIKVGGKAGALGDSITVSREKSKITVTSGSNFSKRYLKYLTKKYLKKHNVRDWLRVIASNKDRNVYELRYFNIAENEAEEED

SEQ ID NO: 10980 - protein, 124 aa, Acacia harpophylla
MSRGTSTGAKGKKKGATFVIDCAKPVEDKIMDIASLEKFLQERIKVGGKAGALGDSVTVSRDKSKITVTSDSNFSKRYLKYLTKKYLKKHNVRDWLRVIAANKERNVYELRYFNIAENEGEEED

SEQ ID NO: 10981 - protein, 123 aa, Phaseolus coccineus
MSRGVTAPKGKKKGVTFTIDCAKPVEDKIMDIASLEKFLQERIKVAGKAGALGDTVAVAREKTKIIVTSDSNFSKRYLKYLTKKYLKKHNVRDWLRVIASNKDRNIYELRYFNIAENEGEEEE

SEQ ID NO: 10982 - protein, 121 aa, Hevea brasiliensis
GPAAGAKGKKKGAAFVIDCGKPVEDKIMDIASLEKFLQERIKVGGKAGALGDTVTVTRDKTKITVTSDSNFSKRYLKYLTKKYLKKHNVRDWLRVIASNKDRNVYELRYFNIAENEGEEED

SEQ ID NO: 10983 - protein, 116 aa, Pisum sativum
AKGKKKGATFTIDCAKPVEDKIMDIASLEKFLQERIKVGGKAGALGDSVTVTREKSKITVTSDSNFSKRYLKYLTKKYLKKHNVRDWLRVIASNKDRNIYELRYFNIAENEGEEED

SEQ ID NO: 10984 - protein, 128 aa, Actinidia deliciosa
MSRGGSAAAGGGAKGKKKAATFTIDCAKPVEDKIMEIASLEKFLQERIKVGGKAGALGDSVTVTRDKSKITVTSDSNFSKRYLKYLTKKYLKKHNVRDWLRVISSNKDRSAYELRYFNIAENEGEDED

SEQ ID NO: 10985 - protein, 127 aa, Sarracenia psittacina
MSRGGSTSGGGAKGKKKGATFTIDCAKPVEDKIMEVASLEKFLQERIKVGGKAGALGDSVTVTREKSKIVVTSDSNFSKRYLKYLTKKYLKKNNVRDWLRVIASNKDRNVYELRYFNIAENEGEDED

SEQ ID NO: 10986 - protein, 126 aa, Unknown
  Sequence found in Organisms: Cucumis sativus, Cucurbita pepo, Cucumis melo, Momordica charantia, Citrullus lanatus
MSRGAAASGGPKGKKKGVTFVIDCAKPVEDKIMDIASLEKFLLERIKVGGKAGALGDSVTVTRDKNKITVNSDSNFSKRYLKYLTKKYLKKHNVRDWLRVIASNKDRNVYELRYFNIAENEGEEED

SEQ ID NO: 10987 - protein, 126 aa, Vinca minor
MSRGAGAAGAKGGKKKGATFVIDCAKPVEDKIMEITSLEKFLQERIKVGGKAGALGDSVTVTRDKSKITVTSDSTFSKRYLKYLTKKYLKKHNVRDWLRVISSNKDRNVYELRYFNIAEGEGEEED

SEQ ID NO: 10988 - protein, 126 aa, Unknown
  Sequence found in Organisms: Cynara scolymus, Carthamus tinctorius
MSRGAGGAGAKGGKKKGATFVIDCGKPVEDKIMEIASLEKFLQERIKVGGKAGNLGDSVTISREKNKISVTSDSNFSKRYLKYLTKKYLKKHNVRDWLRVIASNKDRNVYELRYFNIAENEGEEED

SEQ ID NO: 10989 - protein, 126 aa, Panax ginseng
MSKGTGGAAGAKGKKKGATFVIDCGKPVEDKIMDIASLEKFLQERIKVGGKAGALGDSVSVVREKSKITVTSDNSFSKRYLKYLTKKYLKKNNVRDWLRVIASNKDRNVYELRYFNIAENEGEEED

SEQ ID NO: 10990 - protein, 126 aa, Actinidia deliciosa
  misc_feature (6)..(6): Xaa can be any naturally occurring amino acid
  misc_feature (19)..(19): Xaa can be any naturally occurring amino acid
MSRGSXAAAAAKGKKKGVXFTIDCGKPVEDKIMDIASLEKFLQERIKVGGKAGALGDSVTVSREKSKITVTSDSDFSKRYLKYLTKKYLKKHNVRDWLRVIASNKERNVYELRYFNIAENEGEDED

SEQ ID NO: 10991 - protein, 125 aa, Unknown
  Sequence found in Organisms: Euphorbia peplus, Euphorbia esula
MSRAAGAGGPKGKKKGATFTIDCTKPVEDKIMDIASLEKFLQERIKVGGKAGALGDSVTVSREKSKITVTSDSNFSKRYLKYLTKKYLKKHNVRDWLRVIAANKDRNVYELRYFNIAENEGEDEE

SEQ ID NO: 10992 - protein, 125 aa, Fagopyrum esculentum
MTRGAAAGVAKGKKKGVSFTLDCTKPVEDKIMDIASLEKFLQERIKVGGKAGALGDSVTVSREKNKITVTSDSNFSKRYLKYLTKKYLKKHNVRDWLRVIASNKDRSIYELRYFNIAENEAEEED

SEQ ID NO: 10993 - protein, 125 aa, Fagopyrum esculentum
MSRGSAAGVAKGKKKGVSFTLDCTKPVEDKIMDIASLEKFLQERIKVGGKAGALGDSVTISREKNKITVTSDSNFSKRYLKYLTKKYLKKHNVRDWLRVIASNKDRSIYELRYFNIAENEAEEED

SEQ ID NO: 10994 - protein, 123 aa, Silene vulgaris
MSKAAATKGGKKKGATFTIDCTKPVEDKIMDIASLEKFLQERIKVGGKAGNLGDSVTVSREKNKITVTSDSNFSKRYLKYLTKKYLKKHNVRDWLRVIAANKDRNVYELRYFNIAENEAEEED

SEQ ID NO: 10995 - protein, 91 aa, Tripterygium wilfordii
MSKGSGGPAKAGKKKGATFTIDCGKPVEDKIMDIASLEKFLQERIKVGGKAGALGDSITISREKSKITVTSDSNFSKRYLKYLTKKVLEEA

SEQ ID NO: 10996 - protein, 125 aa, Medicago truncatula
MGRVDAAGSKGKKKGVITFTIDCAKPVEDKIMDIASLEKFLQERIKVGGKPGALGDAVTVSREKSKIAVTSDSNFSKRYLKYLTKKYLKKHNVRDWLRVIASNKDRNVYELRYFNIAENEGEEED

SEQ ID NO: 10997 - protein, 125 aa, Avena sativa
MGRVDAAGSKGKKKGSTTFTIDCAKPVEDKIMDIASLEKFLQERIKVGGKAGALGDAVTVSREKSKITVTSDSNFSKRYLKYLTKKYLKKHNVRDWLRVISSNKDRNVYELRYFNIAENEGEEED

SEQ ID NO: 10998 - protein, 124 aa, Euonymus alatus
MSRGSATGAKGKKKEATFTIDCGKPVEDKIMDIASLEKFLKERIKVGGKAGALGDSITITREKSKITVTSNSNFSKRYLKYLTKKYLKKHNVRDWLRVIASNKDRNVYELRYFNIAENEAEEED

SEQ ID NO: 10999 - protein, 124 aa, Sarracenia psittacina
MSRGATAGLKGKKKGATFVIDCGKPVEDKIMDIATLEKFLQERIKVGGKAGALGDSVTVTRDKNKITVTSDSNFSKRYLKYLTKKYLKKYNVRDWLRVIASNKDRNVYELRYFNIAENEGEDED

SEQ ID NO: 11000 - protein, 124 aa, Sarracenia psittacina
MSRGAAAGPKGKKKGATFVIDCGKPVEDKIMDIATLEKFLQERIKVGGKAGALGDSVTVTRDKNKITVTSDSNFSKRYLKYLAKKYLKKYNVRDWLRVIASNKDRNVYELRYFNIAENEGEDED

SEQ ID NO: 11001 - protein, 124 aa, Tripterygium wilfordii
MSRGTATGAKGKKKGATFVIDCAKPVEDKIMDIASLEKFLQERIKVGGKAGALGDAITVTREKSKITVTSSSDFSKRYLKYLTKKYLKKHNVRDWLRVISSNKDRNVYELRYFNIAENEGEEEE

SEQ ID NO: 11002 - protein, 124 aa, Persea americana
MSRGSAAGPKGKKKASTFTIDCAKPVEDKIMDIASLEKFLQERIKVGGKAGALGDVVSISREKNKISVTSDSAFSKRYLKYLTKKYLKKHNVRDWLRVIASNKDRNVYELRYFNIAENEGEEED

SEQ ID NO: 11003 - protein, 124 aa, Castanea mollissima
MSRGSAPVPKGKKKGVSFTVDCTKPVEDKIMDIASLEKFLQERIKVGGKAGALGDTVTVTREKSKITVTSDSNFSKRYLKYLTKKYLKKHNVRDWLRVISSNKDRNVYELRYFNIAENEGEEED

SEQ ID NO: 11004 - protein, 123 aa, Gerbera hybrid cultivar
MSRGAGAKGGKKKGATFVIDCGKPVEDKIMEIASLEKFLQERIKVGGKAGNLGDSVTISREKNKISVTSDSNFSKRYLKYLTKKYLKKHNVRDWLRVIASNKDRNVYELRYFNIAENEGEEED

SEQ ID NO: 11005 - protein, 115 aa, Jatropha curcas
RGRRKEQLSLLIARSRWRIRSWTLPLSKKFLQERIKVGGKAGALGDSVTVTREKSKITVTSDSNFSKRYLKYLTKKYLKKHNVRDWLRVIASNKDRNVYELRYFNIAENEGEEEE

SEQ ID NO: 11006 - protein, 124 aa, Tropaeolum majus
MSRSNVAGSKGKKKGVTFTIDCAKPVEDKIMDIASLEKFLQERIKVGGKAGALGDSVTITREKTKIVVTSDSTFSKRYLKYLTKKYLKKHNVRDWLRVIAANKDRNVYELRYFNIAENDAEEED

SEQ ID NO: 11007 - protein, 124 aa, Populus trichocarpa
MSKATASGAKGKKKGVTFTVDCTKPVEDKIMDIASLEKFLQERIKVGGKAGALGDTVTVTREKSKITVTSDSNFSKRYLKYLTKKYLKKHNVRDWLRVISSNKDRNVYELRYFNIAENEGEEED

SEQ ID NO: 11008 - protein, 128 aa, Musa acuminata
MSRGGAAAAAAKGGKKKGSTFVIDCAKPVEDKIMDIASLEKFLQERIKVAGGKAGALGDAVTVTRDKSKITVTSEGPFSKRYLKYLTKKYLKKHNVRDWLRVIASNKDRNVYELRYFNIAENEGEEEE

SEQ ID NO: 11009 - protein, 128 aa, Quercus alba
MSRRAAGTGAAGLKGKKKGATFVIDCAKPVEDKIMDIASLEKFLQERIKVGGKAGALGDSVIVSREKNKISVTSDSNFSKRYLKYLTKKYLKKHNVRDWLRVISSNKDRNIYELRYFNIAENEGEEED

SEQ ID NO: 11010 - protein, 127 aa, Mimulus guttatus
MSKGGAAAAGAKGGKKKVATYVIDCAKPVEDKIMEIASLEKFLQERIKVGGKAGALGDSVTVTREKNKITVTADATFSKRYLKYLTKKYLKKHNVRDWLRVIASNKDRNVYELRYFNIAEQEGEEED

SEQ ID NO: 11011 - protein, 126 aa, Catharanthus roseus
MSRGAGAAGAKGGKKKGATFVIDCAKPVEDKIMEITSLEKFLQERIKVGGKAGALGESVTVTRDKNKITVTSDSAFSKRYLKYLTKKYLKKHNVRDWLRVISSNKDRNVYELRYFNIAEGEGEEED

SEQ ID NO: 11012 - protein, 126 aa, Unknown
  Sequence found in Organisms: Centaurea maculosa, Cirsium arvense
MSRGAGGAGAKGGKKKAATFVIDCGKPVEDKIMEIASLEKFLQERIKVGGKAGNLGDSVTISREKNKISVTSDSNFSKRYLKYLTKKYLKKHNVRDWLRVIASNKDRNVYELRYFNIAENEGEEED

SEQ ID NO: 11013 - protein, 126 aa, Cirsium arvense
MSRGAGGAGAKGGKKKSATFVIDCGKPVEDKIMEIASLEKFLTERIKVGGKAGNLGDSVTITREKNKISVTSDSNFSKRYLKYLTKKYLKKHNVRDWLRVIASNKDRNVYELRYFNIAENEGEEED

SEQ ID NO: 11014 - protein, 126 aa, Cucurbita pepo
MSRGAAASGGPKGKKKGVTFVIDCAKPVEDKIMDIASLEKFLLERIKVGGKAGALGDAVTVTRDKNKITVNSDSNFSKRYLKYLTKKYLKKHNVRDWLRVIASNKDRNVYELRYFNIAENEGEEED

SEQ ID NO: 11015 - protein, 126 aa, Flaveria ramosissima
MSRGAGAAGAKGGKKKQSTFVIDCGKPVEDKIMEIASLEKFLQERIKVGGKAGNLGDSVTITREKNKISVTADSNFSKRYLKYLTKKYLKKHNVRDWLRVIASNKDRNVYELRYFNIAENEGEEED

SEQ ID NO: 11016 - protein, 126 aa, Cichorium intybus
MSRGAGGAGAKGGKKKSATFVIDCGKPVEDKIMEIASLEKFLQERIKVGGKAGNLGDSVTISREKNKISVTSDSNFSKRYLKYLTKKYLKKHNVRDWLRVIASNKDRNVYELRYFNIAENEGEEED

SEQ ID NO: 11017 - protein, 126 aa, Cichorium intybus
MSRGAGSAGAKGGKKKAATFVIDCGKPVEDKIMEIASLEKFLQERIKVGGKAGNLGDSVTISREKNKISVTSDSNFSKRYLKYLTKKYLKKHNVRDWLRVIASNKDRNVYELRYFNIAENEGEEED

SEQ ID NO: 11018 - protein, 126 aa, Triphysaria pusilla
MSKGVAAGAAKGGKKKGSTFVIDCAKPVEDKIMDIASLEKFLQERIKVGGKAGALGDSVTVTREKNKITVNADAAFSKRYLKYLTKKYLKKHNVRDWLRVIASNKERNVYELRYFNIAEQEGEEED

SEQ ID NO: 11019 - protein, 125 aa, Euphorbia peplus
MSRAAGAGGPKGKKKGATFTIDCTKPVDDKIMDIASLEKFLQERIKVGGKAGALGDSVTVSREKSKITVTSDSNFSKRYLKYLTKKYLKKHNVRDWLRVIAANKDRNVYELRYFNIAENEGEDEE

SEQ ID NO: 11020 - protein, 125 aa, Lippia dulcis
MSKGAAAAAKGGKKKGASFVIDCSKPVEDKIMEITSLEKFLQERIKVGGKAGALGDSVTVTREKNKITITADSAFSKRYLKYLTKKYLKKHNVRDWLRVIASNKDRNVYELRYFNIAEQEGEEED

SEQ ID NO: 11021 - protein, 125 aa, Trigonella foenum-graecum
MGRVDAAGSKGKKKGVITFTIDCAKPVEDKIMDIASLEKFLQERIKVGGKPGALGDAVTVSREKSKITVTSDSNFSKRYLKYLTKKYLKKHNVRDWLRVIASNKERNVYELRYFNIAENEGEEED

SEQ ID NO: 11022 - protein, 125 aa, Lactuca sativa
MSRAGGAGAKGGKKKSATFVIDCGKPVEDKIMEIASLEKFLQERIKVGGKAGNLGDSVTISREKNKISVTSDSNFSKRYLKYLTKKYLKKHNVRDWLRVIASNKDRNVYELRYFNIAENEGEEED

SEQ ID NO: 11023 - protein, 124 aa, Unknown
  Sequence found in Organisms: Brassica napus, Brassica juncea, Brassica rapa, Raphanus sativus
MSRGGAAVAKGKKKGVSFSIDCSKPVDDKIMEIASLEKFLQERIKVGGKAGALGDSVTITREKNKITVTSDGQFSKRYLKYLTKKYLKKHNVRDWLRVIAANKDRNLYELRYFNIAENEGEEED

SEQ ID NO: 11024 - protein, 115 aa, Euphorbia peplus
KGKKKGATFTIDCAKPVEDKIMDIASLEKFLQERIKVGGKAGALGDSVTVSRDKNKITVTSDSNFSKRYLKYLTKKYLKKHNVRDWLRVIAANKDRSVYELRYFNIAENEGEEED

SEQ ID NO: 11025 - protein, 121 aa, Valeriana officinalis
RAGVAKGGKKKGSTFTIDCGKPVEDKIMEIASLEKFLQERIKVGGKAGALGDSVTVTREKSKITVTSDSNFSKRYLKYLTKKYLKKNNVRDWLRVIASNKDRNVYELRYFNIAENEGEEED

SEQ ID NO: 11026 - protein, 124 aa, Arabidopsis lyrata
MSRGIAAVAKGKKKGVSFTIDCSKPVDDKIMEIASLEKFLQERIKVGGKAGALGDSVTITREKSKITVTSDGQFSKRYLKYLTKKYLKKHNVRDWLRVIAANKDRNLYELRYFNIAENEGEEED

SEQ ID NO: 11027 - protein, 124 aa, Arabidopsis thaliana [sequence omitted]

SEQ ID NO: 11028 - protein, 124 aa, Aristolochia fimbriata
MSRGSAAGPKGKKKGATFTIDCAKPVEDKIMDIASLEKFLQERIKVGGKAGALGDVISITRDKSKITVTSDSALSKRYLKYLTKKYLKKHNVRDWLRVIASNKDRNMYELRYFNIAENEGEEED

SEQ ID NO: 11029 - protein, 119 aa, Cicer arietinum
MSGAKGKKKGTSFVIDCAKPVEDKIMDIASLEKFLQERIKVGGKAGALGDSVTVTREKSKITVTSDSNFSKRYLKYLTKKYLKKHNVRDWLRVIASNKDRNVYELRYFNIAENEGEEED

SEQ ID NO: 11030 - protein, 124 aa, Cleome gynandra
MSRGGAVAPKGKKKNVSFTIDCSKPVEDKIMEIASLEKFLQERIKVGGKAGALGDTVTITRDKTKITVTSDSQFSKRYLKYLTKKYLKKHNVRDWLRVIASNKDRNLYELRYFNIAENEGEEED

SEQ ID NO: 11031 - protein, 124 aa, Cleome spinosa
MSRGGAVAPKGKKKNVSFTIDCSKPVEDKIMEIASLEKFLQERIKVGGKAGALGDTVTITRDKNKITVTSDSQFSKRYLKYLTKKYLKKHNVRDWLRVIASNKDRNVYELRYFNIAENEGEEED

SEQ ID NO: 11032 - protein, 124 aa, Heritiera littoralis
MSRGSAAGPKGKKKGVTFTIDCTKPVEDKIMDIASLEKFLQERIKVGGKAGALGEIVTLTREKSKITVTSDGAFSKRYLKYLTKKYLKKHNVRDWLRVIASNKDRTVYELRYFNIAENEADEED

SEQ ID NO: 11033 - protein, 124 aa, Quercus alba
MSRGSAPVPKGKKKGVSFTVDCTKPVEDKIMDIASLEKFLQERIKVGGKAGALGDTVTVTREKSKITVASDSNFSKRYLKYLTKKYLKKHNVRDWLRVISSNKDRNVYELRYFNIAENEGEEED

SEQ ID NO: 11034 - protein, 124 aa, Carthamus tinctorius
MSRVAGGAKGGKKKGATFVIDCGKPVEDKIMEIASLEKFLQERIKVGGKAGNLGDSVTITREKNKISVTSDSNFSKRYLKYLTKKYLKKHNVRDWLRVIASNKDRNVYELRYFNIAENEGEEED

SEQ ID NO: 11035 - protein, 124 aa, Fragaria vesca
MSRLAVSGAKGKKKGASFVIDCGKPVEDKIMDIASLEKFLQERIKVGGKAGALGDSVSVTREKNKITVTSDSTFSKRYLKYLTKKYLKKHNVRDWLRVIASNKDRNVYELRYFNIADNEGEEED

SEQ ID NO: 11036 - protein, 77 aa, Vitis vinifera
MLKYRNSYTLRSLLEAITRSQSLTLCFFKYFFVKYFRYLRYRLEKLLSEVTVILLLSRVTVTESPRAPALPPTLMRS

SEQ ID NO: 11037 - protein, 127 aa, Cirsium arvense
MSRGAGGAGGAKGGKKKAATFVIDCGKPVEDKIMEIASLEKFLQERIKVGGKAGNLGDSVTISREKNKISVTSDSNFSKRYLKYLTKKYLKKHNVRDWLRVIASNKDRNVYELRYFNIAENEGEEED

SEQ ID NO: 11038 - protein, 127 aa, Cleome spinosa
MSRGAAASVAAKGGKKKAASFVIDCSKPVEDKIMDIASLEKFLQERIKVGGKPGALGDAITVTRDKNKITVTADTNFSKRYLKYLTKKYLKKHNVRDWLRVIASNKDRSVYELRYFNIAENEGEEED

SEQ ID NO: 11039 - protein, 127 aa, Eucalyptus grandis
MSRGGSSGGGAKAAKKKGATFVIDCAKPVEDKIMDIASLEKFLQERIKVDGKAGALGDSVTVSRDKSKITVTSTSDFSKRYLKYLTKKYLKKHNVRDWLRVIASNKDRSVYELRYFNIAENEGEEED

SEQ ID NO: 11040 - protein, 127 aa, Elaeis guineensis
  misc_feature (103)..(103): Xaa can be any naturally occurring amino acid
MSRGASGVAAKGGKKKGSTFTIDCAKPVEDKIMEIASLEKFLQERIKVAGGKAGALGDQVTVTRDKSKITVTSEGPFSKRYLKYLTKKYLKKHNVRDWLRVIXSNKDRSVYELRYFNIAENEGEEED

SEQ ID NO: 11041 - protein, 127 aa, Populus trichocarpa
MSKGAAAVGGAKGKKKGATTFTIDCAKPVEDKIMDIASLEKFLQERIKVGGKPGALGDSVTVTRDKSKITVTCDSSFSKRYLKYLTKKYLKKHNVRDWLRVISSNKDRNAYELRYFNIAENEGEEED

SEQ ID NO: 11042 - protein, 125 aa, Vinca minor
SRGAGAAGTKGGKKKGATFVIDCAKPVEDKIMEIASLEKFLQERIKVGGKAGALGDSVNVTRDKSKITVTSDSTFSKRYLKYLTKKYLKKHNVRDWLRVISSNKDRNVYELRYFNIAEGEGEEED

SEQ ID NO: 11043 - protein, 126 aa, Cichorium intybus
MSRGAGGAGAKGGKKKTSTFVIDCGKPVEDKIMEIASLEKFLQERIKVGGKAGNLGDSVTISREKNKISVTSDSNFSKRYLKYLTKKYLKKHNVRDWLRVIASNKDRNVYELRYFNIAENEGEEED

SEQ ID NO: 11044 - protein, 126 aa, Triphysaria pusilla
MSKGVAAGGAKGGKKKGSTFVIDCAKPVEDKIMDIASLEKFLQERIKVGGKAGALGDSVTVTREKNKITVNADAAFSKRYLKYLTKKYLKKHNVRDWLRVIASNKERNVYELRYFNIAEQEGEEED

SEQ ID NO: 11045 - protein, 120 aa, Valeriana officinalis
AGVAKGGKKKGSTFTIDCGKPVEDKIMEIASLEKFLQERIKVGGKAGALGDSVTVTREKSKITVTSDSNFSKRYLKYLTKKYLKKNNVRDWLRVIASNKDRNVYELRYFNIAENEGEEED

SEQ ID NO: 11046 - protein, 123 aa, Taraxacum officinale
MSRVAGAKGGKKKTATFVIDCGKPVEDKIMEIASLEKFLQERIKVGGKAGNLGDSVTISREKNKISVTSDSNFSKRYLKYLTKKYLKKHNVRDWLRVIASNKDRNVYELRYFNIAENEGEEED

SEQ ID NO: 11047 - protein, 125 aa, Tragopogon dubius
MSRAGGAGAKGGKKKAATFVIDCGKPVEDKIMEIASLEKFLQERIKVGGKAGNLGDSVTISREKNKISVTADSNFSKRYLKYLTKKYLKKHNVRDWLRVIASNKDRNVYELRYFNIAENEGEEED

SEQ ID NO: 11048 - protein, 345 aa, Triphysaria pusilla
MDFLFGNLSGGSSSFNQDIVRCPFLRNINEPTNLSFSTAMTFPIPAREGKGPIFEDGPNFDTAFRLFHGQNGVVPLSGRSFVRTEKPNPRSESSPAQFNPLAAKAATISLSGFGPGGPFGFDAFSEKFKNAKKKSESSKNEKRDKTKSEHEAMGDEWLKSGNCPIAKSYRAVSSVLPLVAKALQPPSGFNYRCPKAIVAARSALAKTAFAKNLRPQPLPSKVLVIGVLGMAANIPLGVWREHTEKFSPSWFAAVHAAVPFIAMIRKSVLMPKAAMAFTIAASILGQVIGSRAERYRLKKLVLDQGLVSGGPAAGLGFETGRCGELVEWKENRVQVASSSSGDVFG

SEQ ID NO: 11049 - protein, 125 aa, Triphysaria pusilla
MSKGVAAAAKGGKKKGSTFVIDCSKPVEDKIMEIASLEKFLQERIKVGGKAGALGESVTVTREKNKITVNADANFSKRYLKYLTKKYLKKHNVRDWLRVIASNKERNVYELRYFNIAEQEGEEED

SEQ ID NO: 11050 - protein, 124 aa, Unknown
  Sequence found in Organisms: Centaurea maculosa, Cirsium arvense
MSRAAGGAKGGKKKSATFVIDCGKPVEDKIMEIASLEKFLQERIKVGGKAGNLGDSVTITREKNKISVTSDSNFSKRYLKYLTKKYLKKHNVRDWLRVIASNKDRNVYELRYFNIAENEGEEED

SEQ ID NO: 11051 - protein, 124 aa, Euonymus alatus
MSRGTATGAKGKKKGATFVIDCAKPVEDKIMDIASLEKFLKERIKVGGKAGALGDAITVTREKSKITVTSSSDFSKRYLKYLTKKYLKKHNVRDWLRVISSNKDRNIYELRYFNIAENEGEEEE

SEQ ID NO: 11052 - protein, 124 aa, Unknown
  Sequence found in Organisms: Thellungiella halophila, Eutrema halophilum
MSRGGAAAPKGKKKGVSFTIDCSKPVDDKIMEIASLEKFLQERIKVGGKAGALGDSVSITREKNKITVTSDGQFSKRYLKYLTKKYLKKHNVRDWLRVIAANKDRNLYELRYFNIAENEAEEED

SEQ ID NO: 11053 - protein, 124 aa, Eutrema parvulum
MSRGSAAVAKGKKKGVSFTIDCSKPVDDKIMEIASLEKFLQERIKVGGKAGALGDSVTITRDKNKITVTSDGQFSKRYLKYLTKKYLKKHNVRDWLRVIAANKDRNLYELRYFNIAENEGEEED

SEQ ID NO: 11054 - protein, 124 aa, Tripterygium wilfordii
MSRGAGTGAKGKKKGATFVIDCAKPVEDKIMDIASLEKFLQERIKVGGKAGALGDDITVTREKSKITVTSSNDFSKRYLKYLTKKYLKKHNVRDWLRVISSNKDRNVYELRYFNIAENEREEEE

SEQ ID NO: 11055 - protein, 124 aa, Unknown
  Sequence found in Organisms: Brassica napus, Brassica juncea, Brassica oleracea, Brassica rapa, Raphanus sativus
MSRGSAAVAKGKKKGVSFSIDCSKPVDDKIMEIASLEKFLQERIKVGGKAGALGDSVTITREKNKITVTSDGQFSKRYLKYLTKKYLKKHNVRDWLRVIAANKDRNLYELRYFNIAENEGEEED

SEQ ID NO: 11056 - protein, 124 aa, Brassica oleracea
MSRGSAAVAKGKKKGVSFSIDCSKPVDDKIMEIASLEKFLQERIKVGGKAGALGDSVTITREKNKITVTSDGKFSKRYLKYLTKKYLKKHNVRDWLRVIAANKDRNLYELRYFNIAENEGEEED

SEQ ID NO: 11057 - protein, 119 aa, Phaseolus coccineus
MSGAKGKKKASSFVIDCAKPVEDKIMDIASLEKFLQERIKVGGKAGALGDSVTVTREKSKITVTSDSNFSKRYLKYLTKKYLKKHNVRDWLRVIASNKDRNVYELRYFNIAENEGEEED

SEQ ID NO: 11058 - protein, 122 aa, Gossypium hirsutum
MSRTAGSKGKKKGVTFTIDCSKPVEDKIMDIASLEKFLQERIKVGGKAGALGETVALTREKSKITVTSDGDFSKRYLKYLTKKYLKKHNVRDWLRVIASNKDRTVYELRYFNIAENEGEEED

SEQ ID NO: 11059 - protein, 124 aa, Eschscholzia californica
MSRGNAATPKGKKKTVTFTIDCAKPVEDKIMDIASLEKFLQERIKVGGKAGALGDAVTISREKNKISVTSDSTFSKRYLKYLTKKYLKKHNVRDWLRVIAANKDKNVYELRYFNIAENEGEEEE

SEQ ID NO: 11060 - protein, 124 aa, Actinidia deliciosa
MSRGTVAGPKGKKKGATFVLDCGKPVEDKIMEIASLEKFLQERIKVGGKAGALGDSVTVTREKNKITVTSDNTFSKRYLKYLTKKYLKKHNVRDWLRVIASNKERNVYELRYFNIQENEGEDED

SEQ ID NO: 11061 - protein, 119 aa, Glycyrrhiza uralensis
MSGAKGKKKGTSFVIDCAKPVEDKIMDIASLEKFLQERIKVGGKAGALGDSVTVTRDKTKITVTFDSNFSKRYLKYLTKKYLKKHNVRDWLRVIASNKDRNVYELRYFNIAENEGEEED

SEQ ID NO: 11062 - protein, 123 aa, Petunia hybrida
MSKVGAAKGGKKKGATFVIDCSKPVEDKIMDIASLEKFLQERIKVGGKAGALGDSVTVTRDKTKITVTSDSTFSKRYLKYLTKKYLKKNNVRDWLRVISANKDRNVYELRYFNIAENEAEEED

SEQ ID NO: 11063 - protein, 124 aa, Rosa hybrid cultivar
MSRGAAGGPKGKKKGVAFTIDCGKPVEDKIMDIASLEKFLQERIKVGGKAGALGDAVTVTRDKSKLTVSSDNNFSKRYLKYLTKKYLKKHNVRDWLRVIASNKDRNVYELRYFNIAENEAEEED

SEQ ID NO: 11064 - protein, 119 aa, Glycine max
MSGAKGKKKGASFVIDCAKPVEDKIMDIASLEKFLQERIKVGGKAGALGDSITVTRDKSKITVTSDSNFSKRYLKYLTKKYLKKHNVRDWLRVIASNKERSVYELRYFNIAENEGEEED

SEQ ID NO: 11065 - protein, 128 aa, Elaeis guineensis
MSRGGSMAASKGGKKKGSTTFTIDCTKPVDDKIMDIASLEKFLQERIKVAGGKPGALGDQVSVTREKSKIIVTSEGPFSKRYLKYLTKKYLKKHNVRDWLRVIASNKDRSVYELRYFNIAENEGEEEE

SEQ ID NO: 11066 - protein, 127 aa, Manihot esculenta
MSRGGAAGAGGAKGKKKGETFTIDCSKPVEDKIMDIASLEKFLQERIKVGGKAGVLGDSVTVTREKSKITVTSDSRFSQRYLKYLTKKHLKKHNVRDWLRVIASNKDPNVYELRYFNIAENEGEDEG

SEQ ID NO: 11067 - protein, 126 aa, Ambrosia trifida
MSRGAGAAGAKGGKKKQSTFVIDCGKPVEDKIMEIASLEKFLQERIKVGGKAGNLGDSVTISREKNKISVTADSNFSKRYLKYLTKKYLKKHNVRDWLRVISSNKDRNVYELRYFNIAENEGEEED

SEQ ID NO: 11068 - protein, 126 aa, Cirsium arvense
MSRGAGGAGAKGGKKKAVTFVIDCGKPVEDKIMEIASLEKFLQERIKVGGKAGNLGDSVTISREKNKISVTSDSNFSKRYLKYLTKKYLKKHNVRDWLRVISSNKDRNVYELRYFNIAENEGEEED

SEQ ID NO: 11069 - protein, 126 aa, Cucurbita pepo
MSRGAAASGGPKGKKKGSTFVIDCAKPVEDKIMDIASLEKFLLERIKVGGKAGAFGDSVTVTRDKNKITVNSDSNFSKRYLKYLTKKYLKKHNVRDWLRVIASNKDCNVYELRYFNTAENEGEEED

SEQ ID NO: 11070 - protein, 126 aa, Flaveria ramosissima
MSRGAGAAGGKGGKKKTSTFVIDCGKPVEDKIMEIASLEKFLQERIKVGGKAGNLGDSVTISREKNKISVTADSNFSKRYLKYLTKKYLKKHNVRDWLRVIASNKDRNVYELRYFNIAENEGEEED

SEQ ID NO: 11071 - protein, 126 aa, Silene vulgaris
MSKVGAVTGKGGKKKGAVTFTIDCSKPVEDKIMDIASLEKFLQERIKVGGKAGNLGDAVTVSREKNKITVTSDSNFSKRYLKYLTKKYLKKHNVRDWLRVIAANKDRNVYELRYFNIAENEAEEED

SEQ ID NO: 11072 - protein, 124 aa, Silene vulgaris
MSKAAATKGGKKKGSSTFTIDCSKPVEDKIMDIASLEKFFQERIKVGGKAGNLGDSVTVSREKNKIIVTADANFSKRYLKYLTKKYLKKHNVRDWLRVIAANKDRNVYELRYFNIAENEAEEED

SEQ ID NO: 11073 - protein, 126 aa, Taraxacum officinale
MSRGAGGPGAKGGKKKTSTFVIDCGKPVEDKIMEIASLEKFLQERIKVGGKAGNLGDSVTISREKNKISVTSDSNFSKRYLKYLTKKYLKKHNVRDWLRVIASNKDRNVYELRYFNIAENEGEEED

SEQ ID NO: 11074 - protein, 126 aa, Mimulus guttatus
MSKGAAAAGAKGGKKKVATYVIDCSKPVEDKIMEIASLEKFLQERIKVGGKAGALGDSVTVTREKSKITVTADATFSKRYLKYLTKKYLKKHNVRDWLRVIASNKDRNIYELRYFNIAEQEGEEED

SEQ ID NO: 11075 - protein, 125 aa, Ambrosia trifida
MSRGAAAGAKGGKKKTASFVIDCGKPVEDKIMEIASLEKFLQERIKVGGKAGNLGDSVTISREKNKITVTADSNFSKRYLKYLTKKYLKKHNVRDWLRVIASNKDLNVYELRYFNIAENEGEEED

SEQ ID NO: 11076 - protein, 125 aa, Euonymus alatus
MSKGSGGSTKAGKKKGATFTIDCGKPVEDKIMDIASLEKFLKERIKVAGKAGALGDSITISREKSKITVTSDSNFSKRYLKYLTKKYLKKHNVRDWLRVIASNKDRNVYELRYFNIAENEGEEED

SEQ ID NO: 11077 - protein, 123 aa, Artemisia annua
MSRAAGAKGGKKKTSTFVIDCGKPVEDKIMEIASLEKFLQERIKVGGKAGNLGDSVTISREKNKISVTADSNFSKRYLKYLTKKYLKKHNVRDWLRVIASNKDRNVYELRYFNIAENEGEEED

SEQ ID NO: 11078 - protein, 125 aa, Ipomoea batatas
MSKGSSGVVKGGKKKGATFFIDCSKPVDDKIMDIASLEKFLQERIKVGGKAGALGDSVTVTRDKTKITVTSDSNFSKRYLKYLTKKYLKKNNVRDWLRVIASNKDRSVYELRYFNIAENDAEDED

SEQ ID NO: 11079 - protein, 125 aa, Ipomoea nil
MSKGSSGVVKGGKKKGATFVIDCSKPVDDKIMDIASLEKFLQERIKVGGKAGALGDSVTVTRDKTKITVTSDSNFSKRYLKYLTKKYLKKNNVRDWLRVIASNKDRSVYELRYFNIAENDAEDED

SEQ ID NO: 11080 - protein, 69 aa, Papaver somniferum
MGNKDVYGYPLPPLKTKGLSVMAIVGIGLGSGFLSLVLSFTAVCIWLRVTEQQAVNAEEGKVSQFMPEY

SEQ ID NO: 11081 - protein, 124 aa, Unknown
  Sequence found in Organisms: Brassica napus, Brassica oleracea
MSRGAAAVAKGKKKGVSFSIDCSKPVDDKIMEIASLEKFLQERIKVGGKAGALGDSVTITREKNKITVTSEGQFSKRYLKYLTKKYLKKHNVRDWLRVIAANKDRNLYELRYFNIAENEGEEED

SEQ ID NO: 11082 - protein, 114 aa, Euphorbia peplus
KGKKKGATFTIDCAKPVEDKIMDIASLEKFLQDRIKVGGKAALGDSVTVSRDKNKITVTSDTNFSKRYLKYLTKKYLKKHNVRDWLRVIAANKDRSVYELRYFNIAENEGEEED

SEQ ID NO: 11083 - protein, 123 aa, Primula obconica
MSKSTATKGGKKKGVTFTIDCAKPVEDKIMEIATLEKFLQERIKVGGKAGALGDAVTVARDKTKITVTSDANFSKRYLKYLTKKYLKKNNVRDWLRVIASNKDRNVYELRYFNIAENEGEEED

SEQ ID NO: 11084 - protein, 124 aa, Unknown
  Sequence found in Organisms: Thellungiella halophila, Eutrema halophilum
MSRGSAAVAKGKKKGVAFTIDCSKPVDDKIMEIASLEKFLQERIKVGGKAGALGDSVTITRDKNKITVTADGQFSKRYLKYLTKKYLKKHNVRDWLRVIAANKDRNLYELRYFNIAENEGEEED

SEQ ID NO: 11085 - protein, 118 aa, Trigonella foenum-graecum
SGVKGKKKATTFVIDCAKPVEDKIMDIASLEKFLQERIKVGGKAGALGDSVTVTREKSKITVTSDSNFSKRYLKYLTKKYLKKHNVRDWLRVIASNKDRNIYELRYFNIAENEGEEED

SEQ ID NO: 11086 - protein, 124 aa, Acacia harpophylla
MSREAATGAKGKKKGVSFVIDCAKPVEDKIMDVASLEKFLQERIKVGGKASVLGDSVTVTRDKSKITVTSDSNFSKRYLKYLTKKYLKKHNVRDWLRVIASNKERNIYELRYFNIAENEGEEED

SEQ ID NO: 11087 - protein, 124 aa, Arabidopsis lyrata
MSRGNAAATKGKKKGVSFTIDCSKPVDDKIMEIASLEKFLQERIKVGGKAGALGDSVSITREKSKITVTSDGQFSKRYLKYLTKKYLKKHNVRDWLRVIAANKDRNLYELRYFNIAENEAEEED

SEQ ID NO: 11088 - protein, 124 aa, Arabidopsis thaliana
MSRGNAAAAKGKKKGVSFTIDCSKPVDDKIMEIASLEKFLQERIKVGGKAGALGDSVSITREKSKITVTADGQFSKRYLKYLTKKYLKKHNVRDWLRVIAANKDRNLYELRYFNIAENEAEEED

SEQ ID NO: 11089 - protein, 123 aa, Artemisia annua
MSRGAVAKGGKKKVSTFVIDCGKPVEDKIMEIASLEKFLQERIKVGGKAGNLGDSVTISREKNKISVTADSNFSKRYLKYLTKKYLKKHNVRDWLRVIASNKDRNVYELRYFNIAENEGEEED

SEQ ID NO: 11090 - protein, 124 aa, Brassica juncea
MSRGSAAVAKGKKKGVSFSIDCSKPVDDKIMEIASLEKFLQERIKVGGKAGALGDSVTITREKNKITVTSDGQFSKRYLKYLTKKYLKKHNVRDWLRVIAANKDRNLYELRYFNIADNEGEEED

SEQ ID NO: 11091 - protein, 124 aa, Brassica napus
MSRGSAAVAKGKKKGVSFSIDCSKPVDDKIMEIASLEKFLQERIKVGGKAGALGDSVTITRDKNKITVTSDGQFSKRYLKYLTKKYLKKHNVRDWLRVIAANKDRNLYELRYFNIAENEGEEED

SEQ ID NO: 11092 - protein, 124 aa, Liriodendron tulipifera
MSRGSAAGPKGKKKVSTFTIDCAKPVEDKIMDIASLEKFLQERIKVGGKAGSLGDVITIARDKNKIMVTSDSAFSKRYLKYLTKKYLKKHNVRDWLRVIASNKDRNMYELRYFNIAENEGEEED

SEQ ID NO: 11093 - protein, 119 aa, Lotus japonicus
MSGAKGKKKATSFVIDCAKPVEDKIMDIASLEKFLQERIKVGGKAGALGDSVTVSREKSKITVTSDSNFSKRYLKYLTKKYLKKHNVRDWLRVIASNKDRNVYELRYFNIAENEGEEED

SEQ ID NO: 11094 - protein, 119 aa, Medicago truncatula
MSGVKGKKKGTSFVIDCAKPVEDKIMDIASLEKFLQERIKVGGKAGALGDSVTVTREKSKITVTSDSNFSKRYLKYLTKKYLKKHNVRDWLRVIASNKDRNIYELRYFNIAENEGEEED

SEQ ID NO: 11095 - protein, 122 aa, Tropaeolum majus
MSRTTGVKGKKKGVTFTIDCAKPVEDKIMDIASLEKFLQERIKVGGKAGALGDSVSIVREKTKIVVTSDSTFSKRYLKYLTKKYLKKHNVRDWLRVIAANKDRTVYELRYFNIAENDAEEED

SEQ ID NO: 11096 - protein, 124 aa, Orobanche aegyptiaca
MSKGVAASKGGKKKGSSFTIDCSKPVEDKIMEIASLEKFLQERIKVGGKAGALGDSVTVTREKNKITVTGDATFSKRYLKYLTKKYLKKHNVRDWLRVIASNKERNVYELRYFNIAEQEGEEED

SEQ ID NO: 11097 - protein, 123 aa, Petunia hybrida
MSKAGATKGGKKKGATFVIDCAKPVDDKIMEIASLEKFLQERIKVGGKAGALGDSVTVTRDKTKITVTSDSTFSKRYLKYLTKKYLKKNNVRDWLRVISSNKDRNVYELRYFNIAENEAEEED

SEQ ID NO: 11098 - protein, 124 aa, Raphanus sativus
MSRGAAAVAKGKKKGVSFSIDCSKPVDDKIMEIASLEKFLQERIKVGGKAGALGDSVTITRDKNKITVTSDGQFSKRYLKYLTKKYLKKHNVRDWLRVIAANKDRNLYELRYFNIAENEGEEED

SEQ ID NO: 11099 - protein, 119 aa, Glycine max
MSGAKGKKKGASFVIDCAKPVEDKIMDIASLEKFLQERIKVGGKAGALGDSITVTRDKSKITVTSDSNFSKRYLKYLTKKYLKKHNVRDWLRVIASNKERNVYELRYFNIAENEGEEED

SEQ ID NO: 11100 - protein, 124 aa, Fragaria vesca
MSRGAAAGPKGKKKGVAFTIDCGKPVEDKIMDIASLEKFLQERIKVGGKAGALGDSVTVSRDKNKLTVSSDSNFSKRYLKYLTKKYLKKHNVRDWLRVIASNKDRNVYELRYFNIADNDAEEED

SEQ ID NO: 11101 - protein, 124 aa, Helianthus annuus
MSRGAVAAKGGKKKTATFVIDCGKPVEDKIMEIASLEKFLQERIKVGGKAGNLGDSVTISREKNKISVTADSNFSKRYLKYLTKKYLKKHNVRDWLRVIASNKERNVYELRYFNIAENEGEEED

SEQ ID NO: 11102 - protein, 124 aa, Triphysaria pusilla
MSKGAAAAKGGKKKGSSFVIDCSKPVEDKIMEIASLEKFLQERIKVGGKAGALGDSVTVSREKNKITVTADSNFSKRYLKYLTKKYLKKHNVRDWLRVIASNKERNVYELRYFNIAEQEGEEED

SEQ ID NO: 11103 - protein, 94 aa, Platanus occidentalis
MDIASLEKFLQERIKVGGKAGALGDSITISRDKNKITVTSDNPFSKRYLKYLTKKYLKKHNVRDWLRVIASNKDRNMYELRYFNIAENEGEEED

SEQ ID NO: 11104 - protein, 129 aa, Amorphophallus konjac
MSRGGSAGPGVRKGKKKGATTFTIDCAKPVEDKIMDIASLEKFLQERIKVAGGKPGALGDAVTVSRDKNKITVTSEGPFSKRYLKYLTKKYLKKHNVRDWLRVIASNKDRNVYELRYFNIAENEGEEED

SEQ ID NO: 11105 - protein, 128 aa, Eucalyptus grandis
MSRGGSSGGGGAKAAKKKGATFVIDCAKPVEDKIMDIASLEKFLQERIKVDGKAGALGDSVTVSRDKSKITVTSTSDFSKRYLKYLTKKYLKKHNVRDWLRVIASNKDRSVYELRYFNIAENEGEEED

SEQ ID NO: 11106 - protein, 128 aa, Orobanche aegyptiaca
MSRGSAAAAAGAKGGKKKGATFVIDCSKPVEDKIMEIASLEKFLQERIKVGGKAGALGDSVTVAREKNKISVTGDAAFSKRYLKYLTKKYLKKHNVRDWLRVIASNKERNVYELRYFNIAEQEGEEEE

SEQ ID NO: 11107 - protein, 127 aa, Ipomoea nil
MSKGSSGGGALKGGKKKGATFVIDCSKPVDDKIMDIASLEKFLQERIKVGGKAGALGDSVTVTRDKTKITVTSDSNFSKRYLKYLTKKYLKKNNVRDWLRVISSNKDRSVYELRYFNIAENDAEDED

SEQ ID NO: 11108 - protein, 127 aa, Nicotiana tabacum
MSKGSSGGGAMKGGKKKGATFVIDCSKPVEDKIMEIASLEKFLQERIKVGGKAGALGDSVTVTRDKTKITVTSDTTFSKRYLKYLTKKYLKKNNVRDWLRVISSNKDRNVYELRYFNIAENEAEEED

SEQ ID NO: 11109 - protein, 82 aa, Humulus lupulus
MSRGSAAAPKGKKKGATFTIDCGKPVEDKIMDIASLEKFLQERIKVGGKAGALGDSVTVTREKSKITVTSDSNLLPNEGICK

SEQ ID NO: 11110 - protein, 126 aa, Flaveria ramosissima
MSRGAAGAGAKGGKKKTSTFVIDCGKPVEDKIMEIASLEKFLQERIKVGGKAGNLGDSVTISREKNKISVTADSNFSKRYLKYLTKKYLKKHNVRDWLRVIASNKDRNVYELRYFNIAENEGEEED

SEQ ID NO: 11111 - protein, 126 aa, Ocimum basilicum
MSKGGAAATAKGGKKKGVSFVIDCGKPVEDKIMEIASLEKFLQERIKVGGKAGALGDSVTISRDKSKITVTADSAFSKRYLKYLTKKYLKKHNVRDWLRVIASNKDRNVYELRYFNIAEQEGEEED

SEQ ID NO: 11112 - protein, 126 aa, Taraxacum officinale
MSRAAGGAGTKGGKKKTATFIIDCGKPVEDKIMEIASLEKFLQERIKVGGKAGNLGDSVTISREKNKISVTSDSNFSKRYLKYLTKKYLKKHNVRDWLRVISSNKDRNVYELRYFNIAENEGEEED

SEQ ID NO: 11113 - protein, 126 aa, Gerbera hybrid cultivar
MSRGTGGAGTKGGKKKASTFVIDCGKPVEDKIMEIASLEKFLQERIKVGGKAGNLGDSVTISREKNKISVTADNNFSKRYLKYLTKKYLKKHNVRDWLRVIASNKDRNVYELRYFNIAENEGEEED

SEQ ID NO: 11114 - protein, 126 aa, Guizotia abyssinica
MSRGAAGAGAKGGKKKTATFVIDCGKPVEDKIMEIASLEKFLQERIKVGGKAGNLGDSVTISREKNKISVTADSNFSKRYLKYLTKKYLKKHNVRDWLRVISSNKDRNVYELRYFNIAENEGEEED

SEQ ID NO: 11115 - protein, 125 aa, Lactuca sativa
MSRGAGGAGAKGGKKKTATFVIDCGKPVEDKIMEIASLEKFLQERIKVGGKAGNLGDSVSISREKNKISVTSDSNFSKRYLKYLTKKYLKKHNVRDWLRVIASNKDRNVYELRYFNIAENEGEED

SEQ ID NO: 11116 - protein, 126 aa, Salvia sclarea
MSKGAAAAGAKGGKKKGATFVIDCTKPVDDKIMEIASLEKFLQERIKVGGKAGALGDSVTVTRDKSKITVTADSAFSKRYIKYLTKKYLKKHNVRDWLRVIASNKERNVYELRYFNIAEQEGEEED

SEQ ID NO: 11117 - protein, 126 aa, Zinnia violacea
MSRGATGAGAKGGKKKTATFVIDCGKPVEDKIMEIASLEKFLQERIKVGGKAGNLGDSVTISREKNKISVTADSNFSKRYLKYLTKKYLKKHNVRDWLRVIASNNDRNVYELRYFNIAENEGEEED

SEQ ID NO: 11118 - protein, 123 aa, Panax ginseng
MSPISAAKGGKKKGATFTIDCGKPVEDKIMEIASLEKFLQERIKVGGKAGALGDAVTVVREKSKIIVTSDSDFSKRYLKYLTKKYLKKNNVRDWLRVIASNKDRNIYELRYFNIAENEGEEED

SEQ ID NO: 11119 - protein, 119 aa, Tamarix hispida
MSRGTAAAGGKGKKKGSTFTIDCGKPVEDKIMDIASLEKFLQERIKVGGKAGNLGDTVTITREKNKISVTSDSNFSKRYLKYLTKKYLKKHNVRDWLRVIASNKDRNVYELRYFNIAEN

SEQ ID NO: 11120 - protein, 123 aa, Arnica chamissonis
MSHGAGAKGGKKKTSTFVIDCGKPVEDKIMEIASLEKFLQERIKVAGKAGNLGDSVTISREKNKISVTADSNFSKRYLKYLTKKYLKKHNVRDWLRVIASNKDRSVYELRYFNIAENEGEEED

SEQ ID NO: 11121 - protein, 124 aa, Flaveria ramosissima
MSRGAGGAKGGKKKTSTFVIDCGKPVEDKIMEIASLEKFLQERIKVGGKAGNLGDSVTISREKNKISVTADSNFSKRYLKYLTKKYLKKHNVRDWLRVIASNKDRNVYELRYFNIAENEGEEED

SEQ ID NO: 11122 - protein, 123 aa, Aristolochia fimbriata
MSRGNAPKGGKKKGATFVIDCAKPVEDKIMDIASLEKFLQERIKVGGKAGALGDAITISRDKSKITVTSDNPFSKRYLKYLTKKYLKKHNVRDWLRVIASNKDRNIYELRYFNIAENEAEEED

SEQ ID NO: 11123 - protein, 123 aa, Nuphar advena
MSRGGAAPKGKKKASTFTIDCAKPVEDKIMDITSFEKFLQDRIKVGGKTGVLGDTITITREKNKISVTSESAFSKRYLKYLTKKYLKKHNVRDWLRVIASNKDRSVYELRYFNIAENEAEEED

SEQ ID NO: 11124 - protein, 123 aa, Helianthus annuus
MSRGAVTKGGKKKTATFVIDCGKPVEDKIMEIASLEKFLQERIKVGGKAGNLGDSVTISREKNKISVTADSNFSKRYLKYLTKKYLKKHNVRDWLRVIASNKERNVYELRYFNIAENEGEEED

SEQ ID NO: 11125 - protein, 124 aa, Nicotiana tabacum
MSKGSGAAKGGKKKGATFIIDCSKPVEDKIMEIASLEKFLQERIKVGGKAGALGDTVTVTRDKTKITVTSDSTFSKRYLKYLTKKYLKKNNVRDWLRVISSNKDRNVYELRYFNIAENEAEEEE

SEQ ID NO: 11126 - protein, 124 aa, Triphysaria pusilla
MSKGAAVAKGGKKKGSSFVIDCSKPVEDKIMEIASLEKFLQERIKVGGKAGALGDSVTVSREKNKITVTADSNFSKRYLKYLTKKYLKKHNVRDWLRVIASNKERNVYELRYFNIAEQEGEEED

SEQ ID NO: 11127 - protein, 99 aa, Lactuca sativa
MSRGAVAKGGKKKIATFVIDCGKPVEDKIMEIASLEKFLQERIKVGGKAGNLGDSVTISREKNKISVTSDNNFSKRYLKYLTKKYLKKHNSRDWLRMIA

SEQ ID NO: 11128 - protein, 128 aa, Linum usitatissimum
MARGVAAAAAGTKGGKKKGVSFVIDCGKPVEDKIMDIASLEKFLQERIKVGGKAGALGDVVSISREKNKITVTSDSNFSKRYLKYLTKKYLKKHNVRDWLRVIASNKERNVYELRYFNIAENEGEEED

SEQ ID NO: 11129 - protein, 212 aa, Plantago ovata
MSRRLALTVLIGAAAVGSKVSPADAAYGESANIFGKPKTGSTEFKPYTGDGFKLDVPAKWNPSNEVEFPGQVLRYEDNFDATSNLSVMITPTDKKSITDFGSPEDFLSKVDYLLGKSAYFGKTDSEGGFDSGAVATANILETATPEIGGKQYYFVSVLTRTADGDEGGKHQLITATVNNGKLYICKAQAGDKRWFKGARKFVENAANSFSVA

SEQ ID NO: 11130 - protein, 141 aa, Lactuca sativa
MSRGAGGAGAKGGKKKTSTFVIDCGKPVEDKIMEIASLEKFLQERIKVGGKAGNLGDSVTISREKNKISVTSDSNFSKRYLKYLTKKYLKKHNVRDWLRVIASNKDRNVYELRYFNIAENEGEEDRSEKSILLLCLFFLAF

SEQ ID NO: 11131 - protein, 126 aa, Flaveria ramosissima
MSRGATGAGAKGGKKKTSTFVIDCGKPVEDKIMEIASLEKFLQERIKVGGKAGNLSDSVTISREKNKISVTADSNFSKRYLKYLTKKYLKKHNVRDWLRVIASNKDRNVYELRYFNIAENEGEEED

SEQ ID NO: 11132 - protein, 126 aa, Lippia dulcis
MSKGTAAAAVKGGKKKGVTFVIDCSKPVEDKIMEIASLEKFLQERIKVGGKAGALGDSVTVSRDKSKITVTADAAFSKRYLKYLTKKYLKKHNVRDWLRVISSNKERNVYELRYFNIAEQEGEEED

SEQ ID NO: 11133 - protein, 126 aa, Aquilegia formosa
MNRGGSAAGTKGGKKKASTFVIDCAKPVEDKIMDIASLEKFLQERIKVGGKAGALGDVVTISREKNKISVTSDSTFSKRYLKYLTKKYLKKHNVRDWLRVIASNKERNVYELRYFNIAENEAEEDD

SEQ ID NO: 11134 - protein, 125 aa, Euonymus alatus
MSKGSGGAGKAGKKKGVTFTIDCGKPVEDKIMEIASLEKFLLERIKVGGKAGALGDSITISREKSKITVTSDSNFSKRYLKYLTKKYLKKHNVRDWLRVISSNKDRNVYELRYFNIAENEGAEED

SEQ ID NO: 11135 - protein, 125 aa, Unknown
  Sequence found in Organisms: Solanum lycopersicum, Ocimum basilicum, Solanum phureja
MSKGSSGATKGGKKKGATFVIDCAKPVEDNIMEIASLEKFLQERIKVGGKAGALGDSVTVTRDKTKITVTSDSTFSKRYLKYLTKKYLKKNSVRDWLRVISSNKDRNVYELRYFNIADNEAEEED

SEQ ID NO: 11136 - protein, 125 aa, Cleome gynandra
MARGAAATVAGGKKKGSTFVIDCAKPVDDKIMDIASLEKFLQERIKVGGKPGALGDAVTVTRDKTKISVTASSDFSKRYLKYLTKKYLKKNNVRDWLRVIASNKDRNIYELRYFNIAENEGEEED

SEQ ID NO: 11137 - protein, 125 aa, Cleome spinosa
MARGAAATAAGGKKKGSTFLIDCTKPVDDKIMDIASLEKFLQERIKVGGKPGALGDAVTITRDKSKITVTATSDFSKRYLKYLTKKYLKKHNVRDWLRVIASNKDRNVYELRYFNIAENEGEEED

SEQ ID NO: 11138 - protein, 125 aa, Unknown
  Sequence found in Organisms: Nicotiana benthamiana, Nicotiana tabacum
MSKGSSGATKGGKKKGATFVIDCSKPVEDKIMDIASLEKFLQERIKVGGKAGALGDAVTVTRDKTKITVTSESTFSKRYLKYLTKKYLKKNNVRDWLRVISANKDRNVYELRYFNIAENEAEEED

SEQ ID NO: 11139 - protein, 123 aa, Helianthus annuus
MSRVAGAKGGKKKQSTFVIDCGKPVEDKIMEIASLEKFLQERIKVGGKAGNLGDSVTISREKNKISVTADSNFSKRYLKYLTKKYLKKHNVRDWLRVIASNKERNVYELRYFNIAENEGEEED

SEQ ID NO: 11140 - protein, 120 aa, Euphorbia peplus
QPGPEQGKKKGATFTIDCSKPVEDKIMDIASLEKFLQERIKVGGKAGALGDSVTVSREKSKITVTSDSNFSKRYLKYLTKKYLKKHNVRDWLRVIAANKDRNVYELRYFNIAENEGEDEE

SEQ ID NO: 11141 - protein, 117 aa, Platanus occidentalis
RPKGKKKGASFVIDCAKPVEDKIMDIASLEKFLQERIKVGGKAGALGDAITVSREKNKITVTSDNAFSKRYLKYLTKKYLKKHNVRDWLRVIASNKDRNVYELRYFNIAENEGEEED

SEQ ID NO: 11142 - protein, 124 aa, Eutrema parvulum
MTRGSAAAPKGKKKGVSFTIDCSKPVDDKIMEIASLEKFLQERIKVGGKAGALGDSVSITRDKNKITVTSDGQFSKRYLKYLTKKYLKKHNVRDWLRVIAANKDRNLYELRYFNIAENEAEEED

SEQ ID NO: 11143 - protein, 124 aa, Eucalyptus grandis
MSRASVAGPKGKKKGVSFTIDCAKPVEDKIMDIASFEKFLQEKIKVDGKAGALGDIVTVTRDKTKITVTSESSFSKRYLKYLTKKYLKKHNVRDWLRVIASNKDRNIYEVRYFNIAENEGEEED

SEQ ID NO: 11144 - protein, 122 aa, Helianthus annuus
MSHGGAKGGKKKQSTFVIDCGKPVEDKIMEIASLEKFLQERIKVGGKAGNLGDSVTISREKNKISVTADSNFSKRYLKYLTKKYLKKHNVRDWLRVIASNKDRNVYELRNFNIAENEGEEED

SEQ ID NO: 11145 - protein, 122 aa, Helianthus annuus
MSHGGAKGGKKKQSTFVIDCGKPVEDKIMEIASLEKFLQERIKVGGKAGNLGDSVTISREKNKISVTADSNFSKRYLKYLTKKYLKKHNVRDWLRVIASNKERNVYELRYFNIAENEGEEED

SEQ ID NO: 11146 - protein, 124 aa, Triphysaria pusilla
MSKGAAVAKGGKKKGSSFVIDCSKPVEDKIMEIASLEKFLQERIKVGGKAGALGDAVTVSREKNKITVTADSNFSKRYLKYLTKKYLKKHNVRDWLRVIASNKERNVYELRYFNIAEQEGEEED

SEQ ID NO: 11147 - protein, 116 aa, Euonymus alatus
MSRGTATGAKGKKKGATFVIDCAKPVEDKIMDIASLEKFLKERIKVGGKAGALGDAITVTREKSKITVTSSSDFSKRYLKYLTKKYLKKHNVRDWLRVISSNKDRNIYEIALPQHS

SEQ ID NO: 11148 - protein, 145 aa, Sarracenia psittacina
MSRGAAAGPKGKKKGATFVIDCGKPVEDKIMDIATLEKFLQERIKVGGKAGALGDSVTVTRDKNKITVTSDSNFSKRYLKYLAKKYLRSTCEGLAPVIAPTKTGMSTSCETSTLQRMKGKMKTEDTVAFSHILSVLICSECCRAS

SEQ ID NO: 11149 - protein, 128 aa, Linum usitatissimum
MARGVAAAAAGTKGGKKKGVSFVIDCGKPVEDKIMDIASLEKFLQERIKVGGKAGALGDVVSISREKNKITVTSDSNFFKRYLKYLTKKYLKKHNVRDWLRVIASNKERNVYELRYFNIAENEGEEED

SEQ ID NO: 11150 - protein, 128 aa, Avena sativa
MARGAAAVAAAKGKKKGSVSFVIDCTKPVEDKIMEIASLEKFLQERIKVAGGKAGNLGDSVTVTRDKSKVTVTSDGNFSKRYLKYLTKKYLKKHNVRDWLRVIAANKERNVYELRYFNIAENEGEEED

SEQ ID NO: 11151 - protein, 116 aa, Setaria italica
MARGVVAAKGGAAAGKKKGSVTFTIDCTKPVEDKIMEIASLEKFLQERIKVAGGKAGSLGDSVTVSREKTKVTVTSDGPFSKRYTTPEVLDQEVLEEAQCAGLATRDCGQQGPHRV

SEQ ID NO: 11152 - protein, 127 aa, Plantago ovata
MSKGAAAATQKGGKKKASVFVIDCGKPVEDKIMDIASLEKFLQERIKVGGKAGALGDSVTITRDKTKISVTANDTTFSKRYLKYLTKKYLKKNNVRDWLRVIASNKDRSVYELRYFNIAENEAEEED

SEQ ID NO: 11153 - protein, 126 aa, Thalictrum flavum
SKGVKGNVPKGGKKKGASFVIDCAKPVEDKIMDIASLEKFLQERIKVGGKAGALGDSVTISREKNKITVTSDNTTFSKRYLKYLTKKYLKKHNVRDWLRVIASNKDRNVYELRYFNIAENEAEEED

SEQ ID NO: 11154 - protein, 127 aa, Nicotiana benthamiana
MSKGSSGGGATKGGKKKGAAFVIDCSKPVEDKIMEIASLEKFLQERIKVGGKAGALGDTVTVTRDKTKITVTSDSTFSKRYLKYLTKKYLKKNNVRDWLRVISSNKDRNVYELRYFNIAENEAEEED

SEQ ID NO: 11155 - protein, 137 aa, Lippia dulcis
MSKGAAATGSKGGKKKGATFIIDCTKPVEDKIMEIASLEKFLQERIKVGGKAGALGDSVTVTRDKSKITVTADSAFSKRYIKYLTKKYLKKHNVRDWLRVIASNKDRNVMNCATSTLLSRRARKKIKLQHFGSVIQF

SEQ ID NO: 11156 - protein, 130 aa, Setaria italica
MARGVVAAKGGAAAGKKKGSVSFVIDCTKPVEDKIMEIASLEKFLQERIKVAGGKAGSLGDSVTVSREKTKVTVTSDGPFSKRYLKYLTKKYLKKHNVRDWLRVIAANKDRTVYELRYFNIAENEGEEED

SEQ ID NO: 11157 - protein, 130 aa, Sorghum bicolor
MARGVVAAKGGAAAGKKKGSVAFTIDCTKPVEDKIMEIASLEKFLQERIKVAGGKAGSLGDSVTISREKTKVTVTSDGPFSKRYLKYLTKKYLKKHNVRDWLRVIAANKDHSVYELRYFNIAENEGEEED

SEQ ID NO: 11158 - protein, 124 aa, Tabernaemontana elegans
KGAGAGALKGGKKKGATFVIDCSKPVEDKIMDISSLEKYLQERIKVGGKPGALGDSVTVTRDKTKISVTADSNFSKRYLKYLTKKYLKKNNVRDWLRVISSNKDRSVYELRYFNIAENEAEEEE

SEQ ID NO: 11159 - protein, 120 aa, Cicer arietinum
MSRSGAAGAKGKKKGATFTIDCSKPVEDKIMDIASLEKFLQERIKVGGKAGALGDSVTVTREKSKITVTSDSNFSKRYLKYLTKKYLKKHNVRDWLRVIASNKDRSIYELRYLGRDHANH

SEQ ID NO: 11160 - protein, 125 aa, Utricularia gibba
MSKGAVAGAKGGKKKTATFVIDCSKPVEDKIMEIASLEKFLQEKIKVGGKTGALGESVTVIREKNKISVTADTAFSKRYLKYLTKKYLKKHNVRDWLRVIASNKDRNVYELRYFNIAEQEGEEED

SEQ ID NO: 11161 - protein, 123 aa, Senecio madagascariensis
MSRVAGAKGGKKKLSTFVIDCGKPVEDKIMEIASLEKFLQERIKVGGKAGNLGESVTISREKNKISVTADSNFSKRYLKYLTKKYLKKHNVRDWLRVIASNKDRNVYELRYFNNAENEGEEED

SEQ ID NO: 11162 - protein, 123 aa, Ambrosia trifida
MSHGGAKGGKKKTSTTFVIDCGKPVEDKIMEIASLEKFLQERIKVGGKAGNLGDSVTISREKNKISVTADSNFSKRYLKYLTKKYLKKHNVRDWLRVISSNKDRNVYELRYFNIAENEGEEED

SEQ ID NO: 11163 - protein, 119 aa, Brassica napus
AAVAKGKKKGVSFSIDCSKPVDDKIMEIASLEKFLQERIKVGGKAGALGDSVTITREKNKITVTSDGQFSKRYLKYLTKKYLKKHNVRDWLRVIAANKDRNLYELRYFNIAENEGEEED

SEQ ID NO: 11164 - protein, 113 aa, Euphorbia peplus
KKKGATFTIDCTKPVEDKIMDIASLEKFLQERIKVGGKAGALGDSVTVSREKSKITVTSDSNFSKRYLKYLTKKYLKKHNVRDWLRVIAANKDRNVYELRYFNIAENEGEDEE

SEQ ID NO: 11165 - protein, 124 aa, Artemisia annua
MSRVAAGGKGGKKKSVTFVIDCGKPVEDKIMEIASLEKFLQERIKVGGKAGNLGDSVTISREKNKISVTADSNFSKRYLKYLTKKYLKKHNVRDWLRVIASNKERNVYELRYFNIAENEGEEED

SEQ ID NO: 11166 - protein, 122 aa, Unknown
  Sequence found in Organisms: Brassica napus, Brassica rapa
MSRAAAPKGKKKGVSFTIDCSKPVDDKIMEIASLEKFLQERIKVGGKAGALGDTVSITRDKNKITVTSDGQFSKRYLKYLTKKYLKKHNVRDWLRVIAANKDRNLYELRYFNIAENEAEEED

SEQ ID NO: 11167 - protein, 130 aa, Zingiber officinale
  misc_feature (9)..(10): Xaa can be any naturally occurring amino acid
  misc_feature (13)..(13): Xaa can be any naturally occurring amino acid
MSRGSGGSXXAAXKGGKKKGSTFVIDCAKPVDDKIMDIASLEKFLQERIKVNGGKAGALGDAVTVTRDKSKITVTSEGPFSKRYLKYLTKKFLKKHNVRDWLRVIASNKDRNVYELRYFNIAENEGEDED

SEQ ID NO: 11168 - protein, 124 aa, Liriodendron tulipifera
MSRGGSAPKGGKKKGAIFVIDCAKPVEDKIMEIASLEKFLQERIKVGGKAGSLGDSISISRDKNKITVTSDNPLSKRYLKYLTKKYLKKHNVRDWLRVIASNKDRNVYELRYFNIAENEAEEED

SEQ ID NO: 11169 - protein, 124 aa, Carica papaya
MSRGSAGAPKGKKKGVSFTIDCSKPAEDKIMDVASLEKFLQERIKVGGKAGALGEVITITREKGKIIVTSESQFSKRYLKYLAKKYLKKHNVRDWLRVVASNKDRGVYELRYFNIDENEGEEED

SEQ ID NO: 11170 - protein, 130 aa, Panicum virgatum
MARGVVAAKAGAAGGKKKGSVTFTIDCTKPVEDKIMEIASLEKFLQERIKVAGGKAGSLGDSVTVSREKTKVSVTSDGPFSKRYLKYLTKKYLKKHNVRDWLRVIAANKDRTVYELRYFNIAENEGEEED

SEQ ID NO: 11171 - protein, 72 aa, Ricinus communis
GGAKGGKKRGATFTIDCAKPVEDKIMDIASLEKFLQERIKVGGKAGALGDTVSVSREKTKITVTSDSNFSKR

SEQ ID NO: 11172 - protein, 101 aa, Sarracenia psittacina
RGAKMKSWGDGWTEGKKKGATFVIDCGKPVEDKIMDIATLEKFLQERIKVGGKAGALGDSVTVTRDKNKVTVTSDSNFSKRYLKYLTKKYLKKYNVRDWLR

SEQ ID NO: 11173 - protein, 129 aa, Brassica juncea
MSRGSAAVAKGKKKGVSFSIDCSKPVDDKIMEIASLEKFLQERIKVGGKAGALGDSVTITREKNKITVTSDGQFSKRYLKYLTKKYLKKHNVRDWLRVIAANKDRNLYELRYFNIAENEDRNLYELRYF

SEQ ID NO: 11174 - protein, 96 aa, Theobroma cacao
MSRGSAAGPKGKKKGVTFTIDCSKPVEDKIMEIASLEKFLQERIKVGGKAAALGETVALTLEKSKIIVTADGAFSKRYLKYLTKKYLKKHNVRDWL

SEQ ID NO: 11175 - protein, 129 aa, Phalaenopsis aphrodite
MSRTGSSAGAKGGKKKGSTFFIDCSKPVEDKIMDIASLEKFLLERIKVASLGGKAGTLGDAVRVTREKSKITVTSEGPFSKRYLKYLTKKYLKKHNVRDWLRVIASNKDRNVYELRYFNIAENEGEEED

SEQ ID NO: 11176 - protein, 129 aa, Festuca arundinacea
MARGAATSAAAAKGKKKGSVSFVIDCTKPVEDKIMEIASLEKFLQERIKVAGGKAGNLGDSVTVTRDKSKVTVTSDGNFSKRYLKYLTKKYLKKHNVRDWLRVIAANKERNVYELRYFNIAENEGEEED

SEQ ID NO: 11177 - protein, 129 aa, Avena sativa
MARGAATAAAAAKGKKKGSVSFVIDCTKPVEDKIMEIASLEKFLQERIKVAGGKAGNLGDSVTVTRDKSKVTVTSDGNFSKRYLKYLTKKYLKKHNVRDWLRVIAANKERNVYELRYFNIAENEGEEED

SEQ ID NO: 11178 - protein, 128 aa, Linum usitatissimum
MARGVAAAAAGTKGGKKKGVSFVIDCGKPVEDKIMDIASLEKFLQERIKVGGKAGALGDVVSISREKNKITVTSNSDFSKRYLKYLTKKYLKKHNVRDWLRVIASNKERNVYELRYFNIAENEGEEED

SEQ ID NO: 11179 - protein, 119 aa, Camellia sinensis
MSRGGSAAAGGGKGKKKGATFTIDCAKPVEDKIMEIASLEKFLQERIKVGGKAGALGDSVTVTREKNKITVTCDSNFSKRYLKYLTKKYLKKHNVRDWLRVIASNKDRNVYELRYFKHC

SEQ ID NO: 11180 - protein, 126 aa, Lippia dulcis
MSKGTAAAASKGGKKKGVTFVIDCSKPVEDKIMEIASLEKFLQERIKVGGKAGALGDSVTVSRDKSKITVTADSAFSKRYLKYLTKKYLKKHNVRDWLRVISSNKERNVYELRYFNIAEQEGEDED

SEQ ID NO: 11181 - protein, 126 aa, Silene vulgaris
MSKVGGVVGKGGKKKGAVTFTLDCSKPVEDKIMDIASLEKFFQERIKVGGKAGNLGDTVTVSREKNKITVTADSNFSKRYLKYLTKKYLKKHNVRDWLRVIAANKDRNVYELRYFNIAENEAEEED

SEQ ID NO: 11182 - protein, 126 aa, Raphanus sativus
MSRGSGAAPKGKKKGGVSFTIDCSKPVDDKIMEIASLEKFLQERIKVGGGKAGALGDSVSITRDKNKITVTSDGQFSKRYLKYLTKKYLKKHNVRDWLRVIAANKDRNLYELRYFNIAENEAEEED

SEQ ID NO: 11183 - protein, 94 aa, Utricularia gibba
MEIASLEKFLQEKIKVGGKTGALGESVTVTREKNKISVTADTAFSKRYLKYLTKKYLKKHNVRDWLRVIASNKDRNVYELRYFNIAEQEGEEED

SEQ ID NO: 11184 - protein, 124 aa, Antirrhinum majus
MSKNAAAKGGKKKGGVSFTIDCSKPVEDKIMEIASLEKFLQERIKVGGKAGALGDSVTVARDKNKITVTADSTFSKRYLKYLTKKYLKKHNVRDWLRVISSNKDRNVYELRYFNIAEQEAEEED

SEQ ID NO: 11185 - protein, 131 aa, Setaria italica
MARGVAAGAKGGAAGGKKKGAVTFTIDCTKPVEDKIMEIATLEKFLQERIKVAGGKAGNLGEGVTVTRDKTKVTVTSEGPFSKRYLKYLTKKYLKKHNVRDWLRVIASNKDRSVYELRYFNIAENEGEEED

SEQ ID NO: 11186 - protein, 125 aa, Capsicum annuum
MSRAAVSAAKGGKKKGATFVIDCSKPVEDSIMEIASLDKFLQERIKVGGKAGALGDSVTVTRDKNKITVTCNSAFSKRYLKYLVKKYLKKHNVRDWLRVIASNKDRNVYELRYFNIADNEAEEED

SEQ ID NO: 11187 - protein, 125 aa, Salvia sclarea
MSKAAAAGAKGGKKKSVTFVIDCTKPVDDKIMEIASLEKFLQERIKVGGKAGALGDSVTVTRDKSKITVTADSAFSKRYIKYLTKKYLKKHNVRDWLRVIASNKERNVYELRYFNIAEQEGEEED

SEQ ID NO: 11188 - protein, 123 aa, Nuphar advena
MSRGGAAPKGKKKASTFTIDCSKPVEDKIMDITSFEKFLQDRIKVGGKTGVLGDTITITREKNKISVTSESAFSKRYLKYLTKKYLKKHNVRDWLRVIASNKDRSVYEMRYFNIAENEADEED

SEQ ID NO: 11189 - protein, 130 aa, Oryza sativa
MARGVAVAAKGGAGGKKKGSVSFVIDCSKPVEDKIMEIASLEKFLQERIKVAGGKAGNLGDSVTVTRDKTKVTVTSDGAFSKRYLKYLTKKYLKKHNVRDWLRVIAANKDRNVYELRYFNIAENEGEEED

SEQ ID NO: 11190 - protein, 123 aa, Arnica chamissonis
EQPAPERRAERRKRTTFVIDCGKPVEDKIMEIASLEKFLQERIKVAGKAGNLGDSVTISREKNKISVTADSNFSKRYLKYLTKKYLKKHNVRDWLRVIASNKDRNVYELRYFNIAENEGEEED

SEQ ID NO: 11191 - protein, 129 aa, Phalaenopsis aphrodite
MSRTGSSAGAKGGKKKGSTFVIDCSKPVEDKIMDIASLEKFLLERIKVASLGGKAGTLGDVVRVAREKSKITVTSEGPFSKRYLKYLTKKYLKKHNVRDWLRVIASNKDRNVYELRYFNIAENEGEEED

SEQ ID NO: 11192 - protein, 129 aa, Hordeum vulgare
MARGAATAAAAAKGKKKGSVSFVIDCTKPVEDKIMEIASLEKFLQERIKVAGGKAGNLGDSVTVTRDKSKVTVTSDGAFSKRYLKYLTKKYLKKHNVRDWLRVIAANKERNVYELRYFNIAENEGEEED

SEQ ID NO: 11193 - protein, 129 aa, Pseudoroegneria spicata
MARGATAAAAAAKGKKKGSVSFVIDCTKPVEDKIMEIASLEKFLQERIKVAGGKAGNLGDSVTVTRDKSKVTVTSDGAFSKRYLKYLTKKYLKKHNVRDWLRVIAANKERNVYELRYFNIAENEGEEED

SEQ ID NO: 11194 - protein, 129 aa, Triticum aestivum
MARGAAAAAAAAKGKKKGSVSFVIDCTKPVEDKIMEIASLEKFLQERIKVAGGKAGNLGDSVTVTRDKSKVTVTSDGAFSKRYLKYLTKKYLKKHNVRDWLRVIAANKERNVYELRYFNIAENEGEEED

SEQ ID NO: 11195 - protein, 134 aa, Cajanus cajan
CLSASGEEGRERGAKMSGAKGKKKGASFVIDCAKPVEDKIMDIASLEKFLQERIKVGGKAGALGDSVTVTRDKSKITVTSDSNFSKRYLKYLTKKYLKKHNVRDWLRVIASNKDRNVYELRYFNIAENEGEEED

SEQ ID NO: 11196 - protein, 132 aa, Sorghum bicolor
MARGVVAAKGGAAAGKKKGSVAFTIDCTKPVEDKIMEIASLEKFLQERIKVAGGKAGSLGDSVTISREKTKVTVTSDGPFSKRYTTLKYLTKKYLKKHNVRDWLRVIAANKDHSVYELRYFNIAENEGEEED

SEQ ID NO: 11197 - protein, 128 aa, Linum usitatissimum
MARGVAAAAAGTKGGKKKGVSFVIDCGKPVEDKIMDIASLEKFLQERIKVGGKAGALGDVVSISREKNKITVTSNSDFFKRYLKYLTKKYLKKHNVRDWLRVIASNKERNVYELRYFNIAENEGEEED

SEQ ID NO: 11198 - protein, 128 aa, Fraxinus spp
MSKGGAAGGAVKGGKKKASTFVIDCSKPVEDKIMDIASLEKFLQERIKVGGKPGALGDSVTVTRDKNKITVVANETSFSKRYLKYLTKKYLKKNNVRDWLRVIASNKDRSVYELRYFNIAENEAEEEE

SEQ ID NO: 11199 - protein, 127 aa, Primula obconica
MTRAAATATAVKGGKKKGATFTIDCGKPVEDKIMEIASLEKFLQERIKVAGKPGALGDGVTVVRDKSKITVNSDSTFSKRYLKYLTKKYLKKNNVRDWLRVIASNKDRNVYELRYFNIAENEGEEED

SEQ ID NO: 11200 - protein, 127 aa, Ipomoea batatas
MSKGSSGGGALKGGKKKGSIFVIDCSKPVDDKIMDIASLEKFLQERIKVSGKAGALGDSVTVARDKTKITVTSDSNFSKRYLKYLTKKYLKKNNVRDWLRVISSNKDRSVYELRYFNIAENDAEDED

SEQ ID NO: 11201 - protein, 132 aa, Sorghum bicolor
MARGVAAGAKGGAAGGGKKKGSVTFTIDCTKPVEDKIMEIATLEKFLQERIKVAGGKAGNLGEGVTVTRDKTKVTVTSDGPFSKRYLKYLTKKYLKKHNVRDWLRVIASNKDRSVYELRYFNIAENEGEEED

SEQ ID NO: 11202 - protein, 131 aa, Avena sativa
MARGVTATTKGGAGAGKKKGSVTFVIDCTKPVDDKIMEIASLEKFLQERIKVAGGKAGNLGDSVTVARDKSKVTVTSDGAFSKRYLKYLTKKYLKKHNVRDWLRVISSNKDRSVYELRYFNIAENEGEEED

SEQ ID NO: 11203 - protein, 126 aa, Amsonia hubrichtii
MSKGTGGGVLKGGKKKGATFVIDCSKPVEDKIMDISSLEKYLQERIKVGGKPGALGDSVTVIRDKTKITVTADSNFSKRYLKYLTKKYLKKNNVRDWLRVISSNKDRSVYELRYFNIAENEAEDEE

SEQ ID NO: 11204 - protein, 131 aa, Pennisetum glaucum
MARGAAAGAKGGAAGGKKKGAVTFTIDCTKPVEDKIMEIATLEKFLQERIKVAGGKAGNLGEGVTVTRDKNKVTVTSEGPFSKRYLKYLTKKYLKKHNVRDWLRVIASNKDRSVYELRYFNIAENEGEEED

SEQ ID NO: 11205 - protein, 131 aa, Oryza sativa
MARGVAAAAGGKGGAGKKKGSVTFVIDCAKPVDDKIMEIASLEKFLQERIKVAGGKAGNLGESVTVSRDKTKVTVTSDGPFSKRYLKYLTKKYLKKHNVRDWLRVIASNKDRNVYELRYFNIAENEGEEED

SEQ ID NO: 11206 - protein, 125 aa, Solanum lycopersicum
MSRAAAAAVKGGKKKGASFVIDCSKPVEDSIMEIASLDKFLQERIKVGGKAGALGDSVTVTRDKNKITVTCNSTFSKRYLKYLVKKYLKKNNVRDWLRVIASNKDRNVYELRYFNIAENEADEED

SEQ ID NO: 11207 - protein, 125 aa, Cleome gynandra
MARGTTAASAGGKKKGSTFVIDCSKPVDDKIMDIASLEKFLQERIKVGGKPGALGDAVTITRDKSKITVTANSDFSKRYLKYLTKKYLKKNNVRDWLRVIASNKDRNIYELRYFNIAENEGEEED

SEQ ID NO: 11208 - protein, 125 aa, Solanum tuberosum
MSRAAAAAVKGGKKKGATFVIDCSKPVEDSIMEIASLDKFLQERIKVGGKAGALGDSVTVSRDKNKITVTCNSTFSKRYLKYLVKKYLKKNNVRDWLRVIASNKDRNVYELRYFNIAENEADEED

SEQ ID NO: 11209 - protein, 123 aa, Nicotiana tabacum
MSRAAAAKGGKKKGATFVIDCSKPVDDKIMEIASLGKFLQERIKVGGKAGALGDSVTVTRDKNKITVTSNSAFSKRYLKYLVKKYLKKNNVRDWLRVIAANKDKNVYELRYFNIAETEADEED

SEQ ID NO: 11210 - protein, 125 aa, Nicotiana tabacum
MSRAAVAAAKGGKKKGATFVIDCSKPVDDKIMEIASLDKFLQERIKVGGKAGALGDSVTVTRDKNKITVTSNSAFSKRYLKYLVKKYLKKNNVRDWLRVIAANKDRNVYELRYFNIAETEADEED

SEQ ID NO: 11211 - protein, 124 aa, Solanum melongena
MSRAAAAAKGGKKKGATFVIDCSKPVDDSIMEIASLDKFLQERIKVGGKAGALGDSVTVSRDKTKITVTCNSAFSKRYLKYLVKKYLKKNNVRDWLRVIASNKDRNVYELRYFNIAENEADEED

SEQ ID NO: 11212 - protein, 113 aa, Gerbera hybrid cultivar
KKKAATFVIDCGKPVEDKIMEIASLEKFLQERIKVGGKAGNLGDSVTITREKNKISVTADSNFSKRYLKYLTKKYLKKHNVRDWLRVIASNKDRNVYELRYFNIAENEGEEED

SEQ ID NO: 11213 - protein, 128 aa, Fraxinus spp
MSKGGAAGGAVKGGKKKASTFVIDCSKPVEDKIMDIASLEKFLQERIKVGGKPGALGDSVTVTRDKSKITVVANETSFSKRYLKYLTKKYLKKNNVRDWLRVIASNKDRNVYELRYFNIAENEAEEEE

SEQ ID NO: 11214 - protein, 128 aa, Fraxinus spp
MSKGGASTGAQKGGKKKAATFVIDCSKPVEDKIMDIASLEKFLQERIKVGGKPGALGDSVTVIRDKNKISVTANETSFSKRYLKYLTKKYLKKNNVRDWLRVIASNKDRTVYELRYFNIAENEAEEEE

SEQ ID NO: 11215 - protein, 127 aa, Phalaenopsis aphrodite
RTGSSAGAKGGKKKGSTFVIDCSKPVEDKIMDIASLEKFLLERIKVASLGGKAGTLGDVVRVTREKSKITVTSEGSFSKRYLKYLTKKYLKKHNVRDWLRVIASNKDRNVYELRYFNIAENEGEEED

SEQ ID NO: 11216 - protein, 128 aa, Cleome gynandra
MSRGGAATTAAAKAGKKKATVFVIDCSKPVEDKIMDIATLEKFFQERIKVGGKPAALGDAVTITRDKNKITVTADTNFSKRYLKYLTKKYLKKYNVRDWLRVIASNKDRNVYELRYFNIAENDGEEED

SEQ ID NO: 11217 - protein, 128 aa, Ipomoea nil
MSKVSSGAGATKGGKKKGSTFVIDCSKPVDDKIMDIASLEKFLQERIKVGGKPGALGDSVTVTRDKTKITVTADSNFSKRYLKYLTKKYLKKNNVRDWLRVISSNKDRSVYELRYFNIAENDSGDDEE

SEQ ID NO: 11218 - protein, 127 aa, Fagopyrum esculentum
MSRGAAAGVAKGKKKSSTFTIDCSKPVEDKIMDIASLEKFLQERIKVGGKAGALGDAVTVSRDKNKLTVTSDSNFSKRYLKYLTKKYLKKHNVRDWLRVIASNKDRNVYELRYFNIAEMRPRRRLAI

SEQ ID NO: 11219 - protein, 127 aa, Vinca minor
MSKGTTGGGVLKGGKKKVAIFVIDCSKPVEDKIMDISSLEKYLQERIKVGGKPGALGDFVTVTRDKTKITVTADSNFSKRYLKYLTKKYLKKNNVRDWLRVISSNKDRSVYELRYFNIAENEAEEED

SEQ ID NO: 11220 - protein, 130 aa, Setaria italica
MARGVVAAKGGAAAGKKKGSVTFTIDCTKPVEDKIMEIASLEKFLQERIKVAGGKAGSLGDSVTVSREKTKVTVTSDGPFSKRYLKYLTKKYLKKHNVRDWLRVIAANKDRTVYELRYFNIAENEGEEED

SEQ ID NO: 11221 - protein, 132 aa, Saccharum officinarum
MARGVAAGSKGGAAGGGKKKGSVTFTIDCTKPVEDKIMEIATLEKFLQERIKVAGGKAGNLGEGVTVTRDKTKVTVTSDGPFSKRYLKYLTKKYLKKHNVRDWLRVIASNKDRSVYELRYFNIAENEGEEED

SEQ ID NO: 11222 - protein, 114 aa, Scabiosa columbaria
RGGAAGGAKGGKKKGSTFTIDCGKPVEDKIMEIASLEKFLQERIKVGGKAGALGDSVTVTREKSKITVTSDSNFSKRYLKYLTKKYLKKNNVRDWLRVIASNKDRNVYELRYFN

SEQ ID NO: 11223 - protein, 130 aa, Zea mays
MARGVVSAKGGAVAGKKKGSVSFTIDCTKPVEDKIMEVASLEKFLQERIKVAGGKAGNLGDSVTISREKTKVTVTSDGPFSKRYLKYLTKKYLKKHNVRDWLRVVAANKDRNVYELRYFNIAENEGEEED

SEQ ID NO: 11224 - protein, 114 aa, Triticum aestivum
MARGVVSAKGGAVAGKKKGSVSFTIDCTKPVEDKIMEVASLEKFLQERIKVAGGKAGNLGDSVTISREKTKVTVTSDGPFSKRYLKYLTKKYLKKHNVRDWATRGCCQQGPKRL

SEQ ID NO: 11225 - protein, 131 aa, Brachypodium distachyon
MARGVAAATKGGVAAGKKKGSVSFVIDCAKPVEDKIMEIASLEKFLQERIKVAGGKAGNLGDSVTVSRDKSKVTVTSDGAFSKRYLKYLTKKYLKKHNVRDWLRVISSNKDRSVYELRYFNIAENDGEEED

SEQ ID NO: 11226 - protein, 136 aa, Vigna unguiculata
LITVTRETVCVLERGAKMSGAKGKKKGASFVIDCAKPVEDKIMDIASLEKFLQERIKVGGKAGALGDSVTVTRDKNKITVTSDSNFSKRYLKYLTKKYLKKHNVRDWLRVIASNKDRNVYELRYFNIAENEGEEED

SEQ ID NO: 11227 - protein, 131 aa, Unknown
  Sequence found in Organisms: Festuca arundinacea, Triticum aestivum
MARGVAAATKGGAGAGKKKGSVTFVIDCTKPVDDKIMEIASLEKFLQERIKVAGGKAGNLGDSVTVARDKSKVTVTSDGAFSKRYLKYLTKKYLKKHNVRDWLRVISSNKDRSVYELRYFNIAENEGEEED

SEQ ID NO: 11228 - protein, 131 aa, Panicum virgatum
MARGVAAGAKGGAAGGKKKGSVTFTIDCTKPVEDKIMEIATLEKFLQERIKVAGGKAGNLGEGVTVSRDKTKVTVTSEGPFSKRYLKYLTKKYLKKHNVRDWLRVIASNKDRSVYELRYFNIAENEGEEED

SEQ ID NO: 11229 - protein, 125 aa, Utricularia gibba
MSKGAVAGAKGGKKKSATFIIDCSKPVEDKIMEIASLEKFLQEKIKVGGKTGALGEAITISREKNKISVTADSAFSKRYLKYLTKKYLKKHNVRDWLRVIASNKDRSVYELRYFNIAEQEAEEED

SEQ ID NO: 11230 - protein, 123 aa, Antirrhinum majus
MSKAVGAKGGKKKGATFVIDCAKPAKDKIMEIASLEKFLQERIKVGGKAGALGESVTVSRDKNKITVTADSDFSKRYLKYLTNKYLKKHNVRDWLRVIASNKERNVYELRYFNIAEQEGEEEE

SEQ ID NO: 11231 - protein, 125 aa, Solanum melongena
MSKGSSGVTKGGKKKGATFVIDCSKPVEDSIMEIASLEKFLQERIKVGGKAGALGDSVTVTRDKTKITVTSESTFSKRYLKYLTKKYLKKNSVRDWLRVISSNKDRNVYELRYFNIADNEAEEEE

SEQ ID NO: 11232 - protein, 125 aa, Solanum melongena
MSRAAAVAAKGGKKRGATFVIDCSKPVDDSIMEIASLDKFLQERIKVGGKAGALGDSVTVTRDKNKITVTSNSAFSKRYLKYLVKKYLKKNNVRDWLRVIASNKDRNVYELRYFNIAENEADEEE

SEQ ID NO: 11233 - protein, 125 aa, Capsicum annuum
MSKGSSGATKGGKKKGATFVIDCSKPVEDSIMEIASLEKFLQERIKVGGKAGALGDSVTVTRDKTKITVTTETNFSKRYLKYLTKKYLKKNSVRDWLRVISSNKDRNVYELRYFNIADNDAEEEE

SEQ ID NO: 11234 - protein, 130 aa, Podocarpus macrophillus
MGPQVAKKGGNAAAKGGKKKANTFTIDCGKPVEDKIMDIASFEKFLQDRIKVGGKTGVLGDIVTISRDKNKISVTSESAFSKRYLKYLTKKYLKKHNVRDWLRVIASNKDRNVYELRYFNIAENEGEDED

SEQ ID NO: 11235 - protein, 125 aa, Unknown
  Sequence found in Organisms: Solanum tuberosum, Solanum phureja
MSRAAAAAAKGGKKKGASFVIDCSKPVEDSIMEIGSLDKFLQERIKVGGKAGALGDSVTVSRDKNKITVTCNSTFSKRYLKYLVKKYLKKNNVRDWLRVIASNKDRNVYELRYFNIAENEADEED

SEQ ID NO: 11236 - protein, 125 aa, Solanum tuberosum
MSRAAAAAAKGGKKKGASFVIDCSKPVEDSIMEIASLDKFLQERIKVGGKAGALGDSVIVSRDKNKITVTCNSTFSKRYLKYLVKKYLKKNNVRDWLRVIASNKDRNVYELRYFNIAENEADEED

SEQ ID NO: 11237 - protein, 116 aa, Saccharum officinarum
GQEEGVVAFTIDCTKPVEDKIMEIASLEKFLQERIKVGGGKAGSLGDSVTISREKTKVTVTSDGPFSKRYLKYLTKKYLKKHNVRDWLRVIAANKDRSVYELRYFNIAENEGEEED

SEQ ID NO: 11238 - protein, 131 aa, Pinus pinaster
MGPQVAGGKKGGAAPVKGKKKASTFVIDCGKPVEDKIMDIASFEKFLQDRIKVGGKTGVLGDIVTIAREKNKISVTSESAFSKRYLKYLTKKYLKKHNVRDWLRVIASNKDRNVYELRYFNIAENEAEEED

SEQ ID NO: 11239 - protein, 126 aa, Brassica juncea
YAEANGGLSTTAKNPEAEDWKAMVGRWGRGEERTPEGVIFVEKLADDEGDDDHGGYNGGEGATSAWGIVAQGRGTDCGPVCYLLKTTRVGSGMGTVCTHFCLVKVKSFRETAMLQLNNSWLVQTGQ

SEQ ID NO: 11240 - protein, 131 aa, Pinus taeda
MGPQVAGGKKGGAAPVKGKKKASTFVIDCGKPVEDKIMDIASFEKFLQDRIKVGGKTGVLGDIVTISREKNKISVTSESAFSKRYLKYLTKKYLKKHNVRDWLRVIASNKDRNVYELRYFNIAENEAEEED

SEQ ID NO: 11241 - protein, 116 aa, Ambrosia trifida
KGGKKKQSTFVIDCGKPVEDKIMEIASLEKFLQERIKVGGKAGNLGDSVTISREKNKISVTADSNFSKRYLKYLTKKYLKKHNVRDWLRVIASNKDRNVYELRYFNIAENEGEEED

SEQ ID NO: 11242 - protein, 124 aa, Amborella trichopoda
MSGKGASVPKGKKKTSTFVIDCAKPVEDKIMDIASFEKFLQDRIKVGGKTGVLGESITIAREKSKISVTADTAFSKRYLKYLTKKYLKKHNVRDWLRVIASNKDRNVYELRYFNIAENEAEEED

SEQ ID NO: 11243 - protein, 118 aa, Brassica juncea
MSRGSAAVTKGKKKGVSFSIDCSKPVDDKIMEIASLEKFLQERIKVGGKAGALGDSVTITREKNKITVTSDGQFSKRYLKYLTKKYLKKHNVRDWLRVIAANKDRNLYELRYFNIAEN

SEQ ID NO: 11244 - protein, 134 aa, Curcuma longa
FDRELSRGSGGSTAAAGKGGKKKGSTFVIDCAKPVDDKIMDIASLEKFLQERIKVNGGKAGALGDAVTVTRDKSKITVTSEGPFSKRYLKYLTKKFLKKHNVRDWLRVIASNKDRNVYELRYFNIAENEGEDED

SEQ ID NO: 11245 - protein, 124 aa, Solanum lycopersicum
MSRAAAAVKGGKKKGASFVIDCSKPVEDSIMEIASLDKFLQERIKVGGKAGALGDSVTVTRDKNKITVTCNSTFSKRYLKYLVKKYLKKNNVRDWLRVIASNKDRNVYELRYFNIAENEADEED

SEQ ID NO: 11246 - protein, 128 aa, Antirrhinum majus
MSKSAAAAGAGAKGGKKKGVSFVIDCQKPVEDKIMEIASLEKFLQERIKVGGKAGALGDSVTISRDKNKITVTADSTFSKRYLKYLTKKYLKKHNVRDWLRVIASNKERNVYELRYFNIAEQEAEEED

SEQ ID NO: 11247 - protein, 133 aa, Eucalyptus grandis
MRKGGSGAAAAAAAGGAKGGKKKGASFVIDCAKPVEDKIMDIASLEKFLQERIKVDGKAGALGDVVSVARDKSKITVTSDSNFSKRYLKYLTKKYLKKHNVRDWLRVIASNKDRNVYELRYFNIAENEGEEED

SEQ ID NO: 11248 - protein, 127 aa, Olea europaea
MSKGAAGAAVKGGKKKASTFLIDCSKPVEDKIMDIASLEKFLQERIKVGGKPGALGDSVTVTRDKSKITVVANETSFSKRYLKYLTKKYLKKNNVRDWLRVIASNKDRNVYELRYFNIAENEAEEEE

SEQ ID NO: 11249 - protein, 127 aa, Cleome spinosa
MARGAAAMATAAGKKKGSTFVIDCSKPVDDKIMDVASLEKFLQERIKVGGKPGALGDAVTVTRDKTKITVTATSDFSKRYLKYLTKKYLKKNNVRDWLRVISSNKDRNVYELRYFNIAENEGEEEED

SEQ ID NO: 11250 - protein, 131 aa, Pennisetum glaucum
MARGVVSAKGGGAAAGKKKGSVSFTIDCTKPVEDKIMEIASLEKFLQERIKVAGGKAGSLGDSVTVSREKTKVTVTSDGPFSKRYLKYLTKKYLKKHNVRDWLRVIAANKDRTVYELRYFNIAENEGEEED

SEQ ID NO: 11251 - protein, 130 aa, Allium cepa
APKVSSAGSKPASKGPKKKATTFVIDCAKPVEDKIMDIASLEKFLQERIKVAGGKAGAFGDSVTITRDKSKVSVTSDGPFSKRYLKYLTKKYLKKHNVRDWLRVISSDKDRNVYELRYFNIAENEAEEEE

SEQ ID NO: 11252 - protein, 131 aa, Hordeum vulgare
MARGVTAATKGGAGAGKKKGSVTFVIDCTKPVDDKIMEIASLEKFLQERIKVAGGKAGNLGDSVTVARDKSKVTVTSDGAFSKRYLKYLTKKYLKKHNVRDWLRVISSNKDRSVYELRYFNIAENEGEEED

SEQ ID NO: 11253 - protein, 131 aa, Triticum aestivum
MARGVPAATKGGAGAGKKKGSVTFVIDCTKPVDDKIMEIASLEKFLQERIKVAGGKAGNLGDSVTVARDKSKVTVTSDGAFSKRYLKYLTKKYLKKHNVRDWLRVISSNKDRSVYELRYFNIAENEGEEED

SEQ ID NO: 11254 - protein, 85 aa, Glycine max
MADLQQKLDALKGLVGVLNSMDEGETHNNATSPNNPHNPTPMPGRNHSIGKYNNSGTQKIKGLSNQTGFTEGNANGAINFGSLHA

SEQ ID NO: 11255 - protein, 243 aa, Glycine max
MDGRHQKQKNKYSIIVPTYNERLNIGLIVYLIFKHLGDADFEIIIVDDGSPDGTQDVVKQLQQVYGEDRILLRARPRKLGLGTAYIHGMKHASGNFVVIMDADLSHHPKYLPNFIRKQSETGADIVTGTRYVKGGGVHGWNLMRKLTSRGANVLAQTLLWPGVSDLTGSFRLYRKSVLEDIISCCVSKGYVFQMEMIVRASRKGYHIEEVPITFVDRVFGSSKLGGSEIVEYLKGLAYLLVTT

SEQ ID NO: 11256 - protein, 243 aa, Cajanus cajan
MDGQHQKQKNKYSIIVPTYNERLNIGLIVYLIFKHLGDVDFEIIVVDDGSPDGTQDVVKQLQQVYGEDRILLRARPRKLGLGTAYIHGMKHASGNFVVIMDADLSHHPKYLPSFIRKQLETGADIVTGTRYVKGGGVHGWNLMRKLTSRGANVLAQTLLWPGVSDLTGSFRLYRKSVLEDIISCCVSKGYVFQMEMIVRASRKGYHIEEVPITFVDRVFGSSKLGGSEIVEYLKGLAYLLVTT

SEQ ID NO: 11257 - protein, 243 aa, Trigonella foenum-graecum
MDGEHQKQKNKYSIIVPTYNERLNISLILYLIFKHLQDVDFEVIVVDDGSPDGTQDIVKQLQQVYGEDRILLRARPRKMGLGTAYIHGMKHASGNFVVIMDADLSHHPKYLPGFLRKQLETGADIVTGTRYVKGGGVHGWNLMRKLTSRGANVLAQTLLWPGVSDLTGSFRLYRKSALEDIISCCVSKGYVFQMEMIVRASRKGYHIEEVPITFVDRVYGSSKLGGSEIVEYLKGLVYLLVTT

SEQ ID NO: 11258 - protein, 243 aa, Arachis hypogaea
MDGLNKNQANKYSIIVPTYNERLNIGLIVYLIFKHLKDVDFEVIVVDDGSPDGTQDIVIQLQKVYGEDRILLRPRPKKLGLGTAYIHGMKHASGNFVVIMDADLSHHPKYLPRFISKQMETRADIVTGTRYVKGGGVHGWNLMRKLTSRGANVLAQTFLWPGVSDLTGSFRLYRKSVLEDIISCCVSKGYVFQMEMIVRASRKGYHIEEVPITFVDRVFGSSKLGGSEIVEYLKGLAYLLVTT

SEQ ID NO: 11259 - protein, 243 aa, Medicago truncatula
MDEKHNQKKNKYSIIVPIYNERLNISLILYLIFKHLPDVDFEVIVVDDGSPDGTQDVVKQLQQVYGEDRILLRARPRKMGLGTAYIHGMKHASGNFVVIMDADLSHHPKYLPGFIRKQLETGADIVTGTRYVKGGGVHRWNLMRKLTSRGANVLAQTLLWPGVSDLTGSFRLYRKTVLEDIISCCVSKGSVFQMEMIVRASRKGYHIKEVPITFVDRVYGSSKLGGSEIVEYLKGLVYLLMTT

SEQ ID NO: 11260 - protein, 168 aa, Heritiera littoralis
MEQKNKYSIIVPTYNERLNIALIVYLIFKHLRDVDFEIIVVDDGSPDGTQEVVKQLQKLYGEDRILLRPRPKKLGLGTAYIHGLKHASGNFVVIMDADLSHHPKYLPSFIKKQLETGASIVTGTRYVKGGGVHGWNLMRKLTSRGANVSCTDSFVAWCIGLNWIFQAL

SEQ ID NO: 11261 - protein, 239 aa, Quercus alba
MEINKNKYSIIVPTYNERLNIALLVYLVFKHLRDVDFEIIVVDDGSPDGTQEVVKQLQQVYGEDRILLRARPRKLGLGTAYVHGLKHASGNFVVIMDADLSHHPKYLPSFIRKQLETGASIVTGTRYVKGGGVHGWNLMRKLTSRGANVLAQTLLWPGVSDLTGSFRLYRKSVLEDVISSCVSKGYVFQMEMIVRASRKRYHIEEVPITFVDRVYGSSKLGGSEIVEYLKGLAYLLVTT

SEQ ID NO: 11262 - protein, 240 aa, Populus trichocarpa
MEKEKKNKYSIIVPTYNERLNIALIVYLIFKHLRDVDFEIIIVDDGSPDGTQEVVKQLQQVYGEDHILLRPRAKKLGLGTAYIHGLKHASGNFVVIMDADLSHHPKYLPSFIKKQLETGASIVTGTRYVKGGGVHGWNLRRKLTSRGANVLAQTLLWPGVSDLTGSFRLYKKSVLEDIISSVVSKGYVFQMEMIVRASRKGYHIEEVPITFVDRVFGSSKLGGSEIVEYLKGLAYLLVTT

SEQ ID NO: 11263 - protein, 241 aa, Theobroma cacao
MEQKKEKNKYSVIVPTYNERLNIALIVYLIFKHLREVDFEIIVVDDGSPDGTQEVVKQLQKLYGEDRILLRPRPKKLGLGTAYVHGLKHASGNFVVIMDADLSHHPKYLPSFIKKQLETDASIVTGTRYVKGGGVHGWNLMRKLTSRGANVLAQTLLWPGVSDLTGSFRLYRKSVLEDVISSCVSKGYVFQMEMIVRASRKGYHIEEVPITFVDRVFGSSKLGGSEIVEYLKGLAYLLVTT

SEQ ID NO: 11264 - protein, 242 aa, Manihot esculenta
MEQRKEEKNKYSIIIPTYNERLNIALIVYLIFKHLRDVEFEIIVVDDGSPDGTQEVVKQLQQVYGEDHILLRPRPKKLGLGTAYIHGLKHASGNFVVIMDADLSHHPKYLPSFIKKQLETGASIVTGTRYVQGGGVHGWNLMRKLTSRGANVLAQTLLWPGVSDLTGSFRLYKKSVLEDIISSVVSKGYVFQMEMIVRASRKGYHIEEVPITFVDRVFGSSKLGGSEIVEYLKGLVYLLVTT

SEQ ID NO: 11265 - protein, 243 aa, Vitis vinifera
MEEQHKNGGNKYSIIVPTYNERLNIALIVFLIFKHLRDVDFEIIIVDDGSPDGTQEIVKQLQQVYGEDRILLRARPKKLGLGTAYSHGLKHASGNFVVIMDADLSHHPKYLPSFIKKQLETGASIVTGTRYVKGGGVHGWNLMRKLTSRGANVLAQTLLWPGVSDLTGSFRLYKKSVLEEVISSCVSKGYVFQMEIIVRASRKGYHIEEVPITFVDRLFGSSKLGGSEIVGYLKGLAYLLVTT

SEQ ID NO: 11266 - protein, 245 aa, Eucalyptus grandis
MEDVRPEGGAGDKYSLIVPTYNERLNIALIVYLVFKHLRDVDFEIIIVDDGSPDGTQDIVKQLQQVYGDDRILLRARPRKLGLGTAYRHGLKHASGNFVVIMDADLSHHPKYLPSFIKKQQETGASIVTGTRYVKGGGVHGWNLMRKLTSRGANVLAQTFLWPGVSDLTGSFRLYRKSVLEDLINSCVSKGYVFQMEMIVRASRKGYHIEEVPITFVDRVFGSSKLGGSEIVEYLKGLAYLLVTT

SEQ ID NO: 11267 - protein, 183 aa, Sarracenia psittacina
MAMEEQQQKKERNKYSIIVPTYNERLNIALIVYLVFKHLPDVDFEMIIVDDGSPDGTQDVVKKLQEVYGEDRILLRARPKKLGLGTAYVHGLKHASGNFVVIMDADLSHHPKYLPSFIKKQRETGASIVTGTRYVKGGGVHGWNLMRKLTSRGANVLAQTLLWPGVSDLTGSFRLYKKLCLKM

SEQ ID NO: 11268 - protein, 243 aa, Euonymus alatus
MEKEKREEKNKYSIIVPTYNERLNIALLVYLIFKHLREVDFEVIVVDDGSPDGTQEVVEQLQQVYGEDHVLLRPRPRKLGLGTAYIHGLKHVSGNFVVIMDADLSHHPKYLPSFIKKQLETDADIVTGTRYVKGGGVHGWNLMRKLTSRGANVLAHTLLWPGVSDLTGSFRLYRKSVLEDVISSCVSKGYVFQMEMIVRASRKGYHIEEVPITFVDRVFGSSKLGGSEIVEYLKGLAYLLVTT

SEQ ID NO: 11269 - protein, 239 aa, Aquilegia formosa
MEKEKNKYSIIVPTYNERLNIALLVYLIFKHLKDVDFEIIVVDDGSPDGTQEVVKQLQKLYGEDRILLRARPRKLGLGTAYIHGLKHASGNFVVIMDADLSHHPKYLPSFIRKQIETGANIVTGTRYVRGGGVHGWNLMRKLTSRGANVLAQTLLWPGVSDLTGSFRLYQRSVLEDVINSCVSKGYVFQMEMIVRASRKGCHIAEVPITFVDRVYGSSKLGGSEIVEYLKGLAYLLVTT

SEQ ID NO: 11270 - protein, 238 aa, Ricinus communis
MGEKNKYSLIIPTYNERLNIALIVYLIFKHLRDVDFEIIVVDDGSPDGTQEVVKQLQQLYGEDRVLLRPRPEKLGLGTAYIHGLKHASGNFVVIMDADLSHHPKYLPSFIEKQSETGASIVTGTRYVTGGGVHGWNLMRKLTSRGANVLAQTLLWPGVSDLTGSFRLYKKSVLEDIISSVVSKGYVFQMEMIVRASRKGYHIEEVPITFIDRVFGSSKLGGSEIVEYLKGLAYLLVTT

SEQ ID NO: 11271 - protein, 242 aa, Citrus sinensis
MEETNKNKNKYSIIIPTYNERLNIALIVYLIFKHLRDVDFEIIVVDDGSPDGTQEVVKQLQQLYGEDRILLRPRPKKLGLGTAYIHGLKHASGSFVVIMDADLSHHPKYLPSFIKKQLETGASIVTGTRYVRSGGVHGWNLMRKLTSRGANVLAQTLLWPGVSDLTGSFRLYKKSVLEDVISSCVSKGYVFQMEMIVRACRKGYHIEEVPITFVDRVFGSSKLGGSEIVEYLKGLLYLLVTT

SEQ ID NO: 11272 - protein, 866 aa, Ricinus communis
MLGSLTLFPAPVFGSLANNSKRAFGNDCHITRQKPLGLIHRSQYLLGCPKVYFLSRFPVNKTVQHVLTASAVMTDDSSTKTNIDEDMENIGLLSTDPGLDQFKDHFRYRVKRFIDQKQLIEKHEGGLEEFSKGYQKFGFNREDGSIVYREWAPAAQEAQVIGDFNGWNGSNHRMEKNEFGVWSIRIPDSAGNPAIPHNSRVKFRFKHGNGAWVDRIPAWIRYATVDPSSFGAPYDGVYWDPPASERYQFKYPRPPKPRAPRIYEAHVGMSSSEPRVNSYREFADDVLPHIQANNYNTVQLMAVMEHSYYGSFGYHVTNFFAVSSRSGTPEDLKYLIDKAHSLGLRVLMDVVHSHASNNVTDGLNGFDVGQSSQDSYFHTADRGYHKLWDSRLFNYANWEVLRFLLSNLRWWLEEYKFDGFRFDGVTSMLYHHHGINMGFSGNYIEYFSEATDVDAVVYLMLANSLIHNLLPDATVIAEDVSGMPGLSCSVSEGGIGFDYRLAMAIPDKWIDYLKNKTDEEWSMGDISWSLTNRRYTEKCVAYAESHDQAIVGDKTIAFLLMDTEMYSGMSCLTDAPPTVERGIALHKMIHLLTMALGGEGYLNFMGNEFGHPEWIDFPREGNGWSYDKCRRQWNLVDTEHLRYKFMNAFDKAMNLLDEKHSFLSSTKQIVSSTNEEDKAIVFERGDLVFVFNFHPENTYDGYKVGCDLPGKYKVALDSDAWEFGGQGRVGHDVDHFTSPEGIPGVPETNFNNRPNSFKVLSPPQTCVAYYRVQESQESNNSINPGARNEISTADDVPKLRDIEVGMKQTLAADTGAKRGDLEEVVNQTLASDAATMLEVFKEPADDKDTEEPTVSVKKGNSKAQEI

SEQ ID NO: 11273 - protein, 242 aa, Cirsium arvense
MAENQNKNNKYSIIVPTYNERLNIALIVFLVFKHIPNVDFEIIIVDDGSPDGTQDIVKQLQQVYGEDRILLRARPRKLGLGTAYIHGLKHASGNFVVIMDADLSHHPKYLPQFIKKQMETGASIVTGTRYVRGGGVHGWTLMRKLTSRGANVLAHTLLWPGVSDLTGSFRLYKKSVLEDIISSCVSKGYVFQMEMIVRASRKGYHIEEVPITFVDRVYGSSKLGGSEIVEYLKGLVYLLVTT

SEQ ID NO: 11274 - protein, 242 aa, Unknown
  Sequence found in Organisms: Citrus clementina, Citrus sinensis
MEETNKNKNKYSIIIPTYNERLNIALIVYLIFKHLRDVDFEIIVVDDGSPDGTQEVVKQLQQLYGEDRILLRPRPKKLGLGTAYIHGLKHASGSFVVIMDADLSHHPKYLPSFIKKQLETGASIVTGTRYVRSGGVHGWNLMRKLTSRGANVLAQTLLWPGVSDLTGSFRLYKKSVLEDVISSCVSKGYVFQMEMIVRACRKGYHIEEVPITFVDRVFGSSKLGGSEIVEYLKGLLYLLITT

SEQ ID NO: 11275 - protein, 239 aa, Gossypium hirsutum
MDAAKNKYSIIVPTYNERLNIALIVYLIFKHLRDVDFEIIVVDDGSPDGTQEVVKKLQTLYGEDRILLRPRPKKLGLGTAYIHGLKHASGNFVVIMDADLSHHPKYLPSFIKKQLETGASIVTGTRYVKGGGVHGWNLIRKLTSRGANVLAQTLLWPGVSDLTGSFRLYKKSVLEDVISSCVSKGYVFQMEMIVRASRKGYHIEEVPITFVDRVFGSSKLGGSEIVEYLKGLVYLLMTT

SEQ ID NO: 11276 - protein, 238 aa, Populus trichocarpa
MEKNNRYSIIVPTYNERLNIALIVYLIFKHLQDVEFEIIVVDDGSPDGTQEVVKQLQKVYGEDRILLRPRAKKLGLGTAYIHGLKHASGNFVVIMDADLSHHPKYLPSFIKKQLETGASIVTGTRYVKGGGVHGWNLMRKLTSRGANVLAQTLLWPGVSDLTGSFRLYKKSVLEDIISSVVSKGYVFQMEMIVRASRKGYQIEEVPITFVDRVFGSSKLGGSEIVEYLKGLAYLLVTT

SEQ ID NO: 11277 - protein, 239 aa, Fragaria vesca
MEKTKNKYSIIVPTYNERLNIALLVYLVFKHLRDVDFEIIIVDDGSPDGTQLVVQQLQDLYGQDRILLRARPRKLGLGTAYIHGLKHASGDFVVIMDADLSHHPKYLPSFIKKQLETNASIVTGTRYVKGGGVHGWNLMRKLTSRGANVLAQTLLWPGVSDLTGSFRLYKKSALEDIISSCVSKGYVFQMEMIVRASRKGYHIEEVPITFVDRVYGISKLGGSEIVEYLKGLAYLLVTT

SEQ ID NO: 11278 - protein, 241 aa, Helianthus annuus
MAEEEEKNKYSIIVPTYNERLNIALIVFLVFKHIPDVDFEIIIVDDGSPDGTQDIVKQLQQVYGDDRILLRARPKKLGLGTAYIHGLKHASGNFVVIMDADLSHHPKYLPHFIKKQIETRADIVTGTRYVKGGGVHGWTLMRKLTSRGANVLAHTLLWPGVSDLTGSFRLYKKSVLEDIISSCVSKGYVFQMEMIVRASRKGYHIEEVPITFVDRVYGSSKLGGSEIVEYLKGLVYLLVTT

SEQ ID NO: 11279 - protein, 242 aa, Cannabis sativa
MEIGDNPKNKYSIIVPTYNERLNIALIVYLIFKHLRDVDFEVIVVDDGSPDGTQEIVKQLQKVYGEERILLRPRPKKLGLGTAYIHGLKHATGNFVVIMDADLSHHPKYLPSFIKKQSETGASIVTGTRYVKGGGVHGWTLMRKLTSRGANVLAQTLLWPGVSDLTGSFRLYRKSVLEDVISSCVSKGYVFQMEMIVRASRKGYHIEEVPITFVDRVYGTSKLGGSEIVEYLKGLVYLLFTT

SEQ ID NO: 11280 - protein, 233 aa, Cirsium arvense
KYSIIVPTYNERLNIALIVFLVFKHIPDVDFEIIIVDDGSPDGTQDIVKQLQQVYGEDRILLRARPRKLGLGTAYIHGLKHASGNFVVIMDADLSHHPKYLPQFIKKQMETGASIVTGTRYVRGGGVHGWTLMRKLTSRGANVLAHTLLWPGVSDLTGSFRLYKKSVLEDIISSCVSKGYVFQMEMIVRASRKGYHIEEVPITFVDRVYGSSKLGGSEIVEYLKGLVYLLVTT

SEQ ID NO: 11281 - protein, 243 aa, Tripterygium wilfordii
MEQEKSEEKIKYSIIVPTYNERLNIALLVYLIFKHLREVDFEVIVVDDGSPDGTQEVVKQLQQVYGEDHILLRPRPRKLGLGTAYIHGLKHVSGNFVVIMDADLSHHPKYLPNFIKKQLETDADIVTGTRYVKGGGVHGWNLMRKLTSRGANVLAHTLLWPGVSDLTGSFRLYRKSVLEDVISSCVSKGYVFQMEMIVRASRKGYHIEEVPITFVDRVFGTSKLGGSEIVEYLKGLLYLLVTT

SEQ ID NO: 11282 - protein, 242 aa, Citrullus lanatus
MAEPEKERNKYSLIVPTYNERLNIALLVYLIFKHLPDVDFEIIVVDDGSPDGTQEVVKQLQWVYGEDRILLRARPRKLGLGTAYCHGLKHATGNFVVIMDADLSHHPKYLPSFIQKQLQTGADIVTGTRYVKGGGVHGWNLMRKLTSRGANVLAQTLLWPGVSDLTGSFRLYKKSVLEDIISSVVSKGYVFQMEMIVRATRKGYHIEEVPITFVDRLFGTSKLGGSEIVEYLKGLLYLLVTT

SEQ ID NO: 11283 - protein, 243 aa, Antirrhinum majus
PMEEKEQKKNKYSIIVPTYNERLNIGLIIYLIFKHLTNVNFEIIVVDDGSPDGTQEIVKQLQQVYGEDRILLRPRAKKLGLGTAYMHGLKHASGNFVVIMDADLSHHPKYLPSFIKKQMETGASIVTGTRYVKGGGVHGWNLMRKLTSRGANVLAHTLLWPGVSDLTGSFRLYKKSVLEDVISSCVSKGYVFQMEMIVRASRKGYHIEEVPITFVDRVYGTSKLGGSEIVEYLKGLLYLLVTT

SEQ ID NO: 11284 - protein, 241 aa, Solanum melongena
IKTMGEKNKYSIIIPTYNERLNIALIVYLVFKHLTDVDFEIIVVDDGSPDGTQDIVKQLQKVYGEDRILLRPRPRKLGLGTAYIHGLKHASGNFVVIMDADLSHHPKYLPRFIKKQMETGANIVTGTRYVSSGGVHGWSLMRKLTSRGANVLAQTLLWPGVSDLTGSFRLYQKSALEDIISSCVSKGYVFQMEMIVRASRKGYHIEEVPITFVDRVFGSSKLGGSEIVEYLKGLLYLLVTT

SEQ ID NO: 11285 - protein, 241 aa, Tropaeolum majus
MEENKERNKYSIIVPTYNERLNIALIVYLIFKHLRDFDFEIIVVDDGSPDGTQEIVMQLQKLYGEERILLRPRAKKLGLGTAYIHGLKHASGNFVVIMDADLSHHPKYLPSFIMKQAETGASIVTGTRYVQGGGVHGWNLMRKLTSRGANVLAQTLLWPGVSDLTGSFRLYKKSVLEDIISSCVSKGYVFQMEMIVRASRKGYHIEEVPITFVDRVFGSSKLGGSEIVEYLKGLAYLMVTT

SEQ ID NO: 11286 - protein, 241 aa, Triphysaria pusilla
MEAKEDKNKYSIIVPTYNERLNIALIVYLIFKHLRNVDFEIIIVDDGSPDGTQEIVKQLQQVYGEDRILLRPRPKKLGLGTAYIHGLKHVSGSFVVIMDADLSHHPKYLPSFIKKQKDTGASIVTGTRYVKDGGVHGWNLMRKLTSRGANVLAQTLLWPGVSDLTGSFRLYKKSVLEDVISSCVSKGYVFQMEMIVRASRKGYRIEEVPITFVDRVYGSSKLGGSEIVEYLKGLLYLLVTT

SEQ ID NO: 11287 - protein, 214 aa, Lotus japonicus
MDEQHQKDKDKYSIIVPTYNERLNIGLIVYLLFKHLRDVDFEIIVVDDGSPDGTQDVVKQLQKVYGEDRILLRARPRKLGLGTAYIHGMKHASGNFVVIMDADLSHHPKYLPSFIRKQKETGADIVTGTRYVKGGGVHGWTLMRKLTSRGANVLAQTLLWPGVSDLTGSFRLYRKSALEDIISRCVTKGYVFQMEMIVRASRKGTILKSSNHVC

SEQ ID NO: 11288 - protein, 240 aa, Flaveria ramosissima
LQMANKNKYSIIVPTYNERLNIALIVFLVFKHMPDVDFEIIIVDDGSPDGTQDIVKQLQRVYGDDRILLRARPRKLGLGTAYIHGLKHASGNFIVIMDADLSHHPKYLPHFIKKQMETGADIVTGTRYVRGGGVHGWTLMRKLTSRGANVLAHTLLWPGVSDLTGSFRLYKKSVLEDIISSCVSKGYVFQMEMIVRASRKGYHIEEVPITFVDRVYGSSKLGGSEIVEYLKGLVYLLFTT

SEQ ID NO: 11289 - protein, 242 aa, Humulus lupulus
MEVGDTPKNKYSIIVPTYNERLNIALIVYLIFKHLRDVDFEVIVVDDGSPDGTQEIVKQLQKVYGEDRILLRPRPKKLGLGTAYIHGLKHATGNFVVIMDADLSHHPKYLPSIIKKQLETGASIVTGTRYVKGGGVHGWTLMRKLTSRGANVLAQTLLWPGVSDLTGSFRLYRKSVLEDVISSCVSKGYVFQMEMIVRASRKGYHIEEVPITFVDRVYGTSKLGGSEIVEYLKGLVYLLCTT

SEQ ID NO: 11290 - protein, 241 aa, Lippia dulcis
MEAKDEKDKYSIIIPTYNERLNIALIVYLIFKHLSNVNFEIIVVDDGSPDGTQDIVKQLQQVYGEDRILLRPRAKKLGLGTAYIHGLKHATGNFVVIMDADLSHHPKYLPSFIKKQMETGASIVTGTRYVKGGGVHGWNLMRKLTSRGANVLAHTLLWPGVSDLTGSFRLYKKSVLEDVISSCVSKGYVFQMEMIVRASRKGYHIEEVPITFVDRVYGSSKLGGSEIVEYLKGLLYLLVTT

SEQ ID NO: 11291 - protein, 243 aa, Valeriana officinalis
MGEEEAEKNKYSIIIPTYNERLNIALIVYLLFKHLNQDVDFEIIVVDDGSPDGTQDIIKQLQRVYGENRILLRARPRKLGLGTAYIHGLKHASGNFVVIMDADLSHHPKYLPSFIKKQMETNASIVTGTRYVKGGGVHGWNLMRKLTSRGANVLAHTLLWPGVSDLTGSFRLYKKSVLEDVISCCVSKGYVFQMEMIVRASRKGYNIEEVPITFVDRVYGSSKLGGSEIVEYLKGLVYLLLTT

SEQ ID NO: 11292 - protein, 243 aa, Mimulus guttatus
MEAKEDDDNNKYSIIVPTYNERLNIALIVYLIFKHLQNVNFEIIVVDDGSPDGTQEIVKQLQQVYGEDRILLRPRAKKLGLGTAYIHGLKHATGNFVVIMDADLSHHPKYLPSFIKKQIETGASIVTGTRYVSGGGVHGWNLMRKLTSRGANVLAQTLLWPGVSDLTGSFRLYKKSVLEDVISSCVSKGYVFQMEMIVRASRKGYHIEEVPITFVDRVYGSSKLGGSEIVEYLKGLLYLLVTT

SEQ ID NO: 11293 - protein, 238 aa, Unknown
  Sequence found in Organisms: Solanum tuberosum, Solanum phureja
MGEKNKYSIIIPTYNERLNIALIIYLVFKHLTDVDFEIIVVDDGSPDGTQDIVKQLQKVYGEDRILLRPRPRKLGLGTAYIHGLKHASGNFVVIMDADLSHHPKYLPRFIKKQMETGANIVTGTRYVSSGGVHGWNLMRKLTSRGANVLAQTLLWPGVSDLTGSFRLYQKSALEDIISSCVSKGYVFQMEMIVRASRKGYRIEEVPITFVDRVFGSSKLGGSEIVEYLKGLLYLLVTT

SEQ ID NO: 11294 - protein, 144 aa, Amsonia hubrichtii
MDADLSHHPKYLPSFIKKQIETGADIVTGTRYVKGGGVHGWNLMRKLTSRGANVLAQTLLWPGVSDLTGSFRLYRKTVLEDVISSVVSKGYVFQMEMIVRATRKGLHIQEVPITFVDRVYGTSKLGGSEIVEYLKGLLYLLVTT

SEQ ID NO: 11295 - protein, 245 aa, Euphorbia peplus
MEEEKKLINPTDKYSIIIPTYNERLNIALIVYLIFKHLRDVDFEIIVVDDGSPDGTQEIVKQLQQVYGEDRILLRPRPRKLGLGTAYVHGLKHASGNFVVIMDADLSHHPKYLPSFIKKQKETNASIVTGTRYVKGGGVHGWNLMRKLTSRGANVLAHTLLWPGVSDLTGSFRLYKKSALEDIISSVVSKGYVFQMEMIVRASRKGYHIEEVPITFVDRVFGSSKLGGSEIVEYLKGLLYLLVTT

SEQ ID NO: 11296 - protein, 244 aa, Solanum lycopersicum
NFEINKMGEKNKYSIIIPTYNERLNIALIIYLVFKHLTDVDFEIIVVDDGSPDGTQDIVKQLQKVYGEDRILLRPRPRKLGLGTAYIHGLKHASGNFVVIMDADLSHHPKYLPRFIKKQMETGANIVTGTRYVSSGGVHGWNLMRKLTSRGANVLAQTLLWPGVSDLTGSFRLYQKSALEDIISSCVSKGYVFQMEMIVRASRKGYRIEEVPITFVDRVFGSSKLGGSEIVEYLKGLLYLLVTT

SEQ ID NO: 11297 - protein, 232 aa, Flaveria ramosissima
YSIIVPTYNERLNIALIVFLVFKHLPDVDFEIIIVDDGSPDGTQDIVKQLQRVYGDDRILLRARPRKLGLGTAYIHGLKHASGNFVVIMDADLSHHPKYLPHFIKKQMETGADIVTGTRYVRGGGVHGWTLMRKLTSRGANVLAHTLLWPGVSDLTGSFRLYKKSVLEDIISSCVSKGYVFQMEMIVRASRKGYHIEEVPITFVDRVYGSSKLGGSEIVEYLKGLVYLLFTT

SEQ ID NO: 11298 - protein, 238 aa, Malus domestica
METKNKYSIIVPTYNERLNIALLVYLVFKHLRDVDFEIIVVDDGSPDGTQEIVEQLQQVYGHDRILLRARAKKLGLGTAYIHGLKHASGNFVVIMDADLSHHPKYLPSFIKKQLETGASIVTGTRYVRGGGVHGWNLMRKLTSRGANVLAQTLLWPGVSDLTGSFRLYRKTVLEDIISSCVSKGYVFQMEMIVRASRKGYHIEEVPISFVDRVYGISKLGGSEIVEYLKGLVYLLVTT

SEQ ID NO: 11299 - protein, 237 aa, Capsicum annuum
ARGHKYSIIIPTYNERLNIALIIYLVFKHLSDVDFEIIVVDDGSPDGTQDIVKQLQKVYGEDRILLRPRPRKLGLGTAYIHGLKHASGNFVVIMDADLSHHPKYLPRFIKKQMETGANIVTGTRYVSSGGVHGWNLMRKLTSRGANVLAQTLLWPGVSDLTGSFRLYQKSALEDIISSCVSKGYVFQMEMIVRASRKGYHIEEVPITFVDRVFGSSKLGGSEIVEYLKGLLYLLVTT

SEQ ID NO: 11300 - protein, 240 aa, Tragopogon dubius
MAEQQKNKYSIIVPTYNERLNIALIVYLVFKHIPDINFEIIIVDDGSPDGTQDIVKQLQKVYGDDRILLRPRPRKLGLGTAYIHGLKHASGNFVIIMDADLSHHPKYLPQFIKKQIETGASIVTGTRYVSGGGVHGWTLMRKLTSRGANVLAHTLLWPGVSDLTGSFRLYKKSVLEDIISSCVSKGYVFQMEMIVRASRKGYHIEEVPITFVDRVYGSSKLGGSEIVEYLKGLVYLLLTT

SEQ ID NO: 11301 - protein, 241 aa, Ambrosia trifida
MENKNKYNKYSIIIPTYNERLNIALIVFLVFKHIPDVDFEIIVVDDGSPDGTQDIVKQLQQVYGDDRILLRARPKKLGLGTAYIHGLKHASGNFVVIMDADLSHHPKYLPHFIKKQVETGADIVTGTRYVRGGGVHGWTLMRKLTSRGANVLAHTLLWPGVSDLTGSFRLYKKSVLEDIISSCVSKGYVFQMEMIVRASRKGYHIKEVPITFVDRVYGSSKLGGSEIVEYLKGLVYLLFTT

SEQ ID NO: 11302 - protein, 245 aa, Ipomoea nil
ESYDRKKMEKKTKFSIIVPTYNERLNIALIVYLVFKHLQDVDFEVIVVDDGSPDGTQDIVKQLQRVYGEDRILLRPRPAKLGLGTAYIHGLKYVSGDFVVIMDADLSHHPKYLPRFIKKQMETGADIVTGTRYVKGGGVHGWNLMRKLTSRGANVLAQTLLWPGVSDLTGSFRLYRKSVLEDIISSCVSKGYVFQMEMIVRASRKRYHIEEVPITFVDRVFGSSKLGGSEIVEYLKGLVYLLFTT

SEQ ID NO: 11303 - protein, 238 aa, Ambrosia trifida
MENKNKYTIIIPTYNERLNIALIVFLVFKHIPDVDFEIIVVDDGSPDGTQDIVKQLQQVYGDDRILLRARPKKLGLGTAYIHGLKHASGNFVVIMDADLSHHPKYLPHFIKKQVETGADIVTGTRYVRGGGVHGWTLMRKLTSRGANVLAHTLLWPGVSDLTGSFRLYKKSVLEDIISSCVSKGYVFQMEMIVRASRKGYHIEEVPITFVDRVYGSSKLGGSEIVEYLKGLVYLLFTT

SEQ ID NO: 11304 - protein, 232 aa, Arnica chamissonis
YSIIVPTYNERLNIALIVFLVFKHIPDVDFEIIIVDDGSPDGTQDIVKQLQQVYGDDRILLRARPRKLGLGTAYIHGLKHASGNFVVIMDADLSHHPKYLPHFIKKQMEMGADIVTGTRYVRGGGVHGWTLMRKLTSRGANVLAHTLLWPGVSDLTGSFRLYKKSVLEDIISSCVSKGYVFQMEMIVRASRKGYHIEEVPITFVDRVYGSSKLGGSEIVEYLKGLVYLLFTT

SEQ ID NO: 11305 - protein, 241 aa, Lippia dulcis
MEAKADENKYSIIIPTYNERLNIALIVYLIFKHLPNVNFEIIVVDDGSPDGTQDIVKQLQEVYGEDRILLRPRAKKLGLGTAYVHGLKHATGNFVVIMDADLSHHPKYLPSFIKKQMETGSSIVTGTRYVKGGGVHGWNLMRKLTSRGANVLAQTFLWPGVSDLTGSFRLYKKSVLEDIISSCVSKGYVFQMEMIVRASRKGYHIEEVPITFVDRVYGSSKLGGSEIVEYLKGLLYLLVTT

SEQ ID NO: 11306 - protein, 241 aa, Fagopyrum esculentum
MEKQEERNKYSIIVPTYNERLNIALIVYLIFKHLREYDFEVIIVDDGSPDGTQDVIKQLQLVYGEDRILLRARPKKLGLGTAYVHGLKHASGNFVVIMDADLSHHPKYLPGFIKKQIETGASIVTGTRYVKGGGVHGWTLMRKLTSRGANVLAQTLLWPGVSDLTGSFRLYRKSVLEDLISSCVSKGYVFQMEIIVRATRKGYHIEEVPITFVDRVYGTSKLGGSEIVQYLKGLVHLLITT

SEQ ID NO: 11307 - protein, 241 aa, Cichorium intybus
MAEQQNKNKYSIIVPTYNERLNIALIVYLVFKHIPDINFEIIIVDDGSPDGTQDIVKQLQHVYGEDRVLLRPRPRKLGLGTAYIHGLKHATGNFVIIMDADLSHHPKYLPQFIKKQIETGASIVTGTRYVTGGGVHGWTLMRKLTSRGANVLAHTLLWPGVSDLTGSFRLYKKTVLEDIISSCVSKGYVFQMEMIVRASRKGYHIEEVPITFVDRVYGSSKLGGSEIVEYLKGLVYLLFTT

SEQ ID NO: 11308 - protein, 242 aa, Cucumis sativus
MAEPEKERDKYSLIVPTYNERINIALLVYLIFKHLPDVDFEIIVVDDGSPDGTQEVVKQLQGLYGEDRILLRARPRKLGLGTAYCHGLKHATGNYVVIMDADLSHHPKYLPSFIQKQLQTGADIVTGTRYVKGGGVHGWNLMRKLTSRGANVLAQTLLWPGVSDLTGSFRLYKKSVLEDIITSVVSKGYVFQMEMIVRATRKGYHIEEVPITFVDRVFGTSKLGGSEIVEYLKGLLYLLVTT

SEQ ID NO: 11309 - protein, 241 aa, Taraxacum officinale
MSQQRNSNLYSIIVPTYNERLNIALIVYLVFKHIPDINFEIIIVDDGSPDGTQDIVKQLQKVYGDDRILLRPRPKKLGLGTAYIHGLKHASGNFVIIMDADLSHHPKYLPQFIKKQIETGASIVTGTRYVTGGGVHGWTLMRKLTSRGANVLAHTLLWPGVSDLTGSFRLYKKSVLEDIISSCVSKGYVFQMEMIVRASRKGYHIEEVPITFVDRVYGSSKLGGSEIVEYLKGLVYLLVTT

SEQ ID NO: 11310 - protein, 242 aa, Setaria italica
MEAAAGSKRAYSIIVPTYNERLNVALIVYLIFKHLPDVNFEIIIVDDGSPDGTQDIVKQLQQVYGEDRVLLRARPRKLGLGTAYLHGLKHASGEFVVIMDADLSHHPKYLPSFIRKQKETGADVVTGTRYVKNGGVHGWNLMRKLTSRGANVLAQTLLQPGASDLTGSFRLYKRDVLEDLISSCVSKGYVFQMEMIVRATRKGYHIEEVPITFVDRVFGISKLGGSEIVEYLKGLVYLLLTT

SEQ ID NO: 11311 - protein, 243 aa, Orobanche aegyptiaca
MNSMEAKEKNKYSVIVPTYNERLNIALIVYLISKHLQDVDFEIIIVDDGSPDGTQEIVQQLQRVYGQDRILLRPRPKKLGLGTAYMHGLKHANGNFVVIMDADLSHHPKYLPSFIKKQMETGASIITGTRYVHGGGVHGWNLMRKLTSRGANVLAQTLLWPGVSDLTGSFRLYKKSVLQDVISSCVSKGYVFQMEMIVRASRKGYHIEEVPITFVDRVYGSSKLGGSEIVEYLKGLLYLLLTT

SEQ ID NO: 11312 - protein, 239 aa, Nicotiana tabacum
  misc_feature (39)..(39): Xaa can be any naturally occurring amino acid
  misc_feature (47)..(47): Xaa can be any naturally occurring amino acid
MEQKKNKYSIIVPTYNERLNIALVIYLVFKHLPDVDFEXIVVDDGSXDGTQDIVKQLQKVYGEDHILLRPRARKLGLGTAYIHGLKHASGNFVVIMDADLSHHPKYLPRFIKKQMETGASIVTGTRYVTGGGVHGWNLMRKLTSRGANVLAQTLLWPGVSDLTGSFRLYQKSALEDIISSCVSKGYVFQMEMIVRASRKGYRIEEVPITFVDRVFGSSKLGGSEIVEYLKGLLYLLVTT

SEQ ID NO: 11313 - protein, 246 aa, Eutrema halophilum
MAEEKETKGGKKYKYSIIVPTYNERLNIALIVYLIFKHLRDVDFEIIVVDDGSPDGTQEIVKQLQQLYGEDRILLRARAKKLGLGTAYIHGLKHATGDFVVIMDADLSHHPKYLPSFIKKQLETNASIVTGTRYVKGGGVHGWNLMRKLTSRGANVLAQTLLWPGVSDLTGSFRLYKKSVLEDVISSCVSKGYVFQMEMIVRATRKGYHIEEVPITFVDRVFGTSKLGGSEIVEYLKGLVYLLLTT

SEQ ID NO: 11314 - protein, 245 aa, Artemisia annua
MAEQEQNDNKKNKYSIIIPTYNERLNIALIVFLVFKHIPDVDFEIIVVDDGSPDGTQDIVKQLQQVYGEDRILLRARPKKLGLGTAYIHGLKHASGNFVVIMDADLSHHPKYLPHFIKKQIKTGADIVTGTRYVRGGGVHGWTLMRKLTSRGANVLAHTLLWPGVSDLTGSFRLYKKSVLEDIISSCVSKGYVFQMEMIVRASRKGYRIEEVPITFVDRVYGSSKLGGSEIVEYLKGLVYLLITT

SEQ ID NO: 11315 - protein, 242 aa, Eutrema parvulum
MAEEKEKKYKYSIIVPTYNERLNIALIVYLIFKHLRDVDFEIIVVDDGSPDGTQEIVKQLQHLYGEDRILLRARAKKLGLGTAYIHGLKHATGDFVVIMDADLSHHPKYLPSFIKKQLETNASIVTGTRYVKGGGVHGWNLMRKLTSRGANVLAQTLLWPGVSDLTGSFRLYKKSVLEDVISSCVSKGYVFQMEMIVRATRKRYHIEEVPITFVDRVFGTSKLGGSEIVEYLKGLVYLLLTT

SEQ ID NO: 11316 - protein, 241 aa, Raphanus sativus
MAEEKEKNKYSIIIPTYNERLNIALIVYLIFKHLRDVDFEIIVVDDGSPDGTQEIVKQLQDLYGEDRILLRARAKKLGLGTAYIHGLKHATGDFVVIMDADLSHHPKYLPSFIKKQLETNASIVTGTRYVKGGGVHGWNLMRKLTSRGANVLAHTLLWPGVSDLTGSFRLYKKSVLEDVICSCVSKGYVFQMEMIVRATRKGYHIEEVPITFVDRVFGTSKLGGSEIVEYLKGLVYLLLTT

SEQ ID NO: 11317 - protein, 242 aa, Sorghum bicolor
MEAAAGRKRAYSIIVPTYNERLNVALIVYLIFKHLPDVNFEIIIVDDGSPDGTQDIVKQLQQVYGEDFVLLRARPRKLGLGTAYLHGLKHASGEFVIIMDADLSHHPKYLPSFIRKQKETGADIVTGTRYVKNGGVHGWNLMRKLTSRGANVLAQTLLQPGASDLTGSFRLYKRDVLEDLISSCVSKGYVFQMEMIVRATRKGYHIEEVPITFVDRVFGISKLGGSEIVEYLKGLVYLLLTT

SEQ ID NO: 11318 - protein, 242 aa, Saccharum officinarum
MEAAAGRKRAYSIIVPTYNERLNVALIVYLIFKHLPDVNFEIIIVDDGSPDGTQDIVKQLQQVYGEDFVLLRARPRKLGLGTAYLHGLKHASGEFVVIMDADLSHHPKYLPSFIRKQKETGADVVTGTRYVKNGGVHGWNLMRKLTSRGANVLAQTLLQPGASDLTGSFRLYKRDVLEDLISSCVSKGYVFQMEMIVRATRKGYHIEEVPITFVDRVFGISKLGGSEIVEYLKGLVYLLLTT

SEQ ID NO: 11319 - protein, 242 aa, Panicum virgatum
MEAAAAGKRAYSIIVPTYNERLNVALIVYLIFKHLPDVNFEIIIVDDGSPDGTQDIVKQLQQVYGEDRVLLRARPRKLGLGTAYLHGLKHASGEFVIIMDADLSHHPKYLPSFIRKQKETGADVVTGTRYVKNGGVHGWNLMRKLTSRGANVLAQTLLQPGASDLTGSFRLYKRDVLEDLISSCVSKGYVFQMEMIVRATRKGYHIEEVPITFVDRVFGISKLGGSEIVEYLKGLVYLLLTT

SEQ ID NO: 11320 - protein, 242 aa, Panicum virgatum
MEAAAGGKRAYSIIVPTYNERLNVALIVYLIFKHLPDVNFEIIIVDDGSPDGTQDIVKQLQEVYGEDRVLLRARPRKLGLGTAYLHGLKHASGEFVVIMDADLSHHPKYLPSFIRKQKETGADVVTGTRYVKNGGVHGWNLMRKLTSRGANVLAQTLLQPGASDLTGSFRLYKRDVLEDLISSCVSKGYVFQMEMIVRATRKGYHIEEVPITFVDRVFGISKLGGSEIVEYLKGLVYLLLTT

SEQ ID NO: 11321 - protein, 245 aa, Hordeum vulgare
MEKGGEAGGGRPEYSIIVPTYNERLNVALIVYLIFKHLPDAKFEIIIVDDGSPDGTQDIVKQLQQVYGEDRVLLRARPRKLGLGTAYMHGLKHASGEFVVIMDADLSHHPKYLPSFIRKQKETGADIVTGTRYVSNGGVHGWNLMRKLTSRGANVLAQTLLRPGASDLTGSFRLYKRSVLEDVISSCVSKGYVFQMEMIVRATRKGYHIEEVPITFVDRVFGISKLGGSEIVGYLKGLVYLLLTT

SEQ ID NO: 11322 - protein, 245 aa, Triticum aestivum
MEKGGEAGGGRPEYSIIVPTYNERLNVALIVYLIFKHLPDAKFEIIIVDDGSPDGTQDIVKQLQQVYGEDRVLLRARPRKLGLGTAYMHGLKHASGEFVVIMDADLSHHPKYLPSFIRKQKETGADIVTGTRYVSNGGVHGWNLMRKLTSRGANVLAQTLLQPGASDLTGSFRLYKRSVLEDVISSCVSKGYVFQMEMIVRATRKGYHIEEVPITFVDRVFGISKLGGSEIVGYLKGLVYLLLTT

SEQ ID NO: 11323 - protein, 249 aa, Solanum lycopersicum
TEKNFNFEINKMGEKNKYSIIIPTYNERLNIALIIYLVFKHLTDVDFEIIVVDDGSPDGTQDIVKQLQKVYGEDRILLRPRPRKLGLGTAYIHGLKHASGNFVVIMDADLSHHPKYLPRFIKKQMETGANIVTGTRYVSSGGVHGWNLMRKLTSRGANVLAQTLLWPGVSDLTGSFRLYQKSALEDIISSCVSKGYVFQMEMIVRASRKGYRIEEVPITFVDRVFGSSKLGGSEIVEYLKGLLYLLVTT

SEQ ID NO: 11324 - protein, 246 aa, Arabidopsis lyrata
MADQMEPKGEKKYKYSIIIPTYNERLNIAIIVYLIFKHLRDVDFEIIVVDDGSPDGTQEIVKQLQQLYGEDRILLRARAKKLGLGTAYIHGLKHATGDFVVIMDADLSHHPKYLPSFIKKQLETNASIVTGTRYVKGGGVHGWNLMRKLTSRGANVLAQTLLWPGVSDLTGSFRLYKKSVLEDVISSCVSKGYVFQMEMIVRATRKGYHIEEVPITFVDRVFGTSKLGGSEIVEYLKGLVYLLLTT

SEQ ID NO: 11325 - protein, 241 aa, Centaurea maculosa
  misc_feature (65)..(65): Xaa can be any naturally occurring amino acid
  misc_feature (72)..(72): Xaa can be any naturally occurring amino acid
  misc_feature (75)..(75): Xaa can be any naturally occurring amino acid
  misc_feature (150)..(150): Xaa can be any naturally occurring amino acid
  misc_feature (158)..(158): Xaa can be any naturally occurring amino acid
  misc_feature (206)..(206): Xaa can be any naturally occurring amino acid
  misc_feature (215)..(215): Xaa can be any naturally occurring amino acid
  misc_feature (219)..(219): Xaa can be any naturally occurring amino acid
  misc_feature (238)..(238): Xaa can be any naturally occurring amino acid
  misc_feature (240)..(240): Xaa can be any naturally occurring amino acid
MAEKQNKNKYSIIVPTYNERLNIALIVFLVFKHIPDVDFEIIIVDDGSPDGTQDIVKQLQQVYGXDRILLRXRPXKLGLGTAYIHGLKHASGNFVVIMDADLSHHPKYLPQFIKKQMETGASIVTGTRYVRGGGVHGWTLMRKLTSRGAXVLAHTLLXPGVSDLTGSFRLYKKSVLEDIISSCVSKGYVFQMEMIVRASRKGYHIXEVPITFVDXVYGXSKLGGSEIVEYLKGLVYLXVXT

SEQ ID NO: 11326 - protein, 241 aa, Lactuca sativa
MSQPRNTNLYSIIVPTYNERLNIALIVYLVFKHIPDINFEIIIVDDGSPDGTQDIVKQLQQVYGEDRILLKPRPKKLGLGTAYIHGLKHASGNFVIIMDADLSHHPKYLPQFIKKQMETGASIVTGTRYVTGGGVHGWTLMRKLTSRGANVLAHTLLWPGVSDLTGSFRLYKKSVLEDIIRSCVSKGYVFQMEMIVRASRKGYLIEEVPITFVDRVYGSSKLGGSEIVEYLKGLVYLLFTT

SEQ ID NO: 11327 - protein, 255 aa, Flaveria ramosissima
MSLGGPSMGSGGRTGRRAFEFGKTYVVKPKDKHLATIVWLHGLGDNGSSWAQLLETLPLPNIKWICPTSPSQPLTLFGGFPSNAWCDVSDLSEDAKQDVEGLDASAAHVLSLLSTEPADVKIGIGGFSMGSALALYCATCFAHGKLGNGDSFSTRLDAVVGLSGWLPCAKDVTNKVEGDEAAARASSLPILLCHGKGDDVVLFRYGDKSAEKLTSAGFKNLTFKVYDSLGHYTMPEEMDDVCAWLTSKLELKNEP

SEQ ID NO: 11328 - protein, 248 aa, Amorphophallus konjac
MEAPERTLEREKKGSKYSIIIPTYNERLNIALITYLIFKHLRNVDFEIIVVDDGSPDGTQDVVMQLQQVYGEDRILLRGRPRKLGLGTAYRHGLKHASGDFVVIMDADLSHHPKYLPTFIRKQIETGASIVTGTRYVRGGGVHGWNLMRKLTSRGANVLAQTLLWPGVSDLTGSFRLYRKSVLEDVINSCFSKGYVFQMEMIVRASRKGYHIEEVPITFVDRVYGSSKLGGSEIVEYLKGLVYLLFTT

SEQ ID NO: 11329 - protein, 246 aa, Brassica napus
MAEEKERKGEKKYKYSVIVPTYNERLNIALIVYLIFKHLRDVDFEIIVVDDGSPDGTQEIVKQLQDLYGEDRILLRARAKKLGLGTAYIHGLKHATGDFVVIMDADLSHHPKYLPSFIKKQLETNASIVTGTRYVKGGGVHGWNLMRKLTSRGANVLAQTLLWPGVFDLTGSFRLYKKSVLEDVISSCVSKGYVFQMEMIVRATRKGYHIEEVPITFVDRVFGTSKLGGSEIVEYLKGLVYLLLTT

SEQ ID NO: 11330 - protein, 246 aa, Arabidopsis thaliana
MADEMETKGEKKYKYSIIIPTYNERLNIAIIVYLIFKHLRDVDFEIIVVDDGSPDGTQEIVKQLQQLYGEDRILLRARAKKLGLGTAYIHGLKHATGDFVVIMDADLSHHPKYLPSFIKKQLETNASIVTGTRYVKGGGVHGWNLMRKLTSRGANVLAQTLLWPGVSDLTGSFRLYKKSALEDVISSCVSKGYVFQMEMIVRATRKGYHIEEVPITFVDRVFGTSKLGGSEIVEYLKGLVYLLLTT

SEQ ID NO: 11331 - protein, 247 aa, Unknown
  Sequence found in Organisms: Brassica napus, Brassica rapa
MADQNETKGEEGKHKYSIIVPTYNERLNIALIVYLIFKHLRDVDFEIIVVDDGSPDGTQEIVKQLQHLYGEDRILLRARAKKLGLGTAYIHGLKHATGDFVVIMDADLSHHPKYLPSFIKKQLETNASIVTGTRYVKGGGVHGWNLMRKLTSRGANVLAQTLLWPGVSDLTGSFRLYKKSVLEDVISSCVSKGYVFQMEMIVRATRKGYHIEEVPITFVDRVFGTSKLGGSEIVEYLKGLVYLLLTT

SEQ ID NO: 11332 - protein, 242 aa, Pennisetum glaucum
MEAAAGGKRTYSIIVPTYNERLNVALIVYLLFKHLRDVNFEIIIVDDGSPDGTQDIVKQLQQVYGEDRVLLRARPRKLGLGTAYLHGLKYASGEFVVIMDADLSHHPKYLPSFIRKQKETGADVVTGTRYVKNGGVHGWNLMRKLTSRGANVLAQTLLQPGASDLTGSFRLYKRDVLEDLISLCVSKGYVFQMEMIVRATRKGYHIEEVPITFVDRVFGISKLGGSEIVGYLKGLVHLLLTT

SEQ ID NO: 11333 - protein, 243 aa, Oryza sativa
MADDAGGGRREYSIIVPTYNERLNVALIVYLIFKHLPDVNFEIIVVDDGSPDGTQDIVKQLQQIYGENRVLLRARPRKLGLGTAYLHGLKHASGDFVVIMDADLSHHPKYLPSFIRKQKETGADVVTGTRYVQNGGVHGWNLMRKLTSRGANVLAQTLLQPGASDLTGSFRLYKRNVLEDLISSCVSKGYVFQMEMIVRATRKGYHIEEVPITFVDRVFGTSKLGGSEIVEYLKGLVYLLLTT

SEQ ID NO: 11334 - protein, 222 aa, Guizotia abyssinica
MAERHKYSIIVPTYNERLNIALIVFLVFKHIPDVDFEIIIVDDGSPDGTQDIVKQLQQVYGEDRILLRARPRKLGLGTAYIHGLKHASGNFVVIMDADLSHHPKYLPHFIKKQMETGADIVTGTRYVRGGGVHGWTLMRKLTSRGANVLAHTLLWPGVSDLTGSFRLYKKSVLEDIISSCVSKGYVFSMEMIVRASRKDIISKKFNKLCRQSLWKFQLGGSE

SEQ ID NO: 11335 - protein, 245 aa, Hordeum vulgare
MKNGAEAGGGRPEYSIIVPTYNERLIVALIVYLIFKHLPDSKFEIIIVDDGSPDDTQDVVKQLQQLYGEDRVLLRARPRKLGLGTAYMHGLKHASGEFVVIMDADLSHHPKYLPSFIRKQKETGADIVTGTRYVSNGSVHGWNLMRKLTSRGANVLAQTLLRPGASDLTGSFRLYKRSVLEDVISSCVSKGYVFQMEMIVRATRKGYHIEEVPITFVDRVFGISKLGGSEIVGYLKGLVYLLLTT

SEQ ID NO: 11336 - protein, 250 aa, Cucurbita pepo
MAEQEKERNKYSLIVPTYNERLNIALLVYLIFKHLPDVDFEVIVVDDGSPDGTQEVVKELQGVYGEDRILLRARPRKLGLGTAYCHGLKHATGNFVVIMDADLSHHPKYLPSFIRKQLQTGADIVTGTRYVKGGGVHGWNLMRKLTSRGANVLAQTLLWPGVSDLTGSFRLYKKSVLEDIISSVVSKGYVFQMEMIVRATRKGYHIEEVPITFVDRVFGISKLGGSEIVEYLKGLLYLWSPHDTQNSEIY

SEQ ID NO: 11337 - protein, 247 aa, Helianthus annuus
AGIQFESSIRVFDLQMANKYSIIVPTYNERLNIALIVFLVFKHIPDVDFEIIIVDDGSPDGTQDIVKQLQQVYGDDRILLRARPKKLGLGTAYIYGLKHASGNFVVIMDADLSHHPKYLPHFIKKQVETGADIVTGTRYVKGGGVHGWTLMRKLTSRGANVLAHTLLWPGVSDLTGSFRLYKKSVLEDIISSCVSKGYVFQMEMIVRASRKGYHIEEVPITFVDRVYGSSKLGGSEIVEYLKGLVYL

SEQ ID NO: 11338 - protein, 262 aa, Gossypium hirsutum
MSQRNKRTHRNKDLGQGIYTEEEKMEQKNKYSIIVPTYNERLNIALIVYLIFKHLRDVDFEIIVVDDGSPDGTQEVVKQLQKLYGEDRILLRPRPKKLGLGTAYIHGLKHASGNFVVIMDADLSHHPKYLPCFIKKQSETGASIVTGTRYVKGGGVHGWNLMRKLTSRGANVLAQTLLWPGVSDLTGSFRLYKKSVLEDVISSCVSKGYVFQMEMIVRASRKGYHIEEVPITFVDRVFGSSKLGGSEIIEYLKGLSYLLVTT

SEQ ID NO: 11339 - protein, 229 aa, Fraxinus spp
MENQQSEKSSAKYSIIVPTYNERLNIALIVYLIFKHLSDVDFEIIVVDDGSPDGTQDIVKQLQQVYGEDRILLRPRPKKLGLGTAYMHGLKHASGNFVVIMDADLSHHPKYLPSFIKKQMETGASIVTGTRYVKGGGVHGWNLMRKLTSRGANVLAQTFLWPGVSDLTGSFRLYRKSVLEDVISSCVSKGYVFQMEMIVRASRKGYHIEEVPITFVDRVCGSSKLGDQK

SEQ ID NO: 11340 - protein, 238 aa, Phalaenopsis aphrodite
MENSNKYSIIIPTYNERLNIALLVYLVFKHLREFNFEVIIVDDGSPDGTQDIVKQLQQLYGKERILLRARPEKLGLGTAYCHGLKHATGDFVIIMDADLSHHPKYLPSFIRKQTETGASIVTGTRYVRGGGVHGWNLMRKLTSRGANVLAQTFLWPGVSDLTGSFRLYKKSVLEDVLGSVVSKGYVFQMEIIVRASRKGYHIEEVPITFVDRVYGTSKLGGSEIVEYLKGLIYLLFTT

SEQ ID NO: 11341 - protein, 249 aa, Brachypodium distachyon
MGEKEMEHTVDRLNRPAYSIIVPTYNERLNVAIIVYLIFKHLPDTNFEIIIVDDGSPDGTQDIIKQLEQLYGEDRVLLRARPKKLGLGTAYLHGLKHATGDFVVIMDADLSHHPKYLPSFIRKQKETGADIVTGTRYVNNGGVHGWNLMRKLTSRGANVLAQTLLQPGASDLTGSFRLYKRSVLEDLISSCVSKGYVFQMEMIVRATRKNYHIEEVPITFVDRVFGISKLGGSEIVGYLKGLVYLLVTT

SEQ ID NO: 11342 - protein, 224 aa, Cynara scolymus
GTTAHIALIVFLVFKHIPDVDFEIIIVDDGSPDGTQDIVKQLQQVYGDDRILLRARPRKLGLGTAYIHGLKHASGNFVIIMDADLSHHPKYLPHFIKKQMETGASIVTGTRYVRGGGVHGWTLMRKLTSRGANVLAHTLLWPGVSDLTGSFRLYKKSVLEDIISSCVSKGYVFQMEMIVRASRKGYHIEEVPITFVDRVYGSSKLGGSEIVEYLKGLVYLLVTT

SEQ ID NO: 11343 - protein, 215 aa, Pisum sativum
EQKNKYSIIVPTYDERLNISLIIYLIFKHLPDFDFEVTVVDDGSPDGTQDIVKQLQQVYGEDRILLRARPRKMGLGTAYIHGMKHASGNFVVIMDADLSHHPKYLPGFLRKQLETGADIVTGTRYVKDGGVHGWNLMRKLTSRGANVLAQTLLWPGVSDLTGSFRLYKKSVLEDIISCCVSKGYVFQMEMIVRASRKGYHIEEVPITFVDRVYGS

SEQ ID NO: 11344 - protein, 240 aa, Sciadopitys verticillata
MGSEGDSSKYKYSILIPTYNERLNIALVTYLIFKHLSGINFEIIVIDDASPDGTQEIVQQLQKVYGEDRILLRPRPGKLGLGTAYMHGLKHASGDFVVIMDADLSHHPKYLPSFIRKQIETSADIVTGTRYVMGGGVHGWNLMRKLTSRGANVLAQTLLWPGVSDLTGSFRLYRKPALEDLIKSCVSKGYVFQMEMIVRASRKQYHIEEVPITFVDRVYGSSKLGGSEIVQYLKGLVYLF

SEQ ID NO: 11345 - protein, 80 aa, Sequoia sempervirens
MGKEGDPSSYKYSILIPTYNERLNIALVTYLIFKHLSGINFEIIVVDDASPDGTQEVVQQLQKVYGEDHILLRPRKGKLV

SEQ ID NO: 11346 - protein, 262 aa, Prunus persica
MEKNKYSIIVPTYNERLNIALLVYLIFKHLRDVDFEIIIVDDGSPDGTQQVVEQLQQLYGEDRILLRARAKKLGLGTAYIHGLKHASGNFVVIMDADLSHHPKYLPSFIKKQLETGASIVTGTRYVKGGGVHGWNLMRKLTSRGANVLAQTLLWPGVSDLTGSFRLYRKSVLEDIISSCVSKGYVFQMEMIVRASRKGYHIEEVPISFVDRVYGISKLGGSEIVEYLKGLAYLLVTTQLFHFTKLFMNCRKKLPELSMVGIL

SEQ ID NO: 11347 - protein, 245 aa, Pinus taeda
MERQRGSSSSSLKYSILIPTYNERLNIALVTYLIFKHLSDINFEIIVIDDASPDRTQEVVKQLQRVYGESRILLRPRQGKLGLGTAYVHGLKYASGDFVIIMDADLSHHPKYLPSFIRKQIETSADIVTGTRYVKGGGVHGWNLMRKLTSRGANVLAQTLLWPGVSDLTGSFRLYRKSVLEDLIKACVSKGYVFQMEMIVRASRKHYHIEEVPITFVDRVYGISKLGGSEIVQYLKGLVYLFLTT

SEQ ID NO: 11348 - protein, 245 aa, Picea glauca
MERPRGSSLSSPKYSILIPTYNERLNIALVTYLIFKHLSDINFEIIVIDDASPDGTQEVVKQLQHVYGESRILLRPRHGKLGLGTAYVHGLKYASGDFVIIMDADLSHHPKYLPSFIRKQIETSADIVTGTRYVKGGGVHGWNLMRKLTSRGANVLAQTLLWPGVSDLTGSFRLYRKTVLEDLIKACVSKGYVFQMEMIVRASRKHYHIEEVPITFVDRVYGISKLGGSEIVQYLKGLVYLFLTT

SEQ ID NO: 11349 - protein, 222 aa, Cirsium arvense
MAENQNKNKYSIIVPTYNERLNIALIVFLVFKHIPDVDFEIIIVDDGSPDGTQDIVKQLQQVYGDDRILLRARPRKLGLGTAYIHGLKHASGNFVVIMDADLSHHPKYLPHFIKKQMETGASIVTGTRYVRGGGVHGWTLMRKLTSRGANVLAHTLLWPGVSDLTGSFRLYKKSVLENIISSCVSKGYVFQMEMIVRASRKGYHIEEVPITFVDRVYGSSKL

SEQ ID NO: 11350 - protein, 218 aa, Rosa hybrid cultivar
KRATELNGEDEEQYSIIVPTYNERLNIALLVYLVVKHLRDVDFEIIIVDDGSPDGTQQVVQQLQELYGHDRILLRARAKKLGLGTAYIHGLKHASGNFVVIMDADLSHHPKYLPSFIKKQLETDATIVTGTRYVKGGGVHGWNLMRKLTSRGANVLAQTLLWPGVSDLTGSFRLYRKSALGRYHLVPVSARDMFFQMEMILRALYKRLPYRRGSIHFC

SEQ ID NO: 11351 - protein, 247 aa, Pseudotsuga menziesii
MEREAASSCASLKYKYSILIPTYNERLNISLVTYLIFKHLGDINFEIIIIDDASPDGTQEVVKQLQNVYGQSRILLRPRQGKLGLGTAYVHGLRFASGDFIIIMDADLSHHPKYLPSFLRKQIETSADIVTGTRYVKGGGVHGWNLMRKLTSRGANVLAQTLLWPGVSDLTGSFRLYRKSVLEDLIKACVSKGYVFQMEMIVRASRKHYHIEEVPITFVDRVYGISKLGGSEIVQYLKGLVYLFLTT

SEQ ID NO: 11352 - protein, 94 aa, Glycine max
MVLDSILTSPRLKSPSFRRQFKKDELGSWSTLFQRHRFLLSALVLLTLLCTVYLYFAVTLGASGTCSGLTGAQKASCHMELVKDSVAKGKLKIL

SEQ ID NO: 11353 - protein, 94 aa, Vigna unguiculata
MVLDSILSSPRLKSPSFRRQFTKDELGSWSTLVQRHRFLLSALVLLTLLCTVYLYFAVTLGASGTCSGLTGAQKASCHMELVKDSVAKGKLKIL

SEQ ID NO: 11354 - protein, 82 aa, Phaseolus coccineus
MVLDSILSSPRLKSPSFRRQFTKDELGSWSTLVQRHRFLLSALVLLTLLCTVYHLLCCHFRAQCHLFWVDRSSESFLPYGTC

SEQ ID NO: 11355 - protein, 94 aa, Glycine max
MVIDSILTSPRLNSPSFRRQFKKDELGSWSTLFQRHRFLLSTLVLITLLCTIYLYFAVTLGASGTCSGLTGAQKTSCHMELVKDSVAKGKLKIL

SEQ ID NO: 11356 - protein, 94 aa, Glycine max
MVIDSILTSPRLKSPSFRRQFKKDELGSWSTLFQRHHFLLSTLVLLTLLYTIYLYFAVTLGASGTCSGLSGAQKASCHMELVKDSVAKGKLKIL

SEQ ID NO: 11357 - protein, 94 aa, Glycyrrhiza uralensis
MVLDTILSSPRMRSPSFRRQFTKDELGSWSTLVQRHRFLLSALVLLTLLCTVYLYFAVTLGSSGSCSGMTGAQKASCHMELVKDSMAKGKLKIL

SEQ ID NO: 11358 - protein, 94 aa, Cajanus cajan
MVLDSILSSPRLRSPSLRRQFAKDELGSWSTLVQRHRFLLSALVLLAILCTVYLYFAVTLGSSGTCSGLTGAQKASCHMELVKDSMAKGKLKIL

SEQ ID NO: 11359 - protein, 93 aa, Trigonella foenum-graecum
MVLDSILSTTSPRLRSPSFRRPKDVLGSWSTLYQRHRFLLSALVLLTILCTVYLYFAITLGSSGTCSGLSGAQKASCHMELVKDSLNGKLKFL

SEQ ID NO: 11360 - protein, 93 aa, Medicago truncatula
MVLDSILSSSPRLKSPSFRRPKDGLGSWATLYQRHRFLLSALVLLTILCTVYLYFAITLGSNGSCSGLSGAQKASCHMELVKDSLSNGKLKFL

SEQ ID NO: 11361 - protein, 93 aa, Medicago truncatula
MVLDSILSSSPRLKSPSFRRPKDGLGSWTTLYQRHRFLLSALVLLTILCTVYLYFAITLGSNGSCSGLSGAQKASCHMELVKDSLSNGKLKFL

SEQ ID NO: 11362 - protein, 94 aa, Lotus japonicus
MVLDTILSSPRLRSPSFKRQFAKVELGNWSTLVQRHRFLLSTLVLLTILCFVYLYFAVTIGSNGSCSGLTGAQKASCHMELVKDSIAKGKLRML

SEQ ID NO: 11363 - protein, 291 aa, Glycine max
MGEKDDDFGLSLSLSLGRVNQQQQHPPPLNHMHQPQQLQPVPMNHNKTLFGDLSQLPDRSSEMIRGIDVNSAAECDGVSSPNSAVSSVSGGDGKQSERDDDNNAAAVAGERTSCSRGSDDDDGGGSDASRKKLRLTKEQSMVLEETFKEHSTLNPKRKQALAEELNLKPRQVEVWFQNRRARTKLKQTEVDCEYLKRCYENLTEENRRLHKEVQELRALKLSPQMYMHMNPPTTLTICPSCERTHSFASSSTATIHSAVAATSSNRKLFGTNIRLPVSFNTRPFEGPIPRP

SEQ ID NO: 11364 - protein, 420 aa, Glycine max
MAMATMEEIPQSPEAKLGMRVEDLWDVQEAQLSPTEKLNACFESIPVSAFPLDPSNTEIEIKSDATLADAVKILAGHNVFSAPVVDVEAPEDASWIDRYIGIVEFAGIVVWILHQSEPTSPRTPSTPSSARAIAAAANGAAFALELEALGLGSAATTAGNFFEDLTSSELYKNTKVRDISGTFRWAPFLALERSNSFLTMLLLLSKYKMKSVPVLDLGSGAIDNIITQSAVIHMLAECAGLQWFESWGTKKLSEVGLPLVTGNQIIKVYEDEPVLQAFKVMRKKRVGGVPVIERETKKAVGNISLRDVQFLLTAPEIYHDYRGITVKDFLTEVRSYLEKNKNASPMLNEYVTCKKDCTIKELIQLLDQEKIHRVYVVDDDGDLQGLITLRDIISRLVHEPRGYFGDFFDGVLPLPANSRV

SEQ ID NO: 11365 - protein, 420 aa, Cajanus cajan
MAMETMGESPRSPEAKLGMRVGDLWDIQESQLSPTEKLNACFESIPVSAFPLSPSNQEVEIKSDATLAEAVKILAQHNVFSAPVVDVDACEDASWMDRYIGIVEFAGIVVWILHQSEPTSPRSPSTPSSAKAIAAAANGANFAMELEALGLGSAATTSGNFFEDLTSSELYKNTKVGDISGTFRWAPFLALEKSNSFLTMLLLLSKYKMKSVPVLDLGSGRIDNIITQSAVIHMLAECAGLHWFESWGTKKLSEVGLPLVKGNHIIKVYEDEPVLQAFKIMRKKRVGGVPVIERDSQRTVGNISLRDVQFLLNAPEIYHDYRAITVKDFLTAVRSHLEENTKAHPMLTEFVTCKEDCTIKELIQLLDQEKIHRVYVVDDEGDLQGLITLRDIISRLVHEPRGYFGDFFDGVLPLPANTRV

SEQ ID NO: 11366 - protein, 420 aa, Medicago truncatula
MAMATMREMPRSPEAKLGMRVEDLWDVQEAQLSPNDKLNACFESIPVSAFPLPAKNQEIEIKSDATLAEAVKILARHNILSAPVVDVDAPEDATWIDRYIGIVEFAGIVVWILHQSEPPSPRSPSTPTSASAIAAAANGNTFARELEALGLGSAATTSGNFFEDLTSSELYKNTKVQDISGTFRWAPFLALERSNSFLTMLLLLSKYKMKSVPVVDLGSGTIDNIITQPAVIHMLAECAGLQWFESWGTKELSDVGLPLVTPKQIIKVYEDEPVLQAFKEMRKKRVGGVPVIKRGGTTAVGNISLRDVQFLLTAPEIYHDYRTITVKDFLTSVRSYLEKNKNAFPMSSEFITCKRDCTVKELIQLLDKEQIHRVYVVDDDGNLEGLITLRDIISRLVHEPHGYFGDFFDGVLPLPANSRV

SEQ ID NO: 11367 - protein, 419 aa, Trigonella foenum-graecum
MATMSREMPRSPEAKLGMRVEDLWDVQEPQLSPTEKLNACFESIPVSAFPLPPSNQEIEIKSDATLAEAVKILARHNILSAPVVDVDAPEDASWIDRYIGIVEFAGIVVWILYQSEPPSPRSPSTPTSASAIAAAANGNNFARELEALGLGSAATTSGNFFEDLTSSELYKNTKVQDISGTFRWAPFLALERSNSFLTMLLLLSKYKMKSVPVVDLGAGRIDNIITQAAVIHMLAECAGLQWFERWGAKELSDVGLPLVTPEQIIKIYEDEPVLQAFKEMRKKRVGGVPVIERGGTAAVGNISLRDVHFLLTAPEIYHDYRTITVKDFLTSVRSYLEKNKTAFPMSSEFITCKRDCTVKELIQLLDKEKIHRVYVVDDDGNLEGLITLRDIISRLVHEPHGYFGDFFDGVLPLPANSRV

SEQ ID NO: 11368 - protein, 415 aa, Phaseolus coccineus
MVTMEESPRSPEAKVGLRVEDLWDVQEPQLSPDEKLNACFESIPVSAFPLPPSNQEIEIKSDTTLAEAVKMLAQHNILSAPVVDVDAPEDASWIDRYIGIVEFAGIVVWILHQSEPTSPRSPSSGSAIAAAVDGITSAFEHEALGLESAMTTSGNFFEDLTSSQLYKNTKVRDISGSFRWAPFLALERSNSFLTMLLLLSKYKMKSVPVVDLGAGRIQNIITQSSVIHMLAECAGLQWFESWGTKKLSQVGLPIVAPNHIIKVYEDEPVLQAFKLMRKKRIGGLPVMERGGSRAIGNISLQDVQFLLTAPEIYHDYRSITAKDFLTAVRSYLEKHEGTFTMSSELITCNKDCTIKELIQLLDHEKIHRVYVVDNDGNLEGLITLRDIISRLVHEPRGYFGDFFDGVLPMPPNSRV

SEQ ID NO: 11369 - protein, 411 aa, Cajanus cajan
MVRMGESPKSPEAKLGLRVEDLWDVQEPQLSPDEKLNACFESIPVSAFPSPPSNQEVEIKSDATLAEAVKILAQHNILSAPVVDVDAPEDASWIDRYIGIVEFAGIVVWILHQSEPTSPRSPSSGAAVNGITSTQEHEALGLESAAKTSGNFFEDLTSSQLYKNTKVRDISGSFRWAPFLALERSNSFLTMLLLLSKYKMKSVPVVDLGAGRIDNIITQSAVIHMLAECAGLHWFESWGTKKLSDVGLPMVTPNHIIKVYEDEPVLQAFKLMRKKRIGGLPVMERGGSRAIGNISLQDVQFLLTAPEIYHDHRSITAKDFLIAVRSYLEKHEGVSPMSGDLITCNKDCTIKELIQLLDHEKIHRVYVADNDGNLEGLITLRDIISRLVHEPRGYFGDFFDGVLPMPPNSRV

SEQ ID NO: 11370 - protein, 411 aa, Glycine max
MVTMEESPRSPEAKLGLRVEDLWDIQEPQLSPDEKLNACFESIPVSAFPPPPSNQEVEIKSDATLAEAVKLLAEHSILSAPVVDVDAPEDASWIDRYIGIVEFAGIVVWILHQSEPTSPRSPSSGAANTAAVTGVAYEALGLESAATTSGNFFEDLTSSQLYKNTKVRDISGSFRWAPFLALERSNSFLTMLLLLSKYKMKSIPVVDLGAGRIDNIITQSSVIHMLAECAGLQWFESWGTKKLSEVGLPMVTPNHIIKVYEDEPVLQAFKLMRKKRIGGLPVMERGGSRAIGNISLQDVQFLLTAPEIYHDYRSITAKDFLTAVRSYLEKHEGAFPMSGDLITCNKNCTIKELIQLLDHEKNHRVYVADNEGNLEGLITLRDIISRLVHEPRGYFGDFFDGVLPMPPNSRV

SEQ ID NO: 11371 - protein, 118 aa, Glycine max
MGLKNNMVVLKVCLVLLFLVGGTTSASLRLSELGLLMKSDHHQHSNDDDSSKPCCDQCACTKSNPPQCRCSDMRLNSCHSACKSCICALSYPAQCFCVDITDFCYEPCKPSEDDKENY

SEQ ID NO: 11372 - protein, 98 aa, Triticum aestivum
MGLKNNMVVLKVCLVLLFLVGGTTSASLRLSELGLLMKSDHHQHSNDDESSKPCCDQCACTKSNPPQCRCSDMRLNSCHSACKSCICALSYPAQVFLC

SEQ ID NO: 11373 - protein, 81 aa, Brassica napus
MNPANMASTGVLRLTGSNAPSSAPGSAPGSAPGSAQGPTTPGASTTPGQAGGPGNAGSMSTSVNFGVNFGILVMLATIFIF

SEQ ID NO: 11374 - protein, 102 aa, Brassica napus
RGNVTNGRPGVHPMTPANVASTRVLRLTGSDAPSSAPGSAPGSAPGSAPGSVPGSAQGPTTPGASTTPGQAGGPENAGSMSTSVNFGVNFGILVMLATIFIF

SEQ ID NO: 11375 - protein, 262 aa, Raphanus sativus
  misc_feature (121)..(121): Xaa can be any naturally occurring amino acid
  misc_feature (156)..(156): Xaa can be any naturally occurring amino acid
  misc_feature (167)..(167): Xaa can be any naturally occurring amino acid
MASNSSLLLILAVACLISPAISQTCSTQNILSADRTPFANCLDLPSLDSYLHYTYNATNSSLSVAFVATPSRSDGWVAWAINPTATGMSGSQAFLAYSPRAGAPPVVNTYNISGYVLNEGXLAFDFWNLRAETMTGNRIVIRTTVSVPEGADSVNXVWQIGGNVTDXRPMVHPFNPANLASRAVLRFAGSDAPSSAPGSAPGSAPGSSPGSVPGSAQGPTTPGASTTPGQAAGPRNAGSMTTSVNFGVNFGILVMLATVLIF

SEQ ID NO: 11376 - protein, 254 aa, Raphanus sativus
  misc_feature (43)..(43): Xaa can be any naturally occurring amino acid
MASNSSLLLILAVACLFSPAISQNCSTQNILSADRTPFANCLXLPSLDSYLHYTYNATNSSLSVAFVATPSRSDGWVAWAINPTMTGMNGSQAFLAYSPGAGAAPVVRSYNISGYVLNEGRLAFEFWNLRAESMAGNMIVIRTSVKVPPGAESVNQVWQIGGNVTSGRPMVHPFNPANLASRGVLRFVGSDAPSSAPGSAPGSVPGSAQGPTTPGASTTPGQAAGPRSAGSMTSSVNFGVNFGILVMLATVFIF

SEQ ID NO: 11377 - protein, 197 aa, Raphanus sativus
IAYRAYDLEGKTVGTVGAGRIGKLLLQRLKPFGCNLLYHDRLQMGPEMEKETGAKYVESLGEMLPKCDVVVVNTPLTEKTRGMFNRELIGKMKKGVLIVNNARGAIMDRQAVVEAVESGHIGGYSGDVWDPQPAPKDHPWRYMPNQAMTPHISGTTIDAQLRYAAGTKDMLEKYFKGEDFPAQNYIVKDGELAPQYR

SEQ ID NO: 11378 - protein, 376 aa, Oryza sativa
MAMWRAAAGHLLGRALGSRAAHTSAGSKKIVGVFYKGGEYADKNPNFVGCVEGALGIREWLESKGHHYIVTDDKEGLNSELEKHIEDMHVLITTPFHPAYVSAERIKKAKNLELLLTAGIGSDHIDLPAAAAAGLTVAEVTGSNTVSVAEDELMRILILLRNFLPGYQQVVHGEWNVAGIAYRAYDLEGKTVGTVGAGRIGRLLLQRLKPFNCNLLYHDRLKIDPELEKEIGAKYEEDLDAMLPKCDVIVINTPLTEKTRGMFNKERIAKMKKGVIIVNNARGAIMDTQAVADACSSGQVAGYGGDVWFPQPAPKDHPWRYMPNHAMTPHISGTTIDAQLRYAAGVKDMLDRYFKGEDFPVQNYIVKEGQLASQYQ

SEQ ID NO: 11379 - protein, 377 aa, Hordeum vulgare
MAAMWRAAARQLVDRAVGSRAAHTSAGSKKIVGVFYQAGEYADKNPNFVGCVEGALGIRDWLESKGHHYIVTDDKEGLNSELEKHIEDMHVLITTPFHPAYVTAERIKKAKNLELLLTAGIGSDHIDLPAAAAAGLTVAEVTGSNTVSVAEDELMRILILLRNFLPGYQQVVKGEWNVAGIAHRAYDLEGKTVGTVGAGRIGRLLLQRLKPFNCNLLYHDRLQINPELEKEIGAKFEEDLDAMLPKCDVVVINTPLTEKTRGMFNKEKIAKMKKGVIIVNNARGAIMDTQAVADACSSGHIAGYGGDVWFPQPAPKDHPWRYMPNHAMTPHISGTTIDAQLRYAAGVKDMLDRYFKGEEFPVENYIVKEGELASQYK

SEQ ID NO: 11380 - protein, 376 aa, Avena sativa
MAMLRAVGRQLVDRAVGSRAAHTSAGSKKIVGVFYQAGEYADKNPNFVGCVEGALGIRDWLESKGHNYIVTDDKEGLNSELEKHIEDMHVLITTPFHPAYVTAERIKKAKNLELLLTAGIGSDHIDLPAAAAAGLTVAEVTGSNTVSVAEDELMRILILLRNFLPGYQQVVQGEWNVAGIAHRAYDLEGKTVGTVGAGRIGRLLLQRLKPFNCNLLYHDRLQINPELEKEIGAKFEEDLDAMLPKCDVIVINTPLTEKTRGMFNKEKIAKMKKGVIIVNNARGAIMDTQAVADACSTGHVAGYGGDVWFPQPAPKEHPWRYMPNHAMTPHISGTTIDAQLRYAAGVKDMLDRYFKGEDFPVENYIVKEGELASQYK

SEQ ID NO: 11381 - protein, 307 aa, Sorghum bicolor
MAMWRAAARQLVDRALGSSAAHTSAGSKKIVGVFYKAGEYADKNPNFVGCVEGALGIRGWLESQGHQYIVTDDKEGPNCELEKHIEDMHVLITTPFHPAYVTAERIKKAKNLELLLTAGIGSDHIDLPAAAAAGLTVAEVTGSNTVSVAEDELLRILILLRNFLPGYQQVVQGEWNVAGIAHRAYDLEGKTVGTVGAGRIGRLLLQRLKPFNCNLLYHDRLQIDPELEKEIGAKFEEDLDAMLPKCDVIVINTPLTEKTRGMFNKERIAKMKKGVIIVNNARGAIMDTQAVADACSSGHIAGTYCIN

SEQ ID NO: 11382 - protein, 368 aa, Panicum virgatum
RQLVDRVLGARAAHTSAVSKKIVGVFYKAGEYADKNPNFVGCVEGALGIRNWLESQGHRYIVTDDKEGPNSELEKHIEDMHVLITTPFHPAYVTAERIKKAKNLELLLTAGIGSDHIDLPAAAAAGLTVAEVTGSNTVSVAEDELLRILILVRNFLPGYQQVVQGEWNVAGIAHRAYDLEGKTVGTVGAGRIGRLLLQRLKPFNCNLLYHDRLQIDPELEKEIGAKFEEDLDAMLPKCDVVVINTPLTEKTRGMFNKERIAKMKKGVIVVNNARGAIMDTQAVADACSSGHIAGYGGDVWFPQPAPKDHPWRYMPNHAMTPHISGTTIDAQLRYAEGVRDMLDRYFKGEDFPAQNYIVKEGQLASQYQ

SEQ ID NO: 11383 - protein, 374 aa, Triticum aestivum
MCRAAARQLVDRAVGSRAAHTSAGSKKIVGVFYQAGEYADKNPNFVGCVEGALGIRDWLESKGHHYIVTDDKEGLNSELEKHIEDMHVLITTPFHPAYVTAERIKKAKNLELLLTAGIGSDHIDLPAAAAAGLTVAEVTGSNTVSVAEDELMRILILLRNFLPGYQQVVKGEWNVAGIAHRAYDLEGKTVGTVGAGRIGRLLLQRLKPFNCNLLYHDRLQINPELEKEIGAKFEEDLDAMLPKCDVIVINTPLTEKTRGMFNKEKIAKMKKGVIIVNNARGAIMDTQAVADACSSGHIAGYGGDVWFPQPAPKDHPWRYMPNHAMTPHISGTTIDAQLRYAAGVKDMLDRYFKGEDFPAENYIVKEGELASQYK

SEQ ID NO: 11384 - protein, 376 aa, Avena sativa
MAMLRAVGRQLVDRAVGSRAAHTSAGSKKIVGVFYQAGEYADKNPNFVGCVEGALGIRDWLESKGHNYIVTDDKEGLNSELEKHIEDMHVLITTPFHPAYVTAERIKKAKNLELLLTAGIGSDHIDLPAAAAAGLTVAEVTGSNTVSVAEDELMRILILLRNFLPGYQQVVQGEWNVAGIAHRAYDLEGKTVGTVGAGRIGRLLLQRLKPFNCNLLYHDRLQINPELEKEIGAKFEEDLDAMLPKCDVIVINTPLTEKTRGMFNKEKIAKMKKGVIIVNNARGAIMDTQAVADACSSGHVAGYGGDVWFPQPAPKEHPWRYMPNHAMTPHISGTTIDAQLRYAAGVKDMLDRYFKGEDFPAENYIVKEGELASQYK

SEQ ID NO: 11385 - protein, 183 aa, Beta vulgaris
  misc_feature (171)..(171): Xaa can be any naturally occurring amino acid
PTRPHCWNWFGPIDLKAAAAAGLTVAEVTGSNVVSVAEDELMRILILVRNFVPGYQQAINGEWNVAGIAYRAYDLEGKTIGTVGAGRIGKLLLQRLKPFNCNLLYHDRIQMDPELENQTGAKYEEDLVKMLGKCDVVVINTPLTEKTKGMFNKELIAKMKKGVLIVNNARXAIMDTQAVVDAC

SEQ ID NO: 11386 - protein, 297 aa, Ananas comosus
ELEKHISDMHVLITTPFHPAYVTAERIKQAKNLQLLLTAGIGSDHIDINAAADAGLTVAEVTGSNVVSVAEDELLRVLILMRNFLPGYHQVINGEWNVAAIAYRAYDLEGKTVGTVGAGRIGKLLLQRLKPFGCNLLYHDRIKIDPGLEKEIGAKFEEDLDAMLPKCDVVVINTPLTEKTRGLVNKERIAKMKKGVIIVNNARGAIMDTQAVVDACNSGHIAGYGGDVWNPQPAPKDHPWRYMPNHAMTPHISGTTIDGQLRYAAGVKDMLDRYFKGEDFPAQNYIVKEGKLASQYQ

SEQ ID NO: 11387 - protein, 326 aa, Cenchrus ciliaris
  misc_feature (308)..(308): Xaa can be any naturally occurring amino acid
  misc_feature (311)..(311): Xaa can be any naturally occurring amino acid
  misc_feature (320)..(321): Xaa can be any naturally occurring amino acid
MAMWRAAARQLVDRAIGSRAAHTSAGSKKIVGVFYKAGEYADKNPNFVGCVEGALGIRNWLESQGHHYIVTDDKEGPNCELEKHIEDMHVLITTPFHPAYVTAERIKKAKNLELLLTAGIGSDHIDLPAAAAAGLTVAEVTGSNTVSVAEDELLRILILVRNFLPGYQQVVQGEWNVAGIAHRAYDLEGKTVGTVGAGRIGRLLLQRLKPFNCNLLYHDRLKIDPELEKEIGAKFEEDLDAMLPKCDVIVINTPLTEKTRGMFNKERIAKMKKGVIIVNNARGAIMDTQAVADACSSGHIAGYGGDVXSPXRHRRIIPGXXCKKKP

SEQ ID NO: 11388 - protein, 109 aa, Brassica juncea
YNQVVNGEWNVAGIAYRAYDLEGKTVGTVGAGRIGKLLLQRLKPFGCNLLYHDRLQMGPEMEKETGAKYVESLDEMLPKCDVVVVNTPLTEKTRGMFNKEMIGKKKKKK

SEQ ID NO: 11389 - protein, 178 aa, Momordica charantia
MDVPAAAAAGLTVAEVTGSNTVSVAEDELLRILILLRNFLPGYQQVVQGEWNVAGIAHRAYDLEGKTVGTVGAGRIGRLLLQRLKPFNCNLLYHDRLKIDPELEKEIGAKFEEDLDAMLPKCDVIVINTPLTEKTRGMFNKERIAKVKKGVIIVNNARGAIMDTQAVADACSSGHIAG

SEQ ID NO: 11390 - protein, 376 aa, Panicum virgatum
MAMWRAAARQLVDRALGARAAHTSAGSKKIVGVFYKAGEYFDKNPNFVGCVEGALGIRSWLESQGHHYIVTDDKEGPNSELERHIEDMHVLITTPFHPAYVTAERIKKAKNLELLLTAGIGSDHIDLPAAAAAGLTVAEVTGSNTVSVAEDELLRILILVRNFLPGYQQVVQGEWNVAGIAHRAYDLEGKTVGTVGAGRIGRLLLQRLKPFNCNLLYHDRLKIDPELEKEIGAKFEEDLDAMLPKCDVIVINTPLTEKTRGMFNKERIAKMKKGVIVVNNARGAIMDTQAVADACSSGHIAGYGGDVWFPQPAPKDHPWRYMPNHAMTPHISGTTIDAQLRYAEGVRDMLDRYFKGEDFPVQNYIVKEGQLASQYQ

SEQ ID NO: 11391 - protein, 355 aa, Cannabis sativa
QASAGSKKIVGVFYKANDYAKLNPNFVGCAEGALGIRDWLESQGHQYIVTDDKEGPGCELEKHIHDLEVLITTPFHPAYVTAERIKRAKNLKLVLTAGIGSDHVDLNAAAAAGLTVAEVTGSNTVSVAEDELMRILILVRNFIPGHHQVINGDWNVAGIAYRAYDLEGKTVGTVGAGRIGKLLLQRLKPFNCNLLYHDRLKMEPELEKEIGAKFEEDLDAMLPKCDIVVINMPLTDKTRGMFDKEKIAKCKKGVLFVNNARGAIMDTQAVVDACSSGHIAGYSGDVWYPQPAPKDHPWRYMPNQAMTPHISGTTIDAQLRYADGVKDMLNRYFKGEDFPAQNYIVKEGELASQYR

SEQ ID NO: 11392 - protein, 223 aa, Phalaenopsis aphrodite
MRILILVRNFVPGYQQVINGDWNVAAISYRAYDLEGKTVGTVGAGRIGKLLLQRLKPFNCNLLYHDRLKIDPELEKEIGAKFEEDLDVMLPKCDVVVINTPLTEKTKGLFDKERISKLKKGVLIVNNARGAIMDTQAVVDACNSGHIAGYSGDVWNPQPAPKDHPWRYMPNQAMTPHVSGTTIDGQLRYAAGVKDMLDKYFKGEDFPQQNYIVKEGKLASQYL

SEQ ID NO: 11393 - protein, 328 aa, Phalaenopsis aphrodite
GTVERALGIREWLESQGHQYIVTDDKDGPNSELEKHIPDLHVLITTPFHPAYVTAERIKKAKNLQLLLTAGIGSDHIDLKAAADAKLTVAEVTGSNVVSVAEDELMRILILVRNFVPGYQQVINGDWNVAAISYRAYDLEGKTVGTVGAGRIGKLLLQRLKPFNCNLLYHDRLKIDPELEKEIGAKFEEDLDVMLPKCDVVVINTPLTEKTKGLFDKERISKLKKGVLIVNNARGAIMDTQAVVDACNSGHIAGYSGDVWNPQPAPKDHPWRYMPNQAMTPHVSGTTIDGQLRYAAGVKDMLDKYFKGEDFPQQNYIVKEGKLASQYL

SEQ ID NO: 11394 - protein, 240 aa, Zingiber officinale
  misc_feature (116)..(116): Xaa can be any naturally occurring amino acid
PFDKEGPNCELEKHFHDMHVLITTPFHPVYVTAEKIKTAKNLQLLLTAGVGSDHIDLKAAADAGINVVEISGSNAVLVAEDELMRILILVRNFLPGYHQVIDGDWNVAGIAHRAYXLEGKTVGIIGAGRIGKLLLQRLKPFNCNLLYHDRLMISPELEKETGAKFEEDLDEILPKCDVVVINTPLTEKTRGMFDKERIGKLKKGVLIVNNARAAIMDTQAVVDACSSGHIAGSYDNYPIR

SEQ ID NO: 11395 - protein, 135 aa, Zea mays
MLPKFDVIVINTPLTEKTRGMFNKERIAKMKKGVIVVNNARGAIMDARAVVDACSSGHIAGYGGDVWFPQPAPKDHPWRYMPNHAMTPHISRTTIDAQVRYADGVRDMLDRYFKGEDFPVQNYIVKEGQLASQYK

SEQ ID NO: 11396 - protein, 446 aa, Zea mays
METSRTSRDGARSTPAAGGWDRCPALAVVAPLVEARLRSPAIYVVQVRVLCEKANEILMEERNVQCSDVLSYNVAVCNVSARRLAGPDDLHDLASPEAVVSSNWIHDLYSRKLLVRYAFRKKEKEGLQTSRDVYCLECTAKMHRDCHKTELEKHIEDMHVLITTPFHPAYVTAERIKKAKNLELLLTAGIGSDHIDLPAAAAAGLTVAEVTGSNTVSVAEDELLRILILLRNFLPGYQQVVQGEWNVAGIAHKAYDLEGKTVGTVGAGRIGRLLLQRLKPFNCNLLYHDRLQIDPELEKEIGAKFEEDLDAMLPKCDVIVINTPLTEKTRGMFNKERIAKMKKGVIVVNNARGAIMDARAVADACSSGHIAGYGGDVWFPQPAPKDHPWRYMPNHAMTPHISGTTIDEQLRYADGVRDMLDRYFKGEDFPVQNYIVKEGQLASQYQ

SEQ ID NO: 11397 - protein, 77 aa, Petunia hybrida
MAMRRVASKAAHAFASSSSLVFTRGLQAPPGSNKIVGVFYKANEYAEMNPNFLGCAENALGIREWLESKGHQYISHS

SEQ ID NO: 11398 - protein, 357 aa, Triticum aestivum
AAHMSAGGKKIVGVFYQAGEYADKNPDFVGCVEGALGIRDWLESNGHHYIVTDDKEELNSELEKHIEDMHVLITTPFHPAYVTAERIKKAKNLELVLTAGIGSDHIDLLAAAAAGLTVAEVTGSNTVSVAEDQLMRILILLRNFLPGYQQVVKGEWNVAGIAHRAYDLEGKTVGTVGAGRIGRLLLQRLKPFNCNMLYHDRIRINPELEKEIGAKFEEDLDVMLPKCDVIVINTPLTEKTRGMFNKEKIAKMKKGVIIVNNARGAIMDTQAVADACSNGYIAGYGGDVWFPQPAPKDHPWRYMPNHAMTPHTSGTTIDAQLRYASGVKDMLDRYFKGEDFPAENYIVKEGELASQYK

SEQ ID NO: 11399 - protein, 124 aa, Brassica juncea
LTPKHRDVQTLCSMLTYKLGYPEILKGFPLTPYITRYLPPFDEFEVDHCDLPTGKSTIFPAIPGPSVYLVIEGTGKLQTGSSQLLVNRGDVLFVPAHNEIQVTGESDVIKLYRAGVSSRFFQTL

SEQ ID NO: 11400 - protein, 135 aa, Brassica rapa
MAASDNVVRAGLTPKHRDVQTLCSMLTYKLGYPEILKGFPLTPYITRYLPPFDEFEVDHCDLPTGKSTIFPAIPGPSVYLVIEGTGKLQTGSSQLLVNRGDVLFVPAHNEIQVTGESDVIKLYRAGVSSRFFQTL

SEQ ID NO: 11401 - protein, 446 aa, Brassica napus
MDRITMFLLAATLAAVRCGCDANYSRNDFPRDFAFGSGTSAYQWEGAYNEDGKKPSVWDTYVHSRNLDNGDITCDGYHKYKEDVQLMVETGLDAFRFSISWSRLIPNGRGPVNPKGLQFYKNFIHELVSHGIEPHVTLYHYDHPQSLEDEYGGWLNRKIIKDFTAYADVCFREFGNHVKLWTTINEANIFTIGGYDGGGTPPGRCSTCSSGNSSTEPYIVAHNLLLAHASASRLYKQKYKDTQGGSVGFSIFAIGFRPSTNSNDDELAIQRFKDFFFAWMLGPLTYGDYPDGMKRKIGTRLPVFSEEESELVKGSSDFVGVIHYLAASVSDSQSKPFLPGDSKFFADMGVLLTYVGNFTAFEYEIAPWAMEGVLEYIKQSYGNPPVYILENGKPMKQDLQLQQEDTPRIEFVHAYMGAVLKAVRNGSDTRGYFVWSFMDLYELLSG

SEQ ID NO: 11402 - protein, 316 aa, Brassica napus
MENGDKACDGYHKYKEDVQLMVETGLEAFRFSISWSRLIPNGRGSVNPKGLQFYKNFILELVSHGIEPHVTLYHYDHPQQLEDEYGGWLNRRIIKDFTAYADVCFREFGKHVKFWTTINEANIFTVGGYDGGNTPPGRCSTCLSGNSSTEPYIVAHNLLLAHASASRLYKQKYKNTQGGSVGFSIFAIGFRPSTNSKDDEMAIQRFKDFFFGWMLGPLTYGDYPEGMKRIVGTRLPVFTKEESEQVKGSSDFVGVIHYLAASISNAQSQPSLPGDSAFFTDIGASLTYSGNFSAFEYEVAPWAMEVVLEYIKQSYG

SEQ ID NO: 11403 - protein, 509 aa, Eutrema parvulum
GAKVEDRKMSVLNIFLTVALLSLCCCDAFTRNDFPHDFAFGSGTSAYQWEGAFEEDGKNPSVWDTYVHSRNMDNGDIACDGYHKYKEDVQLMVETGLDAFRFSISWPRLIPNGRGPVNPKGLQFYKNFINELVTNGIEPHVTLYHYDHPQCLEDEYGGWLNRRIIKDFTAYADVCFREFGNQVKLWTTINEANIFAIGGYDGGGTPPGHCSTCSLGNSSTEPYIVGHNLLLAHASVSRLYNQKYKDMQGGSVGFSLFAIGFTPSTSSKNDAIAVQRFKDFYFGWMLGPLTFGDYPDGMKRIVGSRLPVFTEKESELVKGSSDFVGVIHYLAASVANIESEPSLPVDSSFTADTGVSLTYYGNFTTFDYEVAPWAMEVVLEYIKQSYGNPPVYILENGKPMKQDLQLQEKDTPRIEFVHAYMGAVLKAVRNGSDTRGYFVWSLMDLYELLSGYEFSFGLYSVNFSDPQRKRSPKLSAHWYSAFLKSNTTFLGSQVITQLQSNTSSSAASS

SEQ ID NO: 11404 - protein, 398 aa, Brassica oleracea
  misc_feature (178)..(178): Xaa can be any naturally occurring amino acid
EIWRRRRRAIVPALHMKYVAAMISLFGEASDRLCQKLDSAASTGEEVEMESLFSRLTLDIIGKAVFNYDFDSLTNDTGVIEAVYTVLREAEDRSVSPIPVWDIPIWKDISPRQRKVATSLKLINDTLNDLIATCKRMVEEEELQFHEEYMNERDPSILHFLLASGDDVSSKQLRDDLXTMLIAGHETSAAVLTWTFYLLTTNPKVVAKLQEEVDSVIGDRFPTLEDVKKLKYTTRVMNESLRLYPQPPVLIRRSLENDKLGPYPIKRGEDIFISVWNLHRSPLHWDDAEEFNPERWPLDGPNPNETNQNFSYLPFGGGPRKCIGDMFASFENVVAIAMLIRRFNFQTAPGAPPVKMTTGATIHTTEGLKLTVTKRTPPLSVPILPVEAPRDEVSSALS

SEQ ID NO: 11405 - protein, 286 aa, Raphanus sativus
QRKVATSLKLINDTLNDLIATCKRMVEEEELQFHEEYMNERDPSILHFLLASGDDVSSKQLRDDLMTMLIAGHETSAAVLTWTFYLLTTNPNVVAKLQEEVDSVIGDRFPTLEDMKKLKYTTRVMNESLRLYPQPRVLIRRSLENDTLGPYPIKRNEDIFISVWNLHRSPLHWDDAEEFNPERWPLDGPNPNETNQNFSYLPFGGGPRKCIGDMFASFENVVAIAMLIRRFNFQTAPGAPPVKMTTGATIHTTEGLKLTVTKRTPPLSVPILPMEAPRDEVSSALS

SEQ ID NO: 11406 - protein, 262 aa, Brassica napus
MVEEEELQFHEEYMNERDPSILHFLLASGDDVSSKQLRDDLMTMLIAGHETSAAVLTWTFYLLTTNPKVVAKLQEEVDSVIGDRFPTLEDMKKLKYTTRVMNESLRLYPQPPVLIRRSLENDKLGPYPIKRGEDIFISVWNLHRSPLHWDDAEEFNPERWPLDGPNPNETNQNFSYLPFGGGPRKCIGDMFASFENVVAIAMLIRRFNFQTAPGAPPVKMTTGATIHTTEGLKLTVTKRTPPLSVPILPMEAPRDEVSSALS

SEQ ID NO: 11407 - protein, 614 aa, Theobroma cacao
MAATPAYPPLQLHLTKPKSAAFPLKHYGTSKFGIVKCGSSSNGREPDSVDNGVKSIELLREEKRRAELSARIASGEFTVQKSGFPSLLRNGLSKLGVPIEVLEFLFKWVDDGGDYPKIPEAKGTIKAIRSEAFFLPLYELYLTYGGMFRLTIGPKSFLIVSDPSIAKHILRDNSKSYSKGVLAEILEFVMGKGLIPADAEIWRVRRRAIVPALHQKYVAAMISLFGQATERLCQKLDDAATDGEDVEMESLFSHLTLDIIGKAVFNYDFDSLTNDTGIVEAVYTVLREAEDRSVSPIPTWEIPIWKDISPQQRKVAEALKLINDVLDDLIATCKRMVEEEELQFHEEYMNEQDPSILHFLLASGDDVSSKQLRDDLMTLLIAGHETSAAVLTWTFYLLSKEPTVVSKLQDEVDSVLGDRFPTIGDMKKLKYTTRVINESLRLYPQPPVLIRRSLEDDVLGKYPIKRGEDIFISVWNLHHSPSLWEDPEKFNPERWPLDGPNPNETNQNFCYLPFGGGPRKCVGDMFASFENVVAVAMLVRRFNFQMALGAPPVEMTTGATIHTTGGLKMTVTRRIQPPIIPELDMQGLKMEASARNSEEETQLGEKGEVSQAHS

SEQ ID NO: 11408 - protein, 425 aa, Eucalyptus grandis
MGKGLIPADGEVWRVRRRTIVPALHQKYVAAMINLFGQTTQRLCDKLDIAASEREDVEMESLFSRLTLDVIGKAVFNYDFDSLTNDTGIIEAVYTVLREAEDRSVSPIPFWEIPIWKDISPKQKKVNEALKLVNDALNDLIAICKRMVDEEDLQFHEEYMNEEDPSILHFLLASGDDVSSKQLRDDLMTMLIAGHETSAAVLTWTFYLLSKEPTVMSKLQNEVDSVLGDRIPTIEDMKKLKYTTRVINESMRLYPQPPVLIRRSLENDFLGKYPIKRGEDIFISVWNLHRSPHHWIDADKFNPERWPLDGPNPNETNQNFSYLPFGGGPRKCVGDMFASFEMVVAVAMLVRRFNFQMALGAPAVKMTTGATIHTTEGLKMTVTRRLQPPIVPTLEMPLLQVENSASSSQGDSVLSQKGEVTSAHS

SEQ ID NO: 11409 - protein, 608 aa, Cannabis sativa
MASNIFLLHSPPSFHTTRLRPTSSYPIGLRSSNNNHKGLSVITCSSSNGREPDSVKKKKREELSARIAAGDFTVNQSGFPSQVKNGLSKLGVPKETLEFFFSWVDSNGDYPKVPEAKGSVRAVQSEAFFIPLYELFITYGGIFRLTFGPKSFLIVSDPSIAKHILRDNSKAYSKGILAEILEFVMGKGLIPADGEIWRVRRRTIVPALHLKYVAAMINLFGQATDKLCQKLDAAANDGEDVEMESLFSRLTLDIIGKALFNYDFDSLTNDTGIVEAVYTVLREAEDRSISPIPFWEIPIWKDISPRQRKVSTALKLINDTLDNLIAICKRMVDEEELQFHEEYMNEKDPSILHFLLASGDDVSSKQLRDDLMTMLIAGHETSAAVLTWTFYLLSKEPRVVAKLQEEVDSVLGDRYPTIDDMKKLKYSTRVINESLRLYPQPPVLIRRSIENDTLGQYPIKRGEDIFISVWNLHRSPNHWENADKFIPERWPLDGPNPNETNQGFSYLPFGGGPRKCVGDMFATYETVVALAMLVRRFNFQMAVGAPEVKMTTGATIHTTDGLNMTVTRRVKPPIVPTLETQAMNLDSSSSSSAAAGVIGNDPLVGQTG

SEQ ID NO: 11410 - protein, 619 aa, Malus domestica
MAAAATIPLLQFVPAKTFQAKHHSNRLRPTKQRGSFGLSMITCASSNGREPDSADGGVKSVERLLEKKRRAELSARISSGEFTVEKSGFPSQLKSGLSKVGVPTGLLDFLFSWADAPENYPKIPEAKGAISAIQSEAFFVPLFELYLTYGGIYRLTFGPKSFLIVSDPAIAKHILRENSKAYSKGILAEILEFVMGTGLIPADGEIWRVRRRAIVPALHQKYVTAMINLFGEATDRLCRKLDAAASDGEDVEMESLFSRLTLDIIGKALFNYDFDSLTNDTGIVEAVYTVLREAEDRSVAPIPLWEIPIWKDISPRQRKVATALKLINTTLDDLIAICKRMVDEEELQFHEEYMNEQDPSILHFLLASGDDVSSKQLRDDLMTMLIAGHETSAAVLTWTFYLLSTEPGVMAKLQEEADSVLGDRFPTIDDMKKLKYATRVINESLRLYPQPPVLIRRSLEDDKLGDYPIKRNEDIFICIWNLHRSPKQWDDADKFNPERWPLDGPNPNETNQNFRYLPFGGGPRKCLGDMFATFETVVALSMLVRRFNFQMALGAPEVKMTTGATIHTTEGLKMTVSRRIKPPIVPTLEMPAFEVDKPVGVPKGDSLVSQKGEVSSAHP

SEQ ID NO: 11411 - protein, 632 aa, Ricinus communis
MAANFALLQVPSSISAKHHCLQTKFQVRRVKPINLSSFPPTQNGVLGKRKFAVISCASSKGREPESEEDPVKSVERILEEKRRAELSAKIASGEFTVQQSGFPSILRNGLSKLGVPNETLEFLFKWVDAGEGYPKIPEAKGAISAIRSEAFFIPLYELYLTYGGIFRLTFGPKSFLIVSDPSIAKHILRDNSKAYSKGILAEILDFVMGKGLIPADGEIWRVRRRAIVPAFHQKYVAAMIGLFGQATDRLCKKLDAAASDGEDVEMESLFSRLTLDIIGKAVFNYEFDSLANDTGIVEAVYTVLREAEDRSVAPIPVWEIPIWKDISPRQRKVSAALKLINDILDDLIALCKRMVDEEELQFHDEYMNEQDPSILHFLLASGDDVSSKQLRDDLMTMLIAGHETSAAVLTWTFYLLSKEPSVLSKLQNEVDTILGDRFPTIEDVKKLKYTTRVINESLRLYPQPPVLIRRSLQDDMLGKYPIKRGEDIFISVWNLHRSPHLWDDAEKFNPERWPLDGPNPNETNQNFCYLPFGGGPRKCVGDMFASFETVVATAMLVRRFNFQLALGAPPVKMTTGATIHTTEGLTMTVTRRIQPPIMPMLDMPAMKGDAPGSVPSGESQLGQKGEVSPAHS

SEQ ID NO: 11412 - protein, 636 aa, Medicago truncatula
MASHLTLLHAPPPLSLQTKTFHSKYITIKPLKPTTTFSSSCSLFPCSLKTSHRGSCSSFIACSSSNGRSPNDSVDDGVVKSADQLLEEKRRAELSAKIASGEFTVKQESGLPSILKKSLSNLGVSNEILEFLFGLYPKIPEAKGSISAIRSEAFFIPLYELYITYGGIFRLNFGPKSFLIVSDPAIAKHILKDNSKAYSKGILAEILDFVMGKGLIPADGEIWRVRRRTIVPALHLKFVAAMIGLFGQATDRLCQKLDTAASDGEDVEMESLFSRLTLDVIGKAVFNYDFDSLSNDTGIIEAVYTVLREAEDRSISPIPVWDLPIWKDISPRQRKVTAALKLVNDTLNNLIAICKRMVDEEELQFHEEYMNEQDPSILHFLLASGDDVTSKQLRDDLMTMLIAGHETSAAVLTWTFYLLSKEPSVMSKLQEEVDSVLGDRFPTIEDMKKLKYTTRVINESLRLYPQPPVLIRRSIEDDVLGEYPIKRGEDIFISVWNLHRSPTLWNDADKFEPERWPLDGPNPNETNQGFKYLPFGGGPRKCIGDMFASYEVVVALAMLVRRFNFQMAVGAPPVVMTTGATIHTTQGLNMTVTRRIKPPIVPSLQMSTLEVDPSVSISDKTEEIGQKDQVYQAQKS

SEQ ID NO: 11413 - protein, 363 aa, Arachis hypogaea
MESLFSRLTLDIIGKAVFNYDFDSLTNDTGIVEAVYTVLREAEDRSVSPIPVWEIPIWKDISPRQRKVSAALKLVNDTLNELVAICKRMVDEEELQFHEEYMNEQDPSILHFLLASGDDVSSKQLRDDLMTMLIAGHETSAAVLTWTFHLLSKEPSVVSKLQEEVDSVLGDRFPTIEDMKKLRYTTRVINESMRLYPQPPVLIRRSLENDMLGEYPIKRGEDIFISVWNLHRSPNLWDDADKFQPERWPVDGPNPNETNQNFKYLPFGGGPRKCVGDLFASYETIVALAMLVRRFNFQMAVGAPPVEMTTGATIHTTQGLKMTVTRRIKPPIVPSLQMSTKEIDPSMSKDDTSQKGEVYQAQS

SEQ ID NO: 11414 - protein, 633 aa, Glycine max
MASHVALLRAPPPLSISTQRFHAKQISINGLKFTSSSSCFPCSITTQRGSCSSVITCSSSNDRDPNSVDDEDVKQVERILEDKRRAALSAKIASGEFTVRQKSVLLSIMEGLAKVGAPNEVLEFLSGWVEGGGLQPKIPEAKGSIKAIRSVAFFIPLYELYLTYGGIFRLTFGPKSFLIVSDPSIAKHILRDNSKSYSKGILAEILDFVMGKGLIPADGEIWRVRRRAIVPALHQKYVAAMIGLFGQASDRLCQKLDAAASDGEDVEMESLFSRLTLDIIGKAVFNYDFDSLSNDTGIVEAVYTVLREAEDRSVAPIPVWEIPIWKDISPRLRKVNAALKFINDTLDDLIAICKKMVDEEELQFHEEYMNEKDPSILHFLLASGDDVSSKQLRDDLMTMLIAGHETSAAVLTWTFYLLSKEPRVVSKLQEEVDSVLGDRYPTIEDMKKLKYTTRVINESLRLYPQPPVLIRRSLEDDVLGEYPIKRGEDIFISVWNLHRSPKLWDDADKFKPERWALDGPSPNETNQNFKYLPFGGGPRKCVGDLFASYETVVALAMLMRRFNFQIAVGAPPVEMTTGATIHTTQGLKMTVTHRIKPPIVPSLQMSTMEVDPSISLSDQDEVSQKGEIYQAQS

SEQ ID NO: 11415 - protein, 438 aa, Malus domestica
YSKGILAEILEFVMGTGLIPADGEIWRRRRRAIVPALHQKYVTAMINLFGQATDRLCQKLDAAASDGEDVEMESLFSRLTLDIIGKALFNYDFDSLTNDTGIVEAVYTVLRESEDRSVSPIPVWEIPIWKDISPRQRKVSTALKLINTALDDLIAICKRMVDEEELQFHEEYMNEQDPSILHFLLASGDDVSSKQLRDDLMTMLIAGHETSAAVLTWTFYLLSKEPRVMAKLQEEVDSILGDRFPTIEDMKKLKYATRVINESLRLYPQPPVLIRRSLEDDKLGDFPIKRNEDIFICIWNLHRSPKQWDDADKFYPERWPLDGPNPNETNQNFRYLPFGGGPRKCVGDMFATFETVVALSMLVRRFNFQMALGAPEVKMTTGATIHTTEGLKMTVTRRIKPPIVPTLEMPSFEVDTPVGVPKGDSVAGQKGEVSSAHP

SEQ ID NO: 11416 - protein, 610 aa, Prunus persica
MAATIPLLQFVPTKTFQAKIHSNRLRPTKQRGTFGLSMVTCSSSNGREPDSVDGVKSVERLLEEKRRAELSARIASGEFTVEKTGYPSQLKNGLSKLGVPREILDFLFSWADAHDGSPKIPEAKGAIGAIQSEAFFIPLYELYLTYGGIYRLTFGPKSFLIVSDPSIAKHILRDNSKAYSKGILAEILEFVMGKGLIPADGEIWRVRRRAIVPALHQKYVAAMINLFGEATERLCQKLDAAASDGEDVEMESLFSRLTLDIIGKALFNYDFDSLTNDTGIVEAVYTVLREAEDRSVAPIPVWEIPIWKDISPRQRKVATALKLINTTLDDLIAICKRMVDEEELQFHEEYMNEQDPSILHFLLASGDDVSSKQLRDDLMTMLIAGHETSAAVLTWTFYLLSTEPSVMSKLQEEADSVLGDRCPTIEDVKKLKYATRVINESLRLYPQPPVLIRRSLEDDRLGDYSIKRNEDIFICIWNLHRSPKQWDDADKFKPERWPLDGPNPNETNQNFRYLPFGGGPRKCVGDMFATYETVVALAMLVRRFNFQMALGAPEVKMTTGATIHTTEGLKMTVTRRIKPPIVPTLEMPTFEVDTSVGASKGDSLVGKKGL

SEQ ID NO: 11417 - protein, 428 aa, Phaseolus coccineus
MGKGLIPADGEIWRVRRRAIVPALHQKYVAAMIGLFGQAADRLCQKLDAAASDGEDAEMESLFSRLTLDIIGKAVFNYDFDSLSNDTGIIEAVYTVLREAEDRSVSPIPVWDIPIWKDVSPRLRKVNQALKLINDTLDDLIAICKRIVDEEELQFYEEYMNEKDPSILHFLLASGDDVSSKQLRDDLMTMLIAGHETSAAVLTWTFYLLSKEPRVMSKLQEEVDSVLGDRYPTIEDMKKLKYTTRVINESLRLYPQPPVLIRRSIENDILGEYPIKRGEDIFISVWNLHRSPKLWDNADKFEPERWPLDGPNPNETNQSFKYLPFGGGPRKCVGDLFATYETVVALAMLVRRFNFQMAVGAPPVEMTTGATIHTTQGLKMTVTHRIKPPIVPSLQMSTLEVDPSISLSDQEEISLKGQVYQAQAQGQP

SEQ ID NO: 11418 - protein, 500 aa, Cajanus cajan
MYPKIPEAKGSISAIRSVAFFIPLYELYLTYGGIFRLTFGPKSFLIVSDPSIAKHILRDNSKAYSKGILAEILDFVMGKGLIPADGEIWRVRRRAIVPAFHQKYVAAMIGLFGQAADRLCKKLDAAASDGEDVEMESLFSRLTLDVIGKAVFNYDFDSLSNDTGIVEAVYTVLREAEDRSVAPIPVWEIPIWKDISPRLRKVNAALKLINDTLDDLIAICKRMVDEEELQFHEEYMNEKDPSILHFLLASGDDVSSKQLRDDLMTMLIAGHETSAAVLTWTFYLLSKEPRVMSKLQEEVDSVLGDRFPTIEDMRKLKYTTRVINESLRLYPQPPVLIRRSIDEDVLGEYPIKRGEDIFISVWNLHRSPELWDNADKFEPERWALDGPNPNETNQNFKYLPFGGGPRKCVGDLFASYETVVALAMLVRRFNFQMAVGAPPVEMTTGATIHTTQGLKMTVTHRIKPPIVPSLQMSTLEVDPSISLSDNDEISQKGEIYQAQS

SEQ ID NO: 11419 - protein, 591 aa, Fragaria vesca
QTKLQTNRLLRPTKQRGNIGFSVITCSSNGRGPDSVKSVEQLAEEKKRAELSARIASGEFTVNKTGYPSELKNGLLKLGVPREVLDFLFNWGDMQQPRLKIPEAKGSVSAVQNEAFFIPLYELYLTYGGIFRLTFGPKSFLIVSDPAIAKHILRDNAKAYSKGILAEILEFVMGKGLIPADGEIWRVRRRAIVPALHLKYVTAMINLFGQATERLCQKLDTAASDGEDVEMESLFSRLTLDIIGKALFNYDFDSLTNDTGIVEAVYTVLREAEDRSVAPIPFWEIPIWKDISPRQKKVAKALKLINVTLDDLIAICKRMVDEEELQFHEEYMNEQDPSILHFLLASGDDVSSKQLRDDLMTMLIAGHETSAAVLTWTFYLLSKEPRVMSKLQEEVDSVLGDRIPTIEDMKKLKYATRVINESLRLYPQPPVLIRRSLEDDRLGEYPIKRNEDIFISVWNLHRSPTLWDDADKFKPERWPLDGPNPNETNQNFSYLPFGGGPRKCVGDMFATYENVVALTMLVRRFNFQIALCAPEVKMTTGATIHTTEGLNMTVTRRIKPPIVPTLEVPAFDADTSVGVSKGDSLVGQKGV

SEQ ID NO: 11420 - protein, 630 aa, Citrullus lanatus
MAANFAMLKPCSAFSTSSSVQRKFRAHKSLCTAPCSSFYPQCQGGAYGLCAVKCASSNGKGPDSLDNGVKKVERLLEEKRRAELSARIASGEFTVEKTGFPSILRSGLSKLGVPSEILDLLFGFVNAQEEYPKIPEAKGSISAIRSEAFFIPLYELYLTYGGIFRLTFGPKSFLIVSDPSIAKHILKDNPKNYSKGILAEILDFVMGKGLIPADGEIWRVRRRAIVPSLHMKYVGAMINLFGEAADRLCKKLDAAASDGVDVEMESLFSRLTLDIIGKAVFNYDFDSLTNDAGIVEAVYTVLREAEDRSVAPIPVWEIPIWKDISPRQKKVSKALKLINGTLDQLIAICKRMVDEEELQFHEEYMNEQDPSILHFLLASGDDVSSKQLRDDLMTMLIAGHETSAAVLTWTFYLLSKEPRVMAKLQKEVDSVLGDRFPTIEDMKNLKYATRIINESLRLYPQPPVLIRRSLDNDMLGKYPIKKGEDIFISVWNLHRSPELWDDADKFNPERWPLDGPNPNETNQNFRYLPFGGGPRKCVGDIFASYETVVALAMLVRRFDFQIALGAPPVKMTTGATIHTTDGLQMTVTRRMKPPIIPTLEVPEMVVDSSVSFLKDETQIVQEGEVSSAHS

SEQ ID NO: 11421 - protein, 519 aa, Cucumis melo
KMGVPSEILDLLFGLVNAQDEYPKIPEAKGSINAIRSEAFFVPLYELYLTYGGIFRLTFGPKSFLIVSDPSIAKHILKDNPKNYSKGILAEILDFVMGKGLIPADGEIWRVRRRAIVPSLHMKYVGAMINLFGEAADRLCKKLDAAASDGVYLEMESLFSRLTLDIIGKAVFNYDFDSLTNDAGIVEAVYTVLREAEDRSIAPIPVWDIPIWKDISPRQRKVSKALKLINDTLDQLIAICKRLVDEEELQFHEEYMNDQDPSILHFLLASGDDVSSKQLRDDLMTMLIAGHETSAAVLTWTFYLLSKEPRVMAKLQEEVDSVLGDRFPTIEDMKNLKYATRIINESLRLYPQPPVLIRRSVDNDMLGKYPIKKGEDIFISVWNLHRSPEHWDDADKFNPERWPLDGPNPNETNQNFRYLPFGGGPRKCVGDIFASYETVVALAMLVRRFDFQMALGAPPVKMTTGATIHTTDGLQMTVTRRMKPPIISTLEVPDMVVDSSVSFLKNETQVQGEVSSAHS

SEQ ID NO: 11422 - protein, 612 aa, Mimulus guttatus
MAANLSFLQFSSPILQSKDCRRKLAPAVNFKSNGVSCSYSSNGRGGPKDDAVKEVEKLLEEKRRAELSARIASGEFTVEKPSFGSQLKDGLSKLGLPEEVLGFVFNFSGGPNNLKIPEARGSISAITNEPFFIPLYELFLTYGGIFRLTFGPKSFLIVSDPSIAKHILKDNPKSYSKGILAEILDFVMGKGLIPADGEIWRVRRRAIVPALHQKFVAAMFGLFGEATDRLCKKLDAAAADGEDVEMESLFSRLTLDIIGKAVFNYDFDSLSVDTGIVEAVYTVLREAEDRSVAPIPFWEIPIWKDISPKLKKVNTALKLINDTLDDLIAICKKIVDDEELQFHEEYMNEQDPSILHFLLASGDDVSSKQLRDDLMTLLIAGHETSAALLTWTFYLLSQDPSVMAKLQNEVDLVLGDRIPTVEDMKKLKYTTRVINESLRLYPQPPVLIRRSLEEDVLGKYPIKRGEDIFISVWNLHRSPNHWEDADKFNPERWPLDGPNPNETNQNFSYLPFGGGPRKCIGDMFASFENIVAVTMLVRRFDFQLALGAPPVKMTTGATIHTTEGLKMTVTPRRRAPIIPNLDIPTVNVDSSLNFPEATTVPIQKDQVSPVVS

SEQ ID NO: 11423 - protein, 604 aa, Solanum phureja
MASSLPLFQFPAQHYSKSRLTFSPKFNGSASNFTIRCSSNGKQPESVDEGVKKVEKLLEEKRRAELSARIASGEFTVEQSGFSSLLKNGLSKLGVPKEFLEFFSRRTGDYPRIPEAKGSISAIRDEPFFMPLYELYLTYGGIFRLIFGPKSFLIVSDPSIAKHILKDNSKAYSKGILAEILDFVMGKGLIPADGEIWRVRRRAIVPALHQKYVAAMIGLFGKATDRLCKKLDVAATDGEDVEMESLFSRLTLDIIGKAVFNYDFDSLTVDTGIVEAVYTVLREAEDRSIAPIPVWDLPIWKDISPKLKKVNAALKLINDTLDNLIAICKRMVDEEELQFHEEYMNEKDPSILHFLLASGDEVSSKQLRDDLMTMLIAGHETSAAVLTWTFYLLSKEPSVMAKLQDEVDSVLGDRFPTIEDLKKLRYTTRVINESLRLYPQPPVLIRRSIEEDVVGGYPIKRGEDIFISVWNLHRCPNHWEEADRFNPERWPLDGPNPNETNQNFSYLPFGGGPRKCVGDMFATFENLVAVAMLVRRFDFQMALGAPPVKMTTGATIHTTEGLKMTVTRRTRPPIVPKLEMASLEVDVNSVSSERAKAEASTVRP

SEQ ID NO: 11424 - protein, 641 aa, Glycine max
MASHVALLRVPPPLSISTQRFHAKQICINGLKLTNTSSSSSSSSCFPCSITTQRGSCSSVITCSSSNGRDPNSVDEEDVKQVERILEEKRRAALSAKIASGEFTVKQKSGLLSIMEGLAKVGVPNEVLEFLFGWFEGGGEHPKIPEAKGSIKAVRSVAFFIPLYELYLTYGGIFRLTFGPKSFLIVSDPSIAKHILRENSKAYSKGILAEILDFVMGKGLIPADGEIWRVRRRAIVPALHQKYVAAMIGLFGQAADRLCQKLDAAASDGEDVEMESLFSRLTLDIIGKAVFNYDFDSLSNDTGIVEAVYTVLREAEDRSVAPIPVWEIPIWKDVSPRLRKVNAALKLINDTLDDLIAICKRMVDEEELQFHEEYMNEQDPSILHFLLASGDDVSSKQLRDDLMTMLIAGHETSAAVLTWTFYLLSKEPRVMSKLQEEVDSVLGDQYPTIEDMKKLKYTTRVINESLRLYPQPPVLIRRSLEDDVLGEYPIKRNEDIFISVWNLHRSPKLWDDADKFEPERWALDGPSPNETNQNFKYLPFGGGPRKCVGDLFASYETVVALAMLVRRFNFQIAVGAPPVEMTTGATIHTTQGLKMTVTHRIKPPIVPSLQMSTLEVDPSISLSDQDEVSQKGEVYQAQAQS

SEQ ID NO: 11425 - protein, 601 aa, Valeriana officinalis
MAANCPLLQFDKFHSNRLRVSTPSAFAAKLNRTCRVSLIRCSSDGDKIADKALEEKRRAQLSARIASGEFTVEKTGFGSELINGLTKLGVPSAIVEPLSKLINGGEDYLKIPEAKGAISAIRSEAFFIPLYELYLTYGGIFRLTFGPKSFLIVSDPSIAKHILKDNSKAYSKGILAEILEFVMGTGLIPADGEVWRVRRRAIVPSLHQKYVTAMIGLFGQATDRLCKKLDAAAYDGEDVEMESLFSRLTLDIIGKAVFNYDFDSLTNDTGIVEAVYTVLREAEDRSVSPIPFWEIPIWKDISPKLKKVNSSLKLINETLDNLIAICKRMVDEEELQFHEEYMNERDPSILHFLLASGDDVSSKQLRDDLMTMLIAGHETTAAVLTWTFYLLTTEPSVMAKLQNEVDSVLGDRIPTIEDMKKLRYTTRVINESLRLYPQPPVLIRRSIVDDTLGDYPIKRGEDIFISVWNLHRSPKHWEDAEKFNPERWPLDGPNPNETNQNYSYLPFGGGPRKCVGDMFASFEAVVAVAMLIRRFNFQMALSAPPVEMTTGATIHTTQGLNMTVTRRINPPIVSTFPVLQVNSPEDANPVRKGEVSSAARS

SEQ ID NO: 11426 - protein, 549 aa, Cirsium arvense
EMLREEKRRAELSARIASGEFTVEKPGFGSLLVSGLTKLGLPTEFVESLSQWINPGEGYPKVPEAKGAISAIRSEAFFIPLYELFLTYGGIFRLTFGPKSFLIVSDPIIAKRILKDNAKAYSKGILAEILEFVMGTGLIPADGEIWRVRRRVIVPALHQKYVAAMIGLFAQATDRLCKKLDDAAYNGEDVEMESLFSRLTLDIIGKAVFNYDFDSLTTDNGIVEAVYTVLREAEDRSVSPIPTWEIPIWKDISPRQKKVNESLKLINTTLDDLIAICKRMVDEEEVEFNEEYMNETDPSILHFLLASGDNVSSKQLRDDLMTMLIAGHETTAAVLTWTFYLLSKEPSVVSKLQNEVDAVLGDRFPTIEDMKKLKYTTRVINESLRLYPQPPVLIRRSLEDDVLDKYPIKRGEDFFISVWNLHRSPKHWVDADKFNPERWPLDGPNPNETNQNFSYLPFGGGPRKCVGDMFASFEAIVAVSMLVRRFNFQMALGAPPVKMTTGATIHTTEGLNMTVTRRMKPPIVPTLETQNLENLDSSTTVPEADPIVT

SEQ ID NO: 11427 - protein, 641 aa, Sorghum bicolor
MSLHHCRAATMPAAASAIGLSTAGAVPFRLPASGCAHQGHLRLLPPPPPAAAACRRRLLLRCAASSGGGGSGGSDPALEEQRRRQAELAARIASGEFTVQGPGWIAPLVGKLSKLGPPGELAAALLTRVAGAGAARGGPEIPQALGSINAVVGQAFFVPLYDLFLTYGGIFRLNFGPKSFLIVSDPAIAKHILRDNSKAYSKGILAEILEFVMGKGLIPADGEIWRVRRRAIVPALHQKYVTAMIGLFGEASHRLCEKLDKAAADGEDVEMESLFSRLTLDVIGKAVFNYDFDSLSYDNGIVEAVYVTLREAEMRSTSPIPTWEIPIWKDISPRQKKVNEALKLINSTLDELIAICKRMVEQEDLQFHEEYMNEQDPSILHFLLASGDDVSSKQLRDDLMTMLIAGHETSAAVLTWTFYLLSKYPKVMAKLQDEVDSVLGDGLPTIEDVKKLKYTTRVINESLRLYPQPPVLIRRSLEDDMLGGYPIGRGEDIFISVWNLHHCPKHWDDAEVFNPERWPLDGPNPNEINQNFSYLPFGGGPRKCVGDMFATFENVVATAMLVKRFDFQLAPGAPPVDMTTGATIHTTEGLKMTVTRRTRAPVIPNLEMKIISDSQEPALSTPSMVVSAASVASGEDQGGVS

SEQ ID NO: 11428 - protein, 647 aa, Sorghum bicolor
MSLHHCRAATMPAAASAIGLSTAGAVPFRLPASGCAHQGHLRLLPPPPPAAAACRRRLLLRCAASSGGGGGGGAGGSGGSDPALEEQRRRQAELAARIASGEFTVQGPGWIAPLVGKLSKLGPPGELAAALLTRVAGAGAARGGPEIPQALGSINAVVGQAFFVPLYDLFLTYGGIFRLNFGPKSFLIVSDPAIAKHILRDNSKAYSKGILAEILEFVMGKGLIPADGEIWRVRRRAIVPALHQKYVTAMIGLFGEASHRLCEKLDKAAADGEDVEMESLFSRLTLDVIGKAVFNYDFDSLSYDNGIVEAVYVTLREAEMRSTSPIPTWEIPIWKDISPRQKKVNEALKLINSTLDELIAICKRMVEQEDLQFHEEYMNEQDPSILHFLLASGDDVSSKQLRDDLMTMLIAGHETSAAVLTWTFYLLSKYPKVMAKLQDEVDSVLGDGLPTIEDVKKLKYTTRVINESLRLYPQPPVLIRRSLEDDMLGGYPIGRGEDIFISVWNLHHCPKHWDDAEVFNPERWPLDGPNPNEINQNFSYLPFGGGPRKCVGDMFATFENVVATAMLVKRFDFQLAPGAPPVDMTTGATIHTTEGLKMTVTRRTRAPVIPNLEMKIISDSQEPALSTPSMVVSAASVASGEDQGGVS

SEQ ID NO: 11429 - protein, 334 aa, Raphanus sativus
SSLLNCVPKEDFGGGHPDPNLTYAKELVARMGLGKSDTGVEPPEFGAAADGDADRNMILGKRFFVTPSDSVAIIAANAIGAIPYFSSGLKGVARSMPTSAALDVVAKSLNLKFFEVPTGWKFFGNLMDAGMCSVCGEESFGTGSDHIREKDGIWAVLAWLSILAHKNKGNLEGDNKLVTVEDIVRKHWATYGRHYYTRYDYENVDAGKAKELMEHLVKLQSSIPEVNKMVKGIRSDVANVSSADEFEYKDPVDGSISKHQGIRYLFEDGSRLVFRLSGTGSEGATIRLYIEQYEKDASKTGRESHEALSPLVDIALKLSKMEEFTGRSAPTVIT

SEQ ID NO: 11430 - protein, 444 aa, Brassica oleracea
ENGGPAPESITDKIYENTKTIKEYPIAEDLPIVDISAIGVSSFEGPGGKFDVEVFDSADDYVKLMKSIFDFESIRKLLSSPKFSFCYDAMHGVAGAYAHRIFVEELGSQESSLLNCVPKEDFGGGHPDPNLTYAKELVARMGLGKSDTGVEPPEFGAAADGDADRNMILGKRFFVTPSDSVAIIAANAVGAIPYFSTGLKGVARSMPTSAALDVVAKSLNLKFFEVPTGWKFFGNLMDAGMCSVCGEESFGTGSDHIREKDGIWAVLAWLSILAHKNKETLDGDAELVTVEDIVRKHWATYGRHYYTRYDYENVDAGKAKELMEHLVKLQSSIPEVNKMVKGIRSDVANVSSADEFEYKDPVDGSISKHQGIRYLFEDGSRLVFRLSGTGSEGATIRLYIEQYEKDASKTGRESHEALSPLVDIALKLSKMEEFTGRSAPTVIT

SEQ ID NO: 11431 - protein, 327 aa, Brassica rapa
  misc_feature (299)..(299): Xaa can be any naturally occurring amino acid
PKEDFGGGHPDPNLTYAKELVARMGLGKSDTGVEPPEFGAAADGDADRNMILGKRFFVTPSDSVAIIAANAVGAIPYFSTGLKGVARSMPTSAALDVVAKSLNLKFFEVPTGWKFFGNLMDAGMCSVCGEESFGTGSDHIREKDGIWAVLAWLSILAHKNKETLDGDTKLVTVEDIVRQHWATYGRHYYTRYDYENVDAGKAKELMEHLVKLQSSIPEVNKIVKGIRSDVANVSSADEFEYKDPVDGSISKHQGIRYLFEDGSRLVFRLSGTGSEGATIRLYIEQYEKDASKIGRESQXALSPLVDIALKLSKMEEFTGRSAPTVIT

SEQ ID NO: 11432 - protein, 270 aa, Cleome gynandra
VTPSDSVAIIAANAVAAIPYFSSGLKGVARSMPTSAALDVVATSLNLKFFEVPTGWKFFGNLMDAGMCSVCGEESFGTGSDHIREKDGIWAVLAWLSILAHKNSGNLGGDSNLVSVEDIVRQHWATYGRHYYTRYDYENVDAAAAKELMAYLVKLQSSLPEVNKMVKGIHSDVANVSHADEFEYTDPVDGSISKHQGIRYLFEDGSRLVFRLSGTGSEGATIRLYIEQYEKDAAKTGRDSQEALGPLVDVALKLSKMEEFTGRSAPTVIT

SEQ ID NO: 11433 - protein, 74 aa, Ambrosia trifida
MASFTVNRVETSPIEGQKPGTSGLRKKVRCSPNHITCIILFNRHLTPFLQRTLKDLHSLFRVMDATTQKMQSRL

SEQ ID NO: 11434 - protein, 443 aa, Ambrosia trifida
MGNGGPAPEGITDKIFENTKTIKEYFIAEGLPDVDISAIGISNFSGPDGQFDVDVFDSSSDYVKLMKSIFDFQSIKKLITSPQFSFCYDALHGVAGAYANRIFVEELGAKESSLLNCVPKEDFGGGHPDPNLTYAKELVARMGLGKNPDSNPPEFGAAADGDADRNMILGKRFFVTPSDSVAIIAANAVQSIPYFSSGLKGVARSMPTSAALDVVAKSLNLKFFEVPTGWKFFGNLMDAGLCSVCGEESFGTGSDHIREKDGIWAVLAWLSILAHKNKDNLNGGNLVTVEDIVKQHWATFGRHYYTRYDYENVDAGAAKELMAHLVKLQSSISDVNEIIKGIRPDVANVASADEFEYKDPVDGSISKHQGIRYLFEDGSRLVFRLSGTGSEGATIRLYIEQYEKDSSKTGRDSQEALAPLVEVALKLSKMQEFTGRSAPTVIT

SEQ ID NO: 11435 - protein, 505 aa, Tragopogon dubius
MAAANGARRVWVGQNGLLSTPAVSAVVRERVGADGSKATGAFILTASHNPGGPNEDFGIKYNMENGGPAPEGVTDKIFENTKTIKEYFIAEGLPDVDISKTGVSNFSGPDGQFDVDVFDSASDYVKLMKSIFDFQSIQKLIACPQFSFCYDALHGVAGAYANRIFVQELGAKESSLLNCVPKEDFGGGHPDPNLTYAKELVARMGLGKTPDSNPPEFGAAADGDADRNMVLGKRFFVTPSDSVAIIAANAVQSIPYFSSGLKGVARSMPTSAALDVVAKSLSLKFFEVPTGWKFFGNLMDAGMCSVCGEESFGTGSDHIREKDGIWAVLAWMSILAYKNKDNLSSGKLVTVEDIVKQHWATYGRHYYTRYDYENVDAGAAKELMAHLVKLQSNLSEVNKTIKGIRSDVANVASADEFEYKDPVDGSVSKNQGIRYLFEDGSRLVFRLSGTGSEGATIRLYIEQYEKDSSKTGRDSQEALSPLVEVALKLSKMQEYTGRSAPTVIT

SEQ ID NO: 11436 - protein, 306 aa, Euphorbia esula
  misc_feature (145)..(145): Xaa can be any naturally occurring amino acid
VARMGLGKSNSEVEPPEFGAAADGDADRNMVLGKRFFVTPSDSVAIIAANAVGSIPYFSSGLKGVARSMPTSAALDVVAKHLNLKFFEVPTGWKFFGNLMDAGMCSVCGEESFGTGSDHIREKDGIWAVLAWLSILAHKNKENLXGGKLVTVEDIVRDHWTKYGRHYYTRYDYENVDANAAKELMANLVKLQSSLGEVNEIVKGIRSDVSKVVHGDEFEYKDPVDGSISKHQGIRYLFEDGSRLVFRLSGTGSEGATIRLYIEQYEKDPSKTGRESSEALAPLVDVALKFSKMQEFTGRSAPTVIT

SEQ ID NO: 11437 - protein, 216 aa, Arnica chamissonis
MANFTVNRVESSPIEGQKPGTSGLRKKVKVFTQPHYLHNFVQSTFNALSAEKVKGSTLVVSGDGRYYSKDAIQIIIKMAASNGVRRVWVGQNGLLSTPAVSAVVRERVGADGSKANGAFILTASHNPGGPNEDFGIKYNMGNGGPAPEGITDKIFENTTTIKEYFIAEGLPDVDISAIGISNFSGPDGQFDVDVFDSASDYVKLMKSIFDFQSIQS

SEQ ID NO: 11438 - protein, 311 aa, Cirsium arvense
TYAKELVSRMGLGKNPNSDPPEFGAAADGDADRNMILGKRFFVTPSDSVAIIAANAVQTIPYFSSGLKGVARSMPTSAALDVVAKHLNLKFFEVPTGWKFFGNLMDAGLCSVCGEESFGTGSDHIREKDGIWAVLAWLSILAFKNKDNLNGGKLVTVEDIVKQHWATFGRHYYTRYDYENVDAGAAKELMAYLVKMQSSLDEVNKIVKGVRSDVSNVSSADEFEYKDPVDGSISKHQGIRYLFEDGSRLVFRLSGTGSEGATIRLYIEQYEKDSSKIGRDSQEALAPLVEVALKLSKMQEFTGRSAPTVIT

SEQ ID NO: 11439 - protein, 188 aa, Flaveria ramosissima
MDAGLCSVCGEESFGTGSDHIREKDGIWAVLAWLSILAHKNKDNLNGGKLVTVEDIVTLHWATFGRHYYTRYDYENVDAGAAKELMAHLVKLQSSISDVNKIIKETRSDVANVASADEFEYKDPVDGSISKNQGIRYLFEDGSRLVFRLSGTGSEGATIRLYIEQYEKDATKLEEILKKHLLLWWRLH

SEQ ID NO: 11440 - protein, 342 aa, Tripterygium wilfordii
QNGLLSTPAVSAVIRERVGVDGSRATGGFILTASHNPGGPHEDFGIKYNMENGGPAPEGITDQIYENTKTIKEYLIAEDLPDVDISTIGVTSFSGPEGQFNVEVFDSASDYVKLMKSIFDFESIRKLLTSPKFSFCYDAMHGVGGAYAKPIFVEELGAQESSLLNCTPKEDFGGGHPDPNLTYAKELVVRMGLGKSDSQGEPPEFGAASDGDADRNMILGKRFFVTPSDSVAIIAANAVEAIPYFSAGLKGVARSMPTSAALDVVAKHLNLKFFEVPTGWKFFGNLMDAGLCSVCGEESFGTGSDHIREKDGIWAVLAWLSILAHKNRENLMEIINLSVLKI

SEQ ID NO: 11441 - protein, 365 aa, Momordica charantia
SSPKFSFCYDALHGVAGAYAKRIFVEELGAQESSLLNCVPKEDFGGGHPDPNLTYAKELVDRMGLGKSKSGQEPPEFGAAADGDADRNMVLGKRFFVTPSDSVAIIAANAVEAIPYFSAGLKGVARSMPTSAAVDVVAKNLNLKFFEVPTGWKFFGNLMDAGMCSVCGEESFGTGSDHIREKDGIWAVLAWLSILAYKNKGNLDGGKLVTVEDIVRKHWATYGRHYYTRYDYENVDVGAAKELMANLVKLQSSLAEVNGIVKGIRSDVSKVVHGDEFEYKDPVDGSISKHQGIRYLFEDGSRLVFRLSGTGSEGATIRLYIEQYEKDPSKTGRDSQEALAPLVEVALKLSKMQEFTGRSAPTVIT

SEQ ID NO: 11442 - protein, 378 aa, Flaveria ramosissima
MKSIFDFQSIQKLIASPQFSFCYDALHGVAGAYAKRIFVEELGAKESSLLNCVPKEDFGGGHPDPNLTYAKELVARMGLGKNPDSNPPEFGAAADGDADRNMILGKRFFVTPSDSVAIIAANAVQAIPYFSSGLKGVARSMPTSAALDVVAKSLNLKFFEVPTGWKFFGNLMDAGLCSVCGEESFGTGSDHIREKDGIWAVLAWLSILAHKNKDNLNGGNLVTVEDIVKQHWATFGRHYYTRYDYENVDAGAAKEVMTHLVKLQSSISDVNNTIKGMRSDVADVVSADEFEYKDPVDGSVSKNQGIRYLFEDGSRLVFRLSGTGSEGATIRLYIEQYEKDSSKTGRDSQEALAPLVDVALKLSKMKEYTGRSAPTVIT

SEQ ID NO: 11443 - protein, 64 aa, Flaveria ramosissima
FGAAADGDADRNMILGKRFFVTPSDSVAIIAANAVQSIPYFSSGLKGVARSMPTSAALDVVAKV

SEQ ID NO: 11444 - protein, 488 aa, Flaveria ramosissima
NIHLLYQQFVRERVGADGSKANGAFILTASHNPGGPNEDFGIKYNMENGGPAPEGITDKIYENTKTIKEYFIAEGLPDVDISAIGISNFSGPDGQFDVDVFDSASDYVKLMKSIFDFQSIQKLIASPQFSFCYDALHGVAGAYAKRIFVEELGAKESSLLNCVPKEDFGGGHPDPNLTYAKELVARMGMGKNPDSNPPEFGAAADGDADRNMILGKRFFVTPSDSVAIIAANAVQAIPYFSSGLKGVARSMPTSAALDVVAKSLNLKFFEVPTGWKFFGNLMDAGLCSVCGEESFGTGSDHIREKDGIWAVLAWLSILAHKNKDNLNGGNLVTVEDIVKQHWATFGRHYYTRYDYENVDAGAAKEVMAHLVKLQTSISDVNNTIKGMRSDVADVVSADEFEYKDPVDGSVSKNQGIRYLFEDGSRLVFRLSGTGSEGATIRLYIEQYEKDSSKTGRDSQEALAPLVDVALKLSKMKEYTGRSAPTVIT

SEQ ID NO: 11445 - protein, 379 aa, Olea europaea
MKSIFDFQSIQKLLTSPKFTFCYDALHGVAGAYAKRIFVEELGADESSLLNCVPKEDFGGGHPDPNLTYAKELVARMGLSKTNSEQQPPEFGAAADGDADRNMILGKRFFVTPSDSVAIIAANAVQAIPYFSGGLKGVARSMPTSAALDVVAKHLNLKFFEVPTGWKFFGNLMDAGMCSVCGEESFGTGSDHIREKDGIWAVLAWLSILAYKNKDNLGEEKLVSVEDIVRQHWATYGRHYYTRYDYENVDTGGAKELMAHLVKLQSSLDEVNKIIKGKRSDVSNVVNADEFEYKDPVDGSISKHQGIRYLFEDGSRLVFRLSGTGSEGATIRLYVEQYEKDSSKIGRDSQEALAPLVEVARKLSKMQEFTGRSAPTVIT

SEQ ID NO: 11446 - protein, 320 aa, Plantago ovata
GGHPDPNLTYAKELVARMGLGKTNTEQEPPEFGAAADGDADRNMVLGKRFFVTPSDSVAIIAANAVQSIPYFSGGLKGVARSMPTSAALDVVAKNLNLKFFEVPTGWKFFGNLMDAGMCSVCGEESFGTGSDHIREKDGIWAVLAWLSILAYKNKDNLEGDKLVTVEDIVRQHWAKYGRHYYTRYDYENVDAGAAKELMAYLVKLQSSLSELNGIIKGIRSDVSNVANADEFEYKDPVDGSISKHQGIRFLFEDGSRLVFRLSGTGSEGATIRLYIEQYENDSSKTGRDSQDALSPLVEVALKLSKMQEFTGRTAPTVIT

SEQ ID NO: 11447 - protein, 116 aa, Eschscholzia californica
VLGKRFFVTPSDSVAIIAANAVQSIPYFSAGLKGVARSMPTSAALDVVAKHLNLKFFEVPTGWKFFGNLMDAGLCSVCGEESFGTGSDHIREKDGIWAVLAWLSILAFKNQGYPWW

SEQ ID NO: 11448 - protein, 294 aa, Raphanus sativus
EPPEFGAAADGDADRNMILGKRFFVTPSDSVAIIAANAIEAIPYFSSGLKGVARSMPTSAALDVVAKSLNLKFFEVPTGWKFFGNLMDAGMCSVCGEESFGTGSDHIREKDGIWAVLAWMSILAHKNKDSIDGDTKLVTVEDIVRQHWATYGRHYYTRYDYENVDAGKAKELMEHLVKLQSSIPEVNKIVKGIRSDVANVSSADEFEYKDPVDGSISKHQGIRYLFEDGSRLVFRLSGTGSEGATIRLYIEQYEKDASKIGRESQEALSPLVDIALKLSKMEEFTGRSAPTVIT

SEQ ID NO: 11449 - protein, 386 aa, Flaveria ramosissima
SASDYVKLMKSIFDFQSIQRLIASPQFSFCYDALHGVAGAYARRIFVEELGAKESSLLNCVPKEDFGGGHPDPNLTYAKELVARMGLGKNPDSNPPEFGAAADGDADRNMILGKRFFVTPSDSVAIIAANAVQAIPYFSSGLKGVARSMPTSAALDVVAKCLNLKFFEVPTGWKFFGNLMDAGLCSVCGEESFGTGSDHIREKDGIWAVLAWLSILAHKNKDNLNGGNLVTVEDIVKQHWATFGRHYYTRYDYENVDAGAAKEVMAHLVKLQSSISDVNNTIEGMRSDVADVVSADEFEYKDPVDGSVSKNQGIRYLFEDGSRLVFRLSGTGSEGATIRLYIEQYEKDSSKTGRDSQEALAPLVDVALKLSKMKEYTGRSAPTVIT

SEQ ID NO: 11450 - protein, 298 aa, Ipomoea nil
SKTHPESNPPEFGAAADGDADRNMVLGKRFFVTPSDSVAIIAANAVAAIPYFSGGLKGVARSMPTSAALDVVAKHLNLKFFEVPTGWKFFGNLMDAGMCSVCGEESFGTGSDHIREKDGIWAVLAWLNILAHKNKDLSGKLVTVEDIVRQHWATYGRHYYTRYDYENVDASGAKELMAHLVKLQSSLDEVNKIVAGIRNDVSKVVHGDEFEYKDPVDGSISSHQGIRYLFEDGSRLVFRLSGTGSEGATIRLYIEQYEKDASKIGRESADALAPLVEVALKLSKMQEFTGRSAPTVIT

SEQ ID NO: 11451 - protein, 374 aa, Ambrosia trifida
MANFTVNRVVTSPIEGQKPGTSGLRKKVKVFTQPHYLHNFVQSTFNALSAEKVKGSTLVVSGDGRYYSKDAIQIIIKMAAANGVRRVWVGQNGLLSTPAVSAVVRERVGADGSKANGAFILTASHNPGGPNEDFGIKYNMGNGGPAPEGITDKIFENTKTIKEYFIAEGLPDVDISAIGVSNFSGPGGQFDVDVFDSASDYVKLMKSIFDFQSIKKLITSPQFSFCFDALHGVGGAYAKRMFVEELGAKESSLLNCVPKEDFGGGHPDPNLTYAKELVARMGLGTNPDSNPPEFGAAADGDADRNMILGKRFFVTPSDSVAIIAANAVQAIPYFSSGLKGVARSMPTSAALDVVAKSLNLKFLRYQLAGNSLVT

SEQ ID NO: 11452 - protein, 446 aa, Flaveria ramosissima
MENGGPAPEGITDKIYENTKTIKEYFIAEGLPDVDISAIGISSFSGPDGQFDVDVFDSSSDYVKLMKSIFDFQSIKKLITSPQFSFCYDALHGVAGAYAKRIFVEELGAKESSLLNCVPKEDFGGGHPDPNLTYAKELVARMGLGKNPDSNPPEFGAAADGDADRNMILGKRFFVTPSDSVAIIAANAVQSIPYFSTGLKGVARSMPTSAALDVVAKSLNLKFFEVPTGWKFFGNLMDAGLCSVCGEESFGTGSDHIREKDGIWAVLAWLSILAHKNKDNLNGGKLVTVEDIVTLHWATFGRHYYTRYDYENVDAGAAKELMAHLVKLQSSISDVNKIIKETRSDVANVASADEFEYKDPVDGSVSKNQGIRYLFEDGSRLVFRLSGTGSEGATIRLYIEQYGKDANKNWKRFSRSTCSSGGGCTKVVQRCKNSQVVPPLRDYINN

SEQ ID NO: 11453 - protein, 470 aa, Artemisia annua
SKANGAFILTASHNPGGPNEDFGIKYNMGNGGPAPEGITDQIYENTKTINEYFLAEGLPDVDISAIGISKFSGPDGQFDVDVFDAASDYVKLMKSIFDFEAMKKLIASPQFSFCYDALHGVAGAYAGRIFVEELGATESSLLNCVPKEDFGGGHPDPNLTYAKELVSRMGLGKNPDSNPPEFGAAADGDADRNMVLGKRFFVTPSDSVAIIAANAVESIPYFSSGLKGVARSMPTSAALDVVAKSLNLKFFEVPTGWKFFGNLMDAGLCSVCGEESFGTGSDHIREKDGIWAVLAWLSILAYKNKDNLNGGNLVTVEDIVKQHWAKFGRHYYTRYDYENVDAGAAKELMAHLVKLQASLSDVNTTIKGIRSDVANVASADEFEYKDPVDGSISKNQGIRYLFEDGSRLVFRLSGTGSEGATIRLYIEQYEKDSSKTGRDSQDALAPLVEVALKLSKMQEYTGRSAPTVIT

SEQ ID NO: 11454 - protein, 302 aa, Phaseolus coccineus
LGLGKSEPQDEPPDFGAASDGDADRNMILGKRFFVTPSDSVAIIAANAVDAIPYFSAGLKGVARSMPTSAALDVVAKNLNLKFFEVPTGWKFFGNLMDAGLCSVCGEESFGTGSDHIREKDGIWAVLAWLSILAYKNKDKLEDKLVTVEDIVRQHWATYGRHYYTRYDYENVDAGAAKELMAYLVKLQSSLSEVNEIIKGVRSDVSKVVNADEFEYKDPVDGSISSHQGIRYLFEDGSRLIFRLSGTGSEGATIRLYIEQYEKDASKIGRLSNEALAPLVEVALKLSKMEEFTGRSAPTVIT

SEQ ID NO: 11455 - protein, 76 aa, Populus trichocarpa
MVLFNVSRVETTPFGDQKPGTSGLRKKVKVFKQPNYLQNFVQSTFNALTPQNVRGATLVVSGDGRYFSTDAISDYY

SEQ ID NO: 11456 - protein, 303 aa, Triphysaria pusilla
MGLGKTNSTNEPPEFGAAADGDADRNMVLGKRFFVTPSDSVAIIAANAVQAIPYFSGGLKGVARSMPTSAALDVVAKNLNLKFFEVPTGWKFFGNLMDAGMCSVCGEESFGTGSDHIREKDGIWAVLAWLSILAYKNKDNIGGDKLVSVEDIVRQHWSTYGRHYYTRYDYENVDAGSAKELMTYLVKLQSNLSEVNNIIKGIRPDVAKVVNADEFEYKDPVDGSISKHQGIRYLFEDGSRLVFRLSGTGSEGATIRLYIEQYEQDSSKIGRDSQEALSPLVEVALKLSKMQEYTGRSAPTVIT

SEQ ID NO: 11457 - protein, 66 aa, Thalictrum flavum
VNDFFATPSDSVAIIAANAVEAIPYFSSGLKGVARSMPTSAALDVVAKHLNLKFFEVPTGWKFLET

SEQ ID NO: 11458 - protein, 322 aa, Vinca minor
MVFKVVRVETKPFDGQKPGTSGLRKKVKVFTQSHYLENFVQSTFNALGADKVRGATLVVSGDGRYYSKDAIQIIIKMSAANGVRRVWVGQNGLLSTPAVSCVVRERVGADGSKATGAFILTASHNPGGPNEDFGIKYNMENGGPAPESVTNKIYENTTTIKEYLIAEGLPDVDIITIAVSNFAGPEGQFDVDVFDSANDYLKLMKSIFDFQSIQKLLSSPNFTFCFDALHGVAGAYAKCIFVEELGAKESSLLNCVPKEDFGGGHPDPNLTYAKELVECMGLGKTDSGKEPPEFGAAADGDADRNMVLGKRFLLLHRILLLS

SEQ ID NO: 11459 - protein, 375 aa, Carica papaya
FDFESIRKLLSSPKFTFCYDALHGVAGAYAKCIFVEELGAQESSLLNCTPKEDFGGGHPDPNLTYAKELVARMGLGKSDSGFEPPEFGAAADGDADRNMILGKRFFVTPSDSVAIIAANAVDAIPYFSAGLKGVARSMPTSAALDVVAKNLNLKFFEVPTGWKFFGNLMDAGLCSICGEESFGTGSDHIREKDGIWAVLAWLSILAYKNKDNLDGRKLVSVEDIVRQHWAAYGRHYYTRYDYENVDAAAAKELMAYLVKLQSTLPEVNQIVKGICSDVSNVAAADEFEYKDPVDGSVSKHQGIRYLFEDGSRLVFRLSGTGSEGATIRLYIEQYEKDPSKTGRDSQEALAPLVEVALQLSKMQEFTGRSAPTVIT

SEQ ID NO: 11460 - protein, 239 aa, Brassica juncea
MPTSAALDVVAKSLNLKFFEVPTGWKFFGNLMDAGMCSVCGEESFGTGSDHIREKDGIWAVLAWMSILAHKNKDSIDGDTKLVTVEDIVRQHWATYGRHYYTRYDYENVDAGKAKELMEHLVKLQSSIPEVNKIVKGIRSDVANVSSADEFEYKDPVDGSISKHQGIRYLFEDGSRLVFRLSGTGSEGATIRLYIEQYEKDASKIGRESQEALSPLVDIALKLSKMEEFTGRSAPTVIT

SEQ ID NO: 11461 - protein, 293 aa, Humulus lupulus
EPPEFGAAADGDADRNMVLGKRFFVTPSDSVAIIAANAVDAIPYFSAGLKGVARSMPTSAALDVVAKHLNLKFFEVPTGWKFFGNLMDAGLCSVCGEESFGTGSDHIREKDGIWAVLAWLSILAHKNKDNLDGGKLVSVEEIVRQHWAKYGRHYYTRYDYENVDAGAAKELMAYLVKLQSSLPEVNEIVKSARSDVSKVVHGDEFEYKDPVDGSISKHQGIRYLFEDGSRLVFRLSGTGSEGATIRLYIEQYEKDPSKIGRDSQEALGPLVEVALKLSKMQEYTGRTAPTVIT

SEQ ID NO: 11462 - protein, 338 aa, Phalaenopsis aphrodite
MVVFAVSRKETSPIEGQKPGTSGLRKKVKVFQQPNYLHNFVQSTFDALTAEKVRGATIVVSGDGRYFSKDAIQIIIKMAAANGVRRVWIGQNGLLSTPAVSCVIRERVGADGSKATGAFILTASHNPGGPNEDFGIKYNMENGGPAPEAITDKIYANTKTIKEYLIAEDIPDVDVSTIGVTNFSGPEGLFDVEVFDSASDYVQLMKSIFDFSSIQKLLASPNFSFCYDALHGVAGAYAKRIFLEELGAKESSLLNCTPKEDFGGGHPDPNLTYAKELVARMGLSKSEPQDEPPEFGAAADGDADRNMILGKRFFVTPSDSVAIIAANAVQSIPFFLLG

SEQ ID NO: 11463 - protein, 320 aa, Trifolium pratense
FGGGHPDPNLTYAKELVARMGLGKSEPQGEPPEFGAAADGDADRNMILGKRFFVTPSDSVAIIAANAVQAIPYFSAGLKGVARSMPTSAALDVVAKHLNLKFFEVPTGWKFFGNLMDAGLCSVCGEESFGTGSDHIREKDGIWAVLAWLSILAYKNKDNQDKLVTVEDIVRQHWATYGRHYYTRYDYENVDAGAAKELMAHLVKLQSSLSEVNKIVKGASSDVSNVVHGDEFEYKDSVDGSVSSHQGIRYLFEDGSRLIFRLSGTGSEGATIRLYIEQYEKDPSKIGRLSHEALAPLVAAALKLSKMEEFTGRSAPTVIT

SEQ ID NO: 11464 - protein, 239 aa, Actinidia deliciosa
MPTSAALDVVAKHLNLKFFEVPTGWKFFGNLMDAGLCSVCGEESFGTGSDHIREKDGIWAVLAWLSILAYRNKNNLSDVEKLETVEDIVRQHWAIYGRHYYTRYDYENVDAGAAKELMVYLVNLQSDLAEVNKIVKGICSDVSNVADADEFEYKDPVDGSISKHQGIRYLFADGSRLVFRLSGTGSEGATIRLYIEQYEKDPSKTGRDSQAALAPLVEVALKLSKMEQFTGRSAPTVIT

SEQ ID NO: 11465 - protein, 361 aa, Elaeis guineensis
FTFCYDALHGVAGIYAKRIFVEELGANESSLMNCTPKEDFGGGHPDPNLTYAKELVARMGLSKSGSQGEPPEFGAAADGDADRNMILGKRFFVTPSDSVAIIAANAVEAIPYFSSGLKGVARSMPTSAALDVVAKNLNLKFFEVPTGWKFFGNLMDAGLCSICGEESFGTGSDHIREKDGIWAVLAWLSILAYRNKDKLDGDKLVTVEDIVLQHWATYGRHYYTRYDYENVDAGAAKELMEHLVNLQSSLPDVNKIIKEIRPDVSSVVQADEFEYKDPVDGSISKHQGIRYLFEDGSRLVFRLSGTGSVGATIRVYIEQYEKDPMKTGRDSQEALAPLVAVAIKLSKMQEFTGRSAPTVIT

SEQ ID NO: 11466 - protein, 181 aa, Lippia dulcis
MTSFKVTRVQTSPIDGQKPGTSGLRKKVKVFVQPHYLQNFVQSTFNALGADKMKGATLVVSGDGRYYSKDAIQIIIKMAAANGVRRIWVGQNGLLSTPAVSAVIRERVGADGSKANGAFILTASHNPGGPNEDFGIKYNMENGGPAPEGITDKIYSNTTTIKEYLIAEGLPDVDISKIGLG

SEQ ID NO: 11467 - protein, 518 aa, Sequoia sempervirens
VLFKRGYSDNSKMAAANGVRCIWIGQNGLLSTPAVSAVIRDRVGADGEKASGAFILTASHNPGGPHEDFGIKYNMENGGPAPEGITDKIYENTKTIKEYFIAEDLPDVDISTIGITHFGGPEGPFDVDVFDSAEDYVKLMKTIFDFEAIQKLLTCPKFTFCYDALHGVAGAYAKRIFVEELSADESSLINCIPKEDFGGGHPDPNLTYAKELVARMGLGKEAPASEPPEFGAAADGDADRNMILGKRFFVTPSDSVAIIAANAVEAIPYFSSGLKGVARSMPTSAALDVVAKNLNLKFFEVPTGWKFFGNLMDAGMCSVCGEESFGTGSDHIREKDGIWAVLAWLSILAFKNKDNLAGGKLVSVEDIVHSHWASYGRHYYTRYDYENVDAAAAKELMAHLVKLQSSLPEVNKIIKGVRPDVSDVVHGDEFEYKDPVDGSVSKHQGIRYLFEDGSRLIFRLSGTGSEGATIRLYIEQYEASPSKTGRNSQEALAPLVEVALQLSKMEEFTGRSSPTVIT

SEQ ID NO: 11468 - protein, 481 aa, Taxus baccata
MVLFSVVRKETSPYDGQKPGTSGLRKKVKVFIQENYLQNFVQATFNALSAEKIKGSTIVVSGDGRYYSKDAIQIIIKMAAANGVRRIWVGQNGLLSTPAVSAVIRDRVGADGEKASGAFILTASHNPGGPHEDFGIKYNMENGGPAPEGITDKIYENTKTIKEYFIAEDLPDVDISTIAITHFGGPEGPFDVDVFDSAEDYVKLMKTIFDFEAIQKLLTSPKFTFCYDALHGVAGAYAKRIFVEELSADESSLINCTPKEDFGGGHPDPNLTYAKELVARMGLGKEAPALEPPEFGAAADGDADRNMILGKRFFVTPSDSVAIIAANAVEAIPYFSSGLKGVARSMPTSAALDVVAKNLNLKFFEVPTGWKFFGNLMDAGLCSVCGEESFGTGSDHIREKDGIWAVLAWLSILALKNKNNLDGGNLVSVEDIVHSHWASYGRHYYTRYDYENVDAAAAKELMAHLVKLQSSLPEVNRKLRK

SEQ ID NO: 11469 - protein, 105 aa, Distylium racemosum
MVIFSVSRKETTPYDGQKPGTSGLRKKVKVFAQENYLHNFVQATFNGLSAEKVKGATIVVSGGWTLLLKRGYSDNNKNGSCKWSKSCLGRPKWTSLYTCSVSSHT

SEQ ID NO: 11470 - protein, 207 aa, Fagopyrum esculentum
MDAGMCSVCGEESFGTGSDHVREKDGIWAVLAWLSILAFKNKDNLSGGKLVSVEDIVRKHWETYGRHYYTRYDYENVDAGAAKELIAHLVKLQSTIPEVNKIVKAARPDVSNVVSGDEFEYKDPVDGSISKNQGVRYLFEDGSRLVFRLSGTGSEGATIRLYIEQYEKDSSKIGRDSQEALAPLVEAALKLSKMQEFTGRSAPTVIT

SEQ ID NO: 11471 - protein, 426 aa, Cynodon dactylon
RVDISEYLISEDLPDVDISVVGVTSFSGPEGPFDVDVFDSSVDYIKLMKSIFDFEAIKKLVTSPKFTFCYDALHGVAGAYAKQIFVEELGADESSLLNCVPKEDFGGGHPDPNLTYAKELVERMGLGKSTSNVEPPEFGAAADGDADRNMILGKRFFVTPSDSVAIIAANAVQSIPYFSSGLKGVARSMPTSAALDVVAKNLNLKFFEVPTGWKFFGNLMDAGMCSICGEESFGTGSDHIREKDGIWAVLAWLSILAFKNKDNLGGDKLVSVEDIVRQHWATYGRHYYTRYDYENVDAGAAKELMANLVSMQSSLSDVNKLIKEIRSDVSDVVAADEFEYKDPVDGSVSKHQGIRYLFGDGSRLVFRLSGTGSVGATIRVYIEQYEKDSSKIGRESQDALAPLVDVALKLSKMQEYTGRSAPTVIT

SEQ ID NO: 11472 - protein, 538 aa, Panicum virgatum
MGLFTVTKQATTPFDGQKPGTSGLRKKVTVFQQPHYLQNFVQSTFNALPADQVKGATIVVSGDGRYFSKDAVQIITKMAAANGVRRVWVGLNSLMSTPAVSAVIRERTGADGSKATGAFILTASHNPGGPTEDFGIKYNMGNGGPAPESVTDSIFSNTKTISEYLIAEDLPDVDISVAGVTSFSGPEGPFDVDVFDSSVDYIKLMKSIFDFEAIKKLLTSPKFTFCYDALHGVAGAYAKHIFVEELGADESSLLNCVPKEDFGGGHPDPNLTYAKELVERMGLGKSSSNAEPPEFGAAADGDADRNMILGKRFFVTPSDSVAIIAANAVQSIPYFASGLKGVARSMPTSAALDVVAKNLNLKFFEVPTGWKFFGNLMDAGMCSICGEESFGTGSDHIREKDGIWAVLAWLSILAFKNKDNLGGDKLVTVEDIVRQHWATYGRHYYTRYDYENVDAGAAKELMANLVSMQSSLSDVNKLIKEIRSDVSEVVSADEFEYKDPVDGCVQAPGYPIPLWRWFTTGVPSLWNWFCWCHHSCLH

SEQ ID NO: 11473 - protein, 270 aa, Gnetum gnemon
MVLFSVTKKATTPYDGQKPGTSGLRKKVAIFKKDNYLHNFVQATFSALSPAKVKGATLVVSGDGRYFSKDAIQIIIKMSAANGVRRVWVGQNGLLSTPAVSAVVRNRVGADGEKATGAFILTASHNPGGPHEDFGIKYNMENGGPAPEGVTNKIYEFTKIINEYYIAEDLQDVDLSSIGITKYTGPEGQFDVDVFDATEEYVKLMKTIFDFEAIRKLLTSPKFTFCYDALHGVAGIYAKRIFVEELSANGSSLLNCTPKEDFVGAIQIQI

SEQ ID NO: 11474 - protein, 301 aa, Amaranthus tuberculatus
LGKSNSEGEPPEFGAAADGDADRNMILGKRFFVTPSDSVAIIAANAVEAIPYFSGGLKGVARSMPTSAALDVVAKALNLKFFEVPTGWKFFGNLMDAGQCSVCGEESFGTGSDHVREKDGIWAVLAWLSILSQKNKNKLDGEKLVTVEDIVRQHWATYGRHYYTRYDYENVDAGGAKELMAHLVNLQSDLPQVNKIVKKVNSAVSNVINADEFEYTDPVDGSISKHQGIRYLFEDGSRLVFRLSGTGSEGATIRVYIEQYENDSSKTGRDSQEALKPLVEVALELSKMQEFTGRSEPTVIT

SEQ ID NO: 11475 - protein, 459 aa, Leymus cinereus x Leymus triticoides
  misc_feature (122)..(122): Xaa can be any naturally occurring amino acid
SHNPGGPTEDFGIKYNMENGGPAPESVTDKIFSNTKTITEYLIAEDLPDVDISVTGVTSFTGPEGPFDVDVFDSATDYIKLMKTIFDFESIKKLLASPKFSFCFDGLHGVAGAYAKRIFVDXLGASESSLLNCVPKEDFGGGHPDPNLTYAKELVDRMGLGKTSNVEPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWLSILAYKNKDNLGGDKLVTVEDIVLQHWGTYGRHYYTRYDYENVDAEAAKELMANLVKMQSSLSDVNKFIKEIQPAVADVVSADEFEYKDPVDGSVSKHQGIRYLFGDGSRLVFRLSGTGSVGATIRIYIEQYEKDSSKTGRESSDALSPLVDVALKLSKIQEYTGRSAPTVIT

SEQ ID NO: 11476 - protein, 343 aa, Orobanche aegyptiaca
IFVEELGAQESSLLNCVPKEDFGGGHPDPNLTYAKELVARMGLGKVNSQEEPPEFGAAADGDADRNMILGKRFFVTPSDSVAIIAANAVQAIPYFSGGLKGVARSMPTSAALDVVAKNLNLKFFEVPTGWKFFGNLMDAGMCSVCGEESFGTGSDHIREKDGIWAVLAWLSILAYKNKDNLGGEKLVSVEDIVRQHWSTYGRHYYTRYDYENVDAGGAKELMAYLVKLQSSLSEVNNIINGIRPEVSKIVHADEFQYKDPVDGSISKHQGIRYLFEDGSRLVFRLSGTGSEGATIRLYIEQYEQDPSKIGRDSQEALAPLVEVALKLSKMKEYTERSAPTVIT

SEQ ID NO: 11477 - protein, 207 aa, Sciadopitys verticillata
MDAGMCSICGEESFGTGSDHIREKDGIWAVLAWLSILAFKNKDNLDGGELVTVEDIVHNHWASYGRHYYTRYDYENVDAGAAKELMAYLVKLQSSIPAVNKIIKEARPDVSNVIHADEFEYKDPVDGSVSKHQGIRYLFEDGSRLVFRLSGTGSEGATIRLYIEQYEVDSTKTGKNSQEALAPLVQVALHLSKMEEFTGRLSPTVIT

SEQ ID NO: 11478 - protein, 648 aa, Setaria italica
MIPPVCSCSLPSPAIIPPRPRRHRHRTTTPSPPSHSRSLLHHQRLLRPTPLLASRGDRRRIVGGPAMFSVTKKATTPFEGQKPGTSGLRKKVTVFQQPHYLQNFVQSTFNALPAEEVKGATIVVSGDGRYFSKDAVQIITKMAAANGVRRVWVGQNSLMSTPAVSAVIRERIGEDGSKATGAFILTASHNPGGPTEDFGIKYNMGNGGPAPESVTDKIFSNTTTISEYLISEDLPDVDISEIGVSSFSGPEGPFAVEVFDSSVDYIKLMKSIFDFEAIKKLLTSPKFTFCYDALHGVAGAYAKHIFVEELGADESSLLNCVPKEDFGGGHPDPNLTYAKELVERMGLGKSSSNVEPPEFGAAADGDADRNMILGKRFFVTPSDSVAIIAANAVQSIPYFASGLKGVARSMPTSAALDVVAKNLNLKFFEVPTGWKFFGNLMDAGMCSICGEESFGTGSDHIREKDGIWAVLAWLSILAFKNKDNLGGGDKLVSVEDIVRQHWATYGRHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSSKTGRESSDALAPLVDVALKLSKMQEYTGRSAPTVIT

SEQ ID NO: 11479 - protein, 371 aa, Cedrus atlantica
SVNRKETSPYDGQKPGTSGLRKKVTVFKQQNYLHNFVQATFDALSAEKVKGSTIVVSGDGRYFSEEAIQIIIKMSAGNGVRRVWVGQNGLLSTPAVSAVIRNRIGADGGKASGSFILTASHNAGGPNEDFGIKYNMENGGPAPEGITDKIYENTKTIKEYFTAEDLPNVDISTIGITSFGGPEGPFDVDVFDSTEDYVKLMKTIFDFEAIQKLLTCPKFTFCYDALHGVAGIYAKKIFVEELSASESSLINCIPKDDFGGGHPDPNLTYAKELVTRMGLGKEAPGSEVPEFGAAADGDADRNMILGKRFFVTPSDSVAIIAANAVEAIPYFSSGLKGVARSMPTSAALDVVAKNLNLRFFEVPTGWKFLEI

SEQ ID NO: 11480 - protein, 122 aa, Sarracenia psittacina
MAHLVNLQSDLTEVNSIVKGASSDVSKVVHGDEFEYKDPVDGSISKHQGIRYLFEDGSRLVFRLSGTGSEGATIRLYIEQYEKDPSKTGRDSQDALAPLVEVALKLSKIEEFTGRSAPTVIT

SEQ ID NO: 11481 - protein, 645 aa, Setaria italica
MIPPVCSCSLPSPAIIPPRPRRHRHRTTTPSPPSHSRSLLHHQRLLRPTPLLASRGDRRRIVGGPAMFSVTKKATTPFEGQKPGTSGLRKKVTVFQQPHYLQNFVQSTFNALPAKEVKGATIVVSGDGRYFSKDAVQIITKMAAANGVRRVWVGQNSLMSTPAVSAVIRERIGEDGSKATGAFILTASHNPGGPTEDFGIKYNMGNGGPAPESVTDKIFSNTTTISEYLISEDLPDVDISEIGVSSFSGPEGPFDVEVFDSSVDYIKLMKSIFDFEAIKKLLTSPKFTFCYDALHGVAGAYAKHIFVEELGADESSLLNCVPKEDFGGGHPDPNLTYAKELVERMGLGKSSSNVEPPEFGAAADGDADRNMILGKRFFADSVAIIAANAVQSIPYFASGLKGVARSMPTSAALDVVAKNLNLKFFEVPTGWKFFGNLMDAGMCSICGEESFGTGSDHIREKDGIWAVLAWLSILAFKNKDNLGGGDKLVSVEDIVRQHWATYGRHYYTRYDYENVDAGAAKELMANLVSMQSSLSDVNKLIKEIRSDVSEVVAADEFEYQDPVDGSVSKHQGIRYLFGDGSRLVFRLSGTGSVGATIRVYIEQYEKDSSKTGRESSDALAPLVDVALKLSKMQEYTGRSAPTVIT

SEQ ID NO: 11482 - protein, 527 aa, Utricularia gibba
LVVSGDGRYYSKDAIQIIIKMAAANGVRRVWVGQNGLLSTPAVSAVIRERVGADGSRANGAFILTASHNPGGPTEDFGIKYNMGNGGPAPEGITDKIYRNTTTIKEYLIAEGFPDVDISAVGVTSFRGPEGPFDVDVFDSANDYVNLMKSIFDFDSIQKLLSSQNFTFCYDALHGVAGAYAKRIFVEELGTKESSLLNCVPKEDFGGGHPDPNLTYAKELVARMGLGKESPEQEPPEFGAAADGDADRNMILGKRFFVTPSDSVAIIAANAVQSIPYFSGGLKGVARSMPTSAALDVVAKNLNLKFFEVPTGWKFFGNLMDAGMCSICGEESFGTGSDHIREKDGIWAVLAWLSILAYKNKDNLVGEKKLVSVEDIVFDHWAKYGRHYYTRYDYENVDATAAKELMASLVKLQSDLVELNNIVKGLVSGVSNIVHADEFEYKDPVDGSISSHQGIRYLFEDGSRLVFRLSGTGSEGATIRLYIEQYEKDPSKTKRDSQDALAPLVEVALKLSKMQDFTGRSAPTVIT

SEQ ID NO: 11483 - protein, 258 aa, Solanum melongena
ANAVQAIPYFSGGLKGVARSMPTSAALDVVAKQLNLKFFEVPTGWKFFGNLMDAGMCSICGEESFGTGSDHIREKDGIWAVLAWLSILAYKNKDNLGEGNLVSVEDIVRQHWATYGRHYYTRYDYENVSADGAKELMAHLVKLQSSIDEVNKFIKGIRSDVSNVVHADEFEYKDPVDGSVSKHQGIRYLFEDGSRLVYRLSGTGSEGATIRLYIEQYENDSSKTGRDSQEALAALVEVALKLSKMQEYTGRSAPTVVT

SEQ ID NO: 11484 - protein, 507 aa, Silene vulgaris
KMSAANGAKSIWVGQNGLLSTPAVSAVIRERVGKDGSKASGSFILTASHNPGGPTEDFGIKYNMENGGPAPEGVTDKIYENTTTIKEYLIAEDVPDVDISKLGTSSFTGPEGEFEVEVFDATETYVQLMKSIFDFEAIKKLLACPKFSFCYDSLHGVAGVYATRIFVKELGASESSLLNCTPKEDFGGGHPDPNLTYAKELVQRMGLGKSSSPGEPPEFGAAADGDADRNMILGKRFFVTPSDSVAIIAANAVEAIPYFSGGLKGVARSMPTSAALDVVAKALNLEFFEVPTGWKFFGNLMDAGKCSVCGEESFGTGSDHVREKDGIWAVLAWLSILAYRNKDKLNGGELVTVEDIVRQHWAKYGRHYYTRYDYENVDSGGAKELMAHLVNLQSNLPEVNKIVKSVDSTVANVVDADEFEYKDPVDGSVSKHQGIRYLFADGSRLVFRLSGTGSEGATVRVYIEQYENDSSKTSRDSQDALKPLVNVALKLSKMQEFTGRSEPTVIT

SEQ ID NO: 11485 - protein, 290 aa, Elaeis guineensis
  misc_feature (270)..(270): Xaa can be any naturally occurring amino acid
  misc_feature (277)..(277): Xaa can be any naturally occurring amino acid
KELVTRMGLGKSSPQDEPPEFGAAADGDADRNMILGKRFFVTPSDSVAIIAANAVEAIPYFASGLKGVARSMPTSAALDVVAKNLGLKFFEVPTGWKFFGNLMDAGLCSICGEESFGTGSDHIREKDGIWAVLAWLSILAYKNKNNFNGEKLVTVEDIVVQHWATYGRHYYTRYDYENVDAAAAKELMAYLVNLQSSLSDVNKIVKEIRTDVSNVVQADEFEYKDPVDGSISKHQGIRYLFEDGSRLVFRLSGTGSEGATIRLYIEQYEXDSSRHGXIHKKHLLHLWMWH

SEQ ID NO: 11486 - protein, 257 aa, Capsicum annuum
TRVQAIPYFSGGLKGVARSMPTSAALDVVAKHLNLKFFEVPTGWKFFGNLMDAGMCSICGEESFGTGSDHIREKDGIWAVLAWLSILAYKNKDNLGEGNLVTVEDIIRQHWVTYGRHYYTRYDYENVNADGAKELMAHLVKLQSSIDEVNKVIKEIRSDVSNVVHADEFEYKDPIDGSVSKHQGIRYLFEDGSRLVFRLSGTGSEGATIRLYIEQYEKDSSKIGRDSQEALAPLVEVALNLSKMQEYTGRSAPTVIT

SEQ ID NO: 11487 - protein, 581 aa, Physcomitrella patens
MGLFKVVEQETKPIDGQKPGTSGLRKKVTVFKQEHYLANFVQATFDALPSEKVKGSNIVVSGDGRYWSTEAIQIVIKIAAANGVKRVWVGQNTLLSTPAVSSIIRNRVNSQGEKAYGAFILTASHNPGGPDEDFGIKYNCENGGPAPESLTNKIYENTKKITAYRTADGIPNVDVTQIGVTSFEGPNGTFDVEVFDSTEDYVKLMKSIFDFTAIKDLITNPKFTFCYDALHGVAGVYAKKIFLEELGAKESSLLNCEPKEDFGGGHPDPNLTYAKELVQVMGLGKTQPDEVPEFGAAADGDADRNMILGKRFFVTPSDSVAIIAANAVGAIPYFSGGLKGVARSMPTSAALDVVAKKLNLKFFEVPTGWKFFGNLMDAGMCSVCGEESFGTGSDHIREKDGIWAVLAWLSILAHRNKQAGGDKLVTVEEIVTEHWNTYGRHYYTRYDYENVDSDAAKKLMENLVELQSNLDDVNSMIKKIRPDVAEVQEADEFEYKDPVDQSVSCHQGIRYLFKDGSRLVFRLSGTGSVGATIRLYIEQYEADPTKTFKPSAEALAPLVEVALKLSKMEEFTGRSEPTVIT

SEQ ID NO: 11488 - protein, 581 aa, Ceratodon purpureus
MVFQVVKQETKPIDGQKPGTSGLRKKVTVFKQDHYLANFVQSTFDALPSEKVKGSNIVVSGDGRYWSTEAIQIIIKIAAANGVKRVWVGQNTLLSTPAVSAIIRDRVNSNGEKAYGAFILTASHNPGGPDEDFGIKYNCENGGPAPESLTDKIYSNTKAISAYYTVDGIPDVDVTKIGTTSFEGPDGTFEVEVFDSTEDYVKLMKTIFDFTAIKDLLTNPKFTFCYDALNGVAGVYAKRIFLEELGAQESSLLNCVPKEDFGGGHPDPNLTYAKELVQVMGLGKKPPTNDVPEFGAAADGDADRNMILGKRFFVTPSDSVAIIAANAVGAIPYFNGGLKGVARSMPTSAALDVVAQKLNLKFFEVPTGWKFFGNLMDAGMCSVCGEESFGTGSDHIREKDGIWAVLAWLSILAHRNKLAGGDKLVTVEEIVTEHWNTYGRHYYTRYDYENVDAEAAKKLMAHLVDLQSKLGDVNNMIKEIRPDVAEVKEADEFEYKDPVDNSVSSHQGIRYLFKDGSRLVFRLSGTGSVGATIRLYIEQYESDPTKTFKPSAEALAPLVEVALKLSKIEEFTGRSEPTVIT

SEQ ID NO: 11489 - protein, 290 aa, Malus domestica
EFGAAADGDADRNMVLGKRFFVTPSDSVAIIAANAVEAIPYFKTGLKGVARSMPTSAALDVVAKHLNLKFFEVPTGWKFFGNLMDAGLCSVCGEESFGTGSDHIREKDGIWAVLAWLSILAYKNKENLGGEKLVSVEDIVRKHWATFGRHYYTRYDYENVDAGKAKELMASLVKLQSDLSEVNKIVKGIHSDVSNVVNADEFEYKDPVDGSISKHQGIRYLFEDGSRLVFRLSGTGSEGATIRLYIEQYEKDPSKIGRESSEALGPLVEVALKLSKMQEFTGRSAPTVIT

SEQ ID NO: 11490 - protein, 289 aa, Petunia hybrida
FGAAADGDADRNMILGKRFFVTPSDSVAIIAANAVQAIPYFSGGLKGVARSMPTSAALDVVAKHLNLKFFEVPTGWKFFGNLMDAGMCSVCGEESFGTGSDHIREKDGIWAVLAWLSILAYKNKDNLEGGNLVTVEDIVRQHWTTYGRHYYTRYDYENVDAGGAKELMSHLVKLQSSLDEVNKIVKGVRSDVSNVVHADEFEYKDPVDGSVSKHQGIRYLFEDGSRLIFRLSGTGSEGATIRLYIEQYEKDSSKIGRDSQEALAPLVEVALKLSKMQEYTGRSAPTVIT

SEQ ID NO: 11491 - protein, 581 aa, Physcomitrella patens
MVLFKVVKQETKAIDGQKPGTSGLRKKVTVFKQDHYLANFVQATFDALPSDKVKGSNIVVSGDGRYWSTEAIQIIIKIAAANGVKRVWVGQNTLLSTPAVSAIIRERVNSHGEKAYGAFILTASHNPGGPDEDFGIKYNCENGGPAPESLTNKIYENTKKITAYHTADGIPNVDVTKIGVTSFEGPDGTFDVEVFDSTEDYVKLMKTIFDFTAIKDLITNPKFSFCYDALHGVAGVYAKKIFLEELGAKESSLLNCEPKEDFGGGHPDPNLTYAKELVQVMGLGKTQPDEIPEFGAAADGDADRNMILGKKFFVTPSDSVAIIAANAVGAIPYFSGGLKGVARSMPTSAALDVVAKKLNLEFFEVPTGWKFFGNLMDAGMCSVCGEESFGTGSDHIREKDGIWAVLAWLSILAHRNKQAGGDKLVTVEEIVTEHWNTYGRHYYTRYDYENVDSDDAKKLMAHLVDLQSKLGDVNNLIKEIRPDVAEVQEADEFEYKDPVDQSISSHQGIRYLFKDGSRLVFRLSGTGSVGATIRLYIEQYEADPAKIFEPSAEALAPLVEVALKLSKMEEFTGRSEPTVIT

SEQ ID NO: 11492 - protein, 285 aa, Ocimum basilicum
SDGDADRNLILGKRFFVTPSDSVAIIAANAVQAIPYFSGGLKGVARRMPTSAALDVVAKHLNLKFFEVPTGWKFFGNLMDAGMCSICGEESFGTGSDHIREKDGIWAVLAWLSILADKNKDNLGGEKFVTVEDIVRQHWSTYGRHYYTRYDYENVDSGGAKDLMAYLVKLQSNLTEVNNIIKGIRSDVSNVVNADEFEYKDPVDGSISKHQGIRYLFEDGSRLVFRLSGTGSEGATIRLYIEQYEKDPSKTGRESHEALAPLVEVGLKLSKMQEFTGRSAPTVIT

SEQ ID NO: 11493 - protein, 287 aa, Cajanus cajan
GAAADGDADRNMILGKRFFVTPSDSVAIIAANAVESIPYFSAGLKGVARSMPTSAALDVVAKHLNLKFFEVPTGWKFFGNLMDAGLCSVCGEESFGTGSDHIREKDGIWAVLAWLSILAYKNKDTLEDKLVTVEDIVRQHWATYGRHYYTRYDYENVDAGAAKELMGYLVKLQSSLSEVNEIVKGVRSDVSNVVNADEFEYKDPVDGSVSSHQGIRYLFEDGSRLIFRLSGTGSEGATIRLYIEQYEKDPSKIGRLSNEALAPLVEVALKLSKMEEFTGRSAPTVIT

SEQ ID NO: 11494 - protein, 206 aa, Flaveria ramosissima
LSAEKVKGSTLVVSGDGRYYSKDAIQIIIKMAAANGVRRVWVGQNGLLSTPAVSAVVRERVGADGSKANGAFILTASHNPGGPNEDFGIKYNMENGGPAPEGITDKIYENTKTIKEYFIAEGLPDVDISAIGISSFSGPDGQFDVDVFDSSSDYVKLMKSIFDFQSIKKLIASPQFSFVMMLFMELLELMLNVYLSKSLVQKRAHY

SEQ ID NO: 11495 - protein, 357 aa, Brassica oleracea
DLPAKDGSTYGSGNFVVTLGIGTPKHDLSLIFDTGSDLTWIQCEPCVRTCYSQKEPIFNPSSSSSYHNVSCSSAECSSLSSATGNSGTCSASNCVYGIQYGDQSFSVGFLAKEKFTLTASNVFDGVNFGCGENNQGLFTGVAGLLGLGRDKLSFPSQTAATYNKIFSYCLPSSASYTGHLTFGSAGVSRSVKFTPISTITDGTSFYGLDIVGISVGGQKLAIPPTVFSTPGALIDSGTVISRLPPKAYAALRGAFKAKMSQYKNASGVSILDTCFDLTGFKTVTIPTVSFYFNGGAVVELGSKGVLYAFKMSKVCLAFAGNSDDNNAAIFGNVQQQTLEVVYDGAAGRVGFAPNGCS

SEQ ID NO: 11496 - protein, 277 aa, Brassica napus
FDTGSDLTWIQCEPCVQTCYSQKEPIFNPSSSSSYYNVSCSSAACTSLSSATGNSGSCSASTCVYGIQYGDQSFSVGFLAKEKFTLTTPNVFDGVYFGCGENNQGLFTGVAGLLGLGRDKLSFPRRRNNIQQDLLLLPPFLRQLHRPSHLRNRRNLQIRQVHSDLHHHRRHVLLRPRHRRDHRRRSEASDRSHRVLNSGGFDRLRNRHHSSPAEGLRGAERRVQGEDESVSERVGGLDLGHVFRSQRVKNGYDSESGVFFQRRRGCGAWIDGGSIRV

SEQ ID NO: 11497 - protein, 300 aa, Brassica napus
FNPSSSSSYYNVSCSSAACSSLSSATGNSGSCSASTCVYGIQYGDQSFSVGFLAKEKFTLTSSNVFDGVYFGCGENNQGLFTGVAGLLGLGRDKLSFPSQTAKAYNNIFSYCLPSSSSYTGHLTFGTAGISRSVKFTPISTITEGTSFYGLDIVAITVGGQKLAIAPAVFSTPGALIDSGTVITRLPPKAYAALKDAFKAKMSQYPSASGVSILDTCFDLSGLKTFTIPKVAFSFSGGAVVELGSTGVLYAFKMSQVCLAFAGNSDDTNAAIFGNVQQQTLEVVYDGAGGRVGFAPNGCS

SEQ ID NO: 11498 - protein, 509 aa, Brassica rapa
SLTGFWFDVIVILPVPQAVFWLVVPKLIREEKVKLIMTILLLIFLFQFLPKIYHCICLMRRMQKVTGYIFGTIWWGFALNLIAYFIASHVAGGCWYVLAIQRVASCIRQQCMRTANCNLSLSCQEEVCYQFVSPSSTIGFPCVSGNLTSVVKKPMCLDSDGPFRYGIYGWALPVISSNSLAVKILYPIFWGLMTLSTFGNDLEPTSNWLEVVFSIVMVLSGLLLFTLLIGNIQVFLHAVMAKKRKMQIRCRDMEWWMKRRQLPSRLRQRVRRFERQRWTALGGEDELELIQDLPPGLRRDIKRYLCVDLINNVPLFRGMDDLILDNICDRAKPRVYSKDEKIIREGDPVQRMIFIMRGRVKRNQSLSKGVVATSTLEPGGYLGDELLSWCLRRPFIDRLPPSSATFVCLDNIEAFSLGSEDLRYITDHFRYKFANERLKRTARYYSSNWRTWAAVNIQMSWRRYRKRTCGGVGGSMSPVSEHSVEGNSERRLLQYAAMFMSIRPHDHLE

SEQ ID NO: 11499 - protein, 211 aa, Brassica napus
LRRDIKRYLCVDLINKVPLFRGMDDLILDNISDRAKPRVYSKDEKIIREGDPVQRMIFIMRGRVKRNQSLSKGVVATSTLEPGGYLGDELLSWCLRRPFIDRLPPSSATFVCLDNIEAFSLGSEDLRYITDHFRYKFANERLKRTARYYSSNWRTWAAVNIQMSWRRYRKRTCVGGSMSPVSEHSVEGNSERRLLQYAAMFMSIRPHDHLE

SEQ ID NO: 11500 - protein, 399 aa, Raphanus sativus
MHEDRELNLSLSCQEEVCYQFVSPTSTIGFPCMSGNLTSVVKKPMCLDSDGPFRYGIYGWALPVISSNSLAVKILYPIFWGLMTLSTFGNDLEPTSNWLEVVFSIVMVLSGLLLFTLLIGNIQVFLHAVMAKKRKMQIRCRDMEWWMKRRQLPSRLRQRVRRFERQRWTALGGEDELELIQDLPPGLRRDIKRYLCVDLIEKVPLFRGMDDLILDNICDRAKPRVYSKDEKIIREGDPVQRMIFIMRGRVKRDQSLSKGVVATSTIEPGGYFGDELLSWCLRRPFIDRLPPSTATFVCLDNIEAFSLGSEDLRYITDHFRYKFANERLKRTARYYSSNWRTWAAVNIQMSWRRYRKRTSGGVGGSMSPVSEHSVEGNSERRLLQYAAMFMSIRPHDHLE

SEQ ID NO: 11501 - protein, 189 aa, Brassica oleracea
MDDLILDNICDRAKPRVYSKDEKIIREGDPVQRMIFIMRGRVKRNQSLSKGVVATSTLEPGGYLGDELLSWCLRRPFIDRLPPSSATFVCLDSIEAFSLGSEDLRYITDHFRYKFANERLKRTARYYSSNWRTWAAVNIQMSWRRYRKRTCVGGSMSPVSEHSVEGNSERRLLQYAAMFMSIRPHDHLE

SEQ ID NO: 11502 - protein, 191 aa, Brassica napus
MDDLILDNICDRAKPRVYSKDEKIIREGDPVQRMIFIMRGRVKRNQSLSKGVVATSTLEPGGYLGDELLSWCLRRPFIDRLPPSSATFVCLDNIEAFSLGSEDLRYITDHFRYKFANERLKRTARYYSSNWRTWAAVNIQMSWRRYRKRTCGGVGGSMSPVSEHSVEGNSERRLLQYAAMFMSIRPHDHLE

SEQ ID NO: 11503 - protein, 708 aa, Theobroma cacao
MVLFGVFQFCNRWIGLCQLQNSPGENSDHSGDISEDNPISNTVECYACTQVGVPVFHSTSCDHAHQPEWEASAGSSLVPIQARAGQKKTQAAASRHPSGPLGRVLDPRSKRVQKWNRAFLLARGMALAIDPLFFYALSIGRGGFPCLYMDGGLAAIVTILRTCVDAVHLFHLWLQFRLAYVSRESLVVGCGKLVWDARAIASHYVRSLKGFWFDAFVILPVPQAVFWLVVPKLIREEQIKLIMTILLLIFLFQFLPKVYHSICLMRRMQKVTGYIFGTIWWGFGLNLIAYFIASHVAGGCWYVLAIQRVASCLRQQCERSERCKLSLSCSEEVCYQFLFPAEAVGNPCGGNSTKVVGKPLCLDVHGPFNYGIYQWALPVVSSNSVAVKILYPIFWGLMTLSTFGNDLEPTSHWLEVMFSICIVLAGLLLFTLLIGNIQVFLHAVMAKKRKMQLRCRDMEWWMKRRQLPSRLRQRVRHFERQKWATLGGEDEMELIKDLPEGLRRDIKRYLCLDLIKKVPLFHNLDDLILDNICDRVKPLVFSKDEKIIREGDPVQRMVFIVRGRIKRSQSLSKGMVATSIIEPGGFLGDELLSWCLRRPFIDRLPASSATFVCVESIEAFGLDANNLRYITDHFRYKFANERLKRTARYYSSNWRTWAAVNIQLAWRRYRTRTRGPMISVTENGNSSDRRLLQYAAMFMSIRPHDHLE

SEQ ID NO: 11504 - protein, 194 aa, Brassica juncea
SSVVMLSSDEQRFLEASMAYVSGNPIMSDEEYDKLKMKLKMDGSEIVCEGPRCSLRSKKVYSDLAVDYFKMFLLNVPATVVALGLFFFLDDLTGFEITYLLELPEPFSFIFTWFAAVPAIVYLALSLTKLIIRDSLILKGPCPNCGTENTSFFGTILSISNDGSTNNVKCSGCGTAMVYDSSTRLITLPEGGNA

SEQ ID NO: 11505 - protein, 211 aa, Brassica napus
MSNEEFDNLKEELMWEGSSVVMLSSDEQRFLEASMAYVSGNPIMSDEEYDKLKMKLKMDGSEIVCEGPRCSLRSKKVYSDLAVDYFKMFLLNVPATVVALGLFFFLDDLTGFEITYLLELPEPFSFIFTWFAAVPAIVYLALSLTKLIIRDSLILKGPCPNCGTENTSFFGTILSISNDGSTNNVKCSGCGTAMVYDSSTRLITLPEGGNA

SEQ ID NO: 11506 - protein, 90 aa, Brassica napus
FLITRQSHYRSVRSGGWEEVDSKILPYCSINKNEKRSIGEMEQEFLQAMQSFYYEGKAVMSNEEFDNLKEELMWEGSSVVMLSNDTNMIF

SEQ ID NO: 11507 - protein, 316 aa, Tropaeolum majus
MATKLTFALTPSGLFPATNQKPIAPPSTRFQSIKFDGRKLHVHKRLFMLPIKATADQPGKVEDDVVDRNVLQYCSLDKKEKKSIGELEQDFLQALQAFYYEGKAVMSNEEFDNLKEELMWEGSSVVMLSSDEQKFLEASMAYVSGNPIVSDKEYDKLKLKLKMDGSDIVVEGPRCSLRSRKVYSDLNVDYFKMLLLNVPATVVALGLFFFLDDLTGFEITYLLELPEPFSFIFTWFAAVPLIVYLALSLTKLIVKDSLILKGPCPNCGTENTSFFGTILSIPNGGSTNALKCSNCGTGLVFNSSTRLITLPEGSEA

SEQ ID NO: 11508 - protein, 319 aa, Carica papaya
MASKLAFILTSPRLFTATTKKSIIYFSSSTKIQSLGFNGKQLCVRRRLFMLPPQATADQQGKIEEDEVVDSKILPYCSIDKKEKKSIGELEQDFLQALQAFYYEGKAIMSNEEFDNLKEELMWEGSSVVMLSSDEQKFLEASMAYAAGKPILSDVEFDNLKTKLKMDGSEIVVEGPRCSLRSRKVYSDLSVDYFKMLLLNVPATVVALGLFFFLDDLTGFEITYLLELPEPFSFIFTWFAAVPFIVWLALSLTKLIVKDSLILKGPCPNCGTENVSFFGIILSISNGGTTNNVKCSNCQTDLVYDSKTRLITLPEGSEA

SEQ ID NO: 11509 - protein, 333 aa, Trifolium pratense
ENFSESPPLLLAIITMFTATKVAFTLTPPRLCTAPPTPSIPISSSFSRPQFTSRHLCLRRRLFLLSPKATADQGNVEGDGVVDSNVLPYCSIDQKKVKKSVGELEQEFLQALQSFYYEGKAIMSNEEFDNLKEELMWEGSSVVMLSSDEQKFLEASMAYVSGNPILNDREYDALKLRLKREGSEIVVEGPRCSLRSRKVYSDLSVDYLKMFLLNVPATVVALGLFFFLDDITGFEITYLLELPEPFSFIFTWFAAVPLIVYLALSLTRAIIKDFVILKGPCPNCGHENTSFFGTILSISSGGSNNKVKCSDCGTEMVYDSSTRLITLPEGSNA

SEQ ID NO: 11510 - protein, 319 aa, Medicago truncatula
MFTATKVAFTLAPPRPCSAPPTPFIPFSFSSVSPPHLNSRHLCLRRRLFLLSPKATADQQGNVGDFDGDAVIDTNVLPYCSIDQKKEKKSVGELEQEFLQALQSFYYEGKAIMSNEEFDNLKEELMWEGSSVVMLSSDEQKFLEASMAYVSGNPILTDKEYDKLKLNLKREGSEIVVEGPRCSLRSKKVYSDLSVDYLRMFLLNVPATVVALGLFFFLDDLTGFEITYLLELPEPFSFIFTWFAAVPLIVYLALSLTRAIIKDFVILKGPCPNCGTENTSFFGTILSISSGGSNNKVKCSDCGTEMVYDSGTRLITLPE

SEQ ID NO: 11511 - protein, 209 aa, Tripterygium wilfordii
MKNFDNLKEELMWEGSSVVMLSSDEQKFLEASMAYVAGNPIMSDGDYDKLKMRLKTGGSEIVAEGPRCSLRSRKVYSDLYVDYFKMFLLNVPATVVALGLFFFLDDLTGFEITYLLELPEPFSFIFTWFAAVPAIFWLAQLLTKLIVKEFLILKGPCPNCGTENVSFFGTILSVSNGGSTNNLKCSNCGTELVYDSSTRLITLPEGSEA

SEQ ID NO: 11512 - protein, 327 aa, Arachis hypogaea
MASKLLAFALAHPRAPTPTPLIPISSTSSSSSANFGAHHLVQVSGRHLCLRRRLLMLSPKATADQQQGKVEENDGVDDDGKILQYCSIDKKKRSVGEMEQEFLQALQAFYYEGKAIMSNEEFDNLKEELMWEGSSVVMLSSDEQKFLEASMAYVSGKPILSDKEFDQLKLRLKMEGSEIVAEGPRCSLRSRKVYSDLSVDYLKMFLLNVPATVVALGLFFFLDDLTGFEITYLLELPEPFSFIFTWFAAVPLIVWLAQSLTSAIIKDSLILKGPCPNCGTENTSFFGTILSISSGDSTNKVKCENCGTALVYDSTTRLITLPEGSSS

SEQ ID NO: 11513 - protein, 332 aa, Glycine max
MFTASKLAFTLTPPRPCTAPLTPISSLSSSSSSSSASASGINFIQFNGRHLCLRRRLFLLSPKATADQQGKVEEFEDDSNVVDSKILPYCSIDKKEKKSIGELEQEFLQALQAFYYEGKAIMSNEEFDNLKEELMWEGSSVVMLSSDEQKFLEASMAYVSGNPIMSDKEFDELKLRLKKEGSEIVAEGPRCSLRSKKVYSDLSVDYLKMFLLNVPATVIALGLFFFLDDLTGFEITYLLELPEPFSFIFTWFAAVPLIVWIALSLTNAIVKDFVILKGPCPNCGTENTSFFGTILSISNGGSTNTVKCSNCGTAMEYDSTSRLITLPEGSNA

SEQ ID NO: 11514 - protein, 284 aa, Brassica napus
MGSAQPWEIGSLEKSFFLLPSKATTEQPGQAGGEDVDSNIMPYCSINKAEKKTIGEMEQEFLQAMQSFYYDGKAIMSNEEFDNLKEELMWEGSSVVMLSSDEQRFLEASMAYVSGNPILNDQEFDQLKLKLKMDGSEIVCEGPRCSLRSKKVYSDLAVDYFKMLLLNVPASVVALGLFFFLDDITGFEITYILELSEPFSFIFTWFAAVPLIVYLASSITKLIIKDFLILKGPCPNCGTENVSFFGTILSISSGGKTNNVKCTNCGTAMEYDSGSRLITLPEAS

SEQ ID NO: 11515 - protein, 325 aa, Castanea mollissima
MAAKLAITSTSPQLHTAPIKRPLVPISSFVSSLSSYTRAQTVQFNGRHLCLRRRVMVLPTKATADQQDQVEGSDVVDGKILPYCSIDKEKKSIGELEQEFLLALQSFYYEGKAIMSNEEFDNLKEELMWEGSSVVMLSSDEQKFLEASMAYVAGKPIMSDEEYDKLKLRLKSEGSEIVVEGPRCSLRSKKVYSDLSVDYLRMFLLNVPATVVALGLFFFLDDITGFEITYLLELPEPFSFIFTWFAAVPLLVWLALSLTNVIVKDFLILKGPCPNCGTENTSFFGTILSISSGGTTNSVKCTNCGTAMVYDSNTRLITLPEGSNA

SEQ ID NO: 11516 - protein, 286 aa, Raphanus sativus
MVSAHPGPGRSVPLRKRFFLLPAKATTEQSGQVGGEDVDSNIMPYCSINKAEKKSIGEMEQEFLQAMQSFYYDGKAIMSNEEFDNLKEELMWEGSSVVMLSSDEQRFLEASMAYVSGNPILNDEEFDNLKLKLKMDGSEIVCEGPRCSLRSKKVYSDLAVDYFKMLLLNVPASVVALGLFFFLDDITGFEITYILELSEPFSFIFTWFAAVPLIVYLASTITKLIIKDFLILKGPCPNCGTENVSFFGTILSISSGGKTNNVKCTNCGTAMEYDSGSRLITLPEGS

SEQ ID NO: 11517 - protein, 321 aa, Glycine max
MFTASKLAFTLTPPRPCTAPLTPISSASGVHLIQFNGRHLCLRQRLFLLSPMATADQQGKVEEFEDDSNTVDSKILPYCSIDKKEKKSIGELEQEFLQALQAFYYEGKAIMSNEEFDNLKEELMWEGSSVVMLSSDEQKFLEASMAYVSGKPIMSDKEFDELKLRLKIEGSEIVAEGPRCSLRSRKVYSDLSVDYLKMLLLNVPATVIALGLFFFLDDLTGFEITYLLELPEPFSFIFTWFAAVPLIVWIALSLTNAIVKDFVILKGPCPNCGTENTSFFGTILSISNGGSTNTVKCSNCGTAMEYDSTTRLITLPEGSNA

SEQ ID NO: 11518 - protein, 323 aa, Malus domestica
MATKLGFTLTSTTPFNPSIQRPFVSVSSSSSTRVESFQISGRQLCLHLRRRRLLVLPAKATADQQGKVEKDDVVDSKILPYCSIDKKKKSLGELEQDFLQALQSFYYDGKAIMSNEEFDNLKEELMWEGSSVVMLSSDEQKFLEASMAYVSGKPILTDQEYDDLKMRLKTEGSDIVVEGPRCSLRTRKVYSDLSVDYLKMFLLNVPATVVALAAFFFLDDLTGFEITYLLELPEPFSFIFTWFAAVPAIVYLAQALTKLIIKDVLILKGPCPNCGTENLSFFGTILSISNGGSTNNIKCSNCGTPLVYDSKSRLITLPDGSNA

SEQ ID NO: 11519 - protein, 327 aa, Citrus clementina
MASKVASGFTPQAQRVFAVPVQKPAAALVPFSSSSRAHSNSNTQFSGRQFSVRRRSFVLPSKATTDQQGQVEGDEVVDSKILQYCSIDKKEKKSLGELEQEFLQALQAFYYEGKAVMSNEEFDNLKEELMWEGSSVVMLSSAEQKFLEASMAYVAGKPIMSDEEYDKLKQKLKMDGSEIVVEGPRCSLRSRKVYSDLSVDYLKMLLLNVPATVVALGLFFFLDDITGFEITYLLELPEPFSFIFTWFAAVPLIVYLSQSLTKLIVRESLILKGPCPNCGTENVSFFGTILSISSGGTTNTINCSNCGTTMVYDSNTRLITLPEGSEA

SEQ ID NO: 11520 - protein, 325 aa, Euonymus alatus
MAHKLAFTMSSTRLFSAPIQKPLFCVSSSSPCSSSRVQPSHLNGRKFCHRRRMFVLPIKATADQQGKVVEGDEAIDGRILPYCSIDKKNKKTLGEMEQEFLQALQAFYYEGKAIMSNEEFDNLKEELMWEGSSVVMLSSDEQKFLEASIAYVSGNPIMSDQDYDKLKMKLKTEGSEIVVEGPRCSLRSKKVYSDLYVDYFKMLLLNVPASVVALGLFFFLDDLTGFEITYLLELPEPFSFIFTWFAAVPAIVWSAQSLTKLIVKDFLILKGPCPNCGTENVSFFGTILSVSSGGSTNKIKCSNCETQMVYNSSTRLITLPEGSEA

SEQ ID NO: 11521 - protein, 276 aa, Tripterygium wilfordii
LRRRVFVLPIKATADQQGKVEEEDTVDSKILPYCSIDKKDKKSLGEMEQEFLQALQAFYYEGKAIMSNEEFDNLKEELMWEGSSVVMLSSDEQKFLEASMAYVAGKPIMSDKDFDQLKLKLKTEGSEIVVEGPRCSLRSRKVYSDLYVDYFKMFLLNVPATVVALGLFFFLDDLTGFEITYLLELPEPFSFIFTWFAAVPAIFWIAQVLTKLIVKDFLILKGPCPNCGTENVSFFGTILSVSSGGSTNNLKCSNCGTELVYSSSTRLITLPEGSEA

SEQ ID NO: 11522 - protein, 327 aa, Lotus japonicus
MFTASKLAFTLTSPRSCTPPTPTPLIPLSSSSFTSSRFNLIQFNGRQLCLRRRLFLLSPKATADQQGKVEEFEEGAVDSKILPYCSIDKKDKKSVGEMEQDFLQALQSFYYEGKAIMSNEEFDNLKEELMWEGSSVVMLSSDEQKFLEASMAYVSGKPILSDKEYDDLKMRLKMNGSEIVVEGPRCSLRSRKVYSDLSVDYLKMFLLNVPATVIALGLFFFLDDLTGFEITYLLELPEPFSFIFTWFAAVPLIVWLALTITNVIIKDFLILKGPCPNCGTENTSFFGTILSIASGGSSNKVKCSNCGTEMVYDSATRLITLPEGSNA

SEQ ID NO: 11523 - protein, 324 aa, Cajanus cajan
MFTASKLAYITLPPPPPCTAPFIPISSLSSSSAVHFIQFNGRHLCLRRRLFLLSPKATADQQGKVEEFEEDAVVDSKILPYCSIDKKEKKSIGELEQEFLQALQAFYYEGKAIMSNEEFDNLKEELMWEGSSVVMLSSDEQKFLEASMAYVSGNPIMSDKEYDELKLRLKMEGSEIVVEGPRCSLRSRKVYSDLSVDYLKMFLLNVPATVIALGLFFFLDDLTGFEITYLLELPEPFSFIFTWFAAVPLIVWIALSLTNAIVKDFVILKGPCPNCGTENTSFFGTILSISSGGSTNSVKCSDCGTEMVFDSTTRLITLPEGSNA

SEQ ID NO: 11524 - protein, 327 aa, Citrus sinensis
MAGKVASGFTPQAQRVFAVPVQKPAAALAPFPSSSRAHSNSNTQFNGRQFTVRRRSFVLPSKATTDQQGQVEGDEVVDSKILQYCSIDKKEKKSLGELEQEFLQALQAFYYEGKAVMSNEEFDNLKEELMWEGSSVVMLSSAEQKFLEASMAYVAGKPIMSDEEYDKLKQKLKMEGSEIVVEGPRCSLRSRKVYSDLSVDYLKMLLLNVPATVVALGLFFFLDDITGFEITYLLELPEPFSFIFTWFAAVPLIVYLSQSLTKLIVRESLILKGPCPNCGTENVSFFGTILSISSGGTTNTINCSNCGTTMVYDSNTRLITLPEGSEA

SEQ ID NO: 11525 - protein, 282 aa, Brassica juncea
QLSPGRSVPLRKRFFLLPAKATAEQSGQAGGEDVDSNIMPYCSINKAEKKSIGEMEQEFLQAMQSFYYDGKAIMSNEEFDNLKEELMWEGSSVVMLSSDEQRFLEASMAYVSGNPILNDKEFDQLKLKLKMDGSEIVSEGPRCSLRSKKVYSDLAVDYFKMLLLNVPASVVALGLFFFLDDITGFEITYILELSEPFSFIFTWFAAVPLIVYLASQITKLIIKDFLILKGPCPNCGTENVSFFGTILSISSGGKTNNVKCTNCGTAMEYDSGSRLITLPEGS

SEQ ID NO: 11526 - protein, 326 aa, Phaseolus coccineus
MFTASKLAFMLTLPRPCTAPLTPISSLSSSSPSGIHLIHFNGRHLCLRRRLFLLSPKATADQQGRVGDFEDDANTVDSKILPYCSIDKKEKKSIGELEQDFLQALQAFYYEGKAIMSNEEFDNLKEELMWEGSSVVMLSSDEQKFLEASMAYVSGKPIMNDKEFDELKLRLKIEGSEIVAEGPRCSLRSRKVYSDLSVDYLKMLLLNVPATVIALGLFFFLDDLTGFEITYLLELPEPFSFIFTWFAAVPLIVWIALTLTNAIVKDFVILKGACPNCGTENTSFFGTILSISNGGSTNTVKCSNCGTAMEYDSTTRLITLPEGSNA

SEQ ID NO: 11527 - protein, 320 aa, Ricinus communis
MASKLAFSLTFPRVYSAPILKPLISLSSSSRIHSSHLHGKHLSVRRRILLLPIKATADQQQGKVEGDEVVDGKILQYCSIDKKDKKSIGEMEQEFLQALQAFYYEGKAIMSNEEFDNLKEELMWEGSSVVMLSCDEQKFLEASMAYVSGNPIMSDEEFDQLKLRLKQEGSEIVVEGPRCSLRSRKVYSDLSVDYLKMFLLNVPAAVVALGLFFFLDDLTGFEITYLLELPEPFSFIFTWFAAVPVIVWLSLSFTNAIVKDFLILKGPCPNCGTENQSFFGTILSISSGGTTNSVKCSNCGTDMVYDSKTRLITLPEGSNA

SEQ ID NO: 11528 - protein, 327 aa, Citrus sinensis
  misc_feature (46)..(46): Xaa can be any naturally occurring amino acid
MASKVASGFTPQAQRVFAVPVQKPAAALVPFSSSSRAHSNSNTQFXGRQFSVRRRSFVLPSKATTDQQGQVEGDEVVDSKILQYCSIDKKEKKSLGELEQEFLQALQAFYYEGKAVMSNEEFDNLKEELMWEGSSVVMLSSAEQKFLEASMAYVAGKPIMSDEEYDKLKQKLKMEGSEIVVEGPRCSLRSRKVYSDLSVDYLKMLLLNVPATVVALGLFFFLDDITGFEITYLLELPEPFSFIFTWFAAVPLIVYLSQSLTKLIVRDSLILKGPCPNCGTENVSFFGTILSISSGGTTNTINCSNCGTTMVYDANTRLITLPEGSEA

SEQ ID NO: 11529 - protein, 326 aa, Quercus alba
MAAKLAITSTSPQLHTAPIKRPLVPISSFVSSLSSYTRAQTVQFNGRHLCLRRQVLVLPTKATADQQDQVEGSDVVDGKILPYCSIDKKEKKSIGELEQEFLLALQSFYYEGKAIMSNEEFDNLKEELMWEGSSVVMLSSDEQKFLEASMAYVAGKPIMNDKEYDNLKLRLKSEGSEIVVEGPRCSLRSKRVYSDLSVDYLRMFLLNVPATVVALGLFFFLDDITGFEITYLLELPEPFSFIFTWFAAVPLLVWLALSLTNVIVKDFLILKGPCPNCGTENTSFFGTILSISSGGTTNSVKCTNCGTEMVYDSNTRLITLPEGSNA

SEQ ID NO: 11530 - protein, 323 aa, Fragaria vesca
MASKLAFTLVAPTRSTTTTTNPSIQRPFVSVSSSSTRVQSFQFGGRQLCVRRRLLVIPSKAAADKQQGNEDVVDGNVLPYCSIDKKQKKSLGEMEQDFLQALQSFYYDGKAIMSNEEFDILKEELMWEGSSVVMLSSDEQKFLEASMAYVSGKPILSDKEFDELKMRLKEQGSDIVVEGPRCSLRTRKVYSDLSVDYLKMLLLNVPATVVALGLFFFLDDLTGFEITYLLELPEPFSFIFTWFAAVPVIVYLATQLTKLIVKDVLILKGPCPNCGTENQSFFGSILSISNGGTTNNLKCSNCGTALVYDKTTRLITLPEGSNA

SEQ ID NO: 11531 - protein, 336 aa, Eucalyptus grandis
MATTKLGATLTCHRLFTRPARKPSIAFGSSVPGAASCSSSSSRARPFDGRQLGVRGRVLVIPVKATADQQGKVEEGKVEEGESDVEDSNVLPYCSIDKKEKKSIGELEQDFLQAMQAFYYEGKAVMSNEEFDNLKEELMWEGSSVVMLSSAEQKFLEASMAYVSGNPIMSDQEYDDLKLKLKTEGSEIVVEGPRCSLRSRKVYSDLSVDYFKMLLLNVPATVVALGLFFFLDDITGFEITYLLELPEPYSFIFTWFAAVPVIVWLALSLTNVIVKDSLILKGACPNCGTENVSFFGTILSISNGGTTNNIKCSNCGTELVYDKKTRLITLPEGSQA

SEQ ID NO: 11532 - protein, 341 aa, Vigna unguiculata
TALFSFTATTTITMFTASKLAFILTLPRPCSAPFAPIPSLSPSSSSPSGVHLIHFNGRHSCLRRRLFLLSPKATADQQGKVSEFEEDGNIVDGKILPYCSIDRKEKKSIGELEQDFLQALQSFYYEGKAIMSNEEFDNLKEELMWEGSSVVMLSSDEQKFLEASMAYVSGNPIMTDKEFDELKMRLKIEGSEIVAEGPRCSLRSRKVYSDLSVDYLKMLLLNVPATVIALGLFFFLDDLTGFEITYLLELPEPFSFIFTWFAAVPLIVWIALNLTNAIVKDFVILKGPCPNCGTENTSFFGTILSISNGGSTNTVKCNNCGTTMEYDSTTRLITLPEGSNA

SEQ ID NO: 11533 - protein, 249 aa, Salvia sclarea
SNVLPYCSLDKKQKRTLGEMEQEFLQALQAFYYEGKSVMSNEEFDVLKEELMWEGSSVVMLSADEQRFLEASMAYVSGNPIMSDEEYDKLKQQLKIDGSEIVVEGPRCSLRSKKVYSDLSVDYLKMFLLNVPAAVVALGLFFFLDDLTGFEITYLLELPEPFSFIFTWFAALPLILYLAFTFTNIIIKDFLILVGPCPNCGTENTSFFGTILSISNGGTINKVKCSNCGTDMVYDSKSRLITLPEGSEA

SEQ ID NO: 11534 - protein, 211 aa, Cucurbita pepo
MSNEEFDNLKEELMWEGSSVVMLSSDEQKFLEASMAYVSGNPILTDKEFDELKMRLKMEGSEIVAEGPRCSLRSRKVYSDLSVDYFRMFLLNVPATVVALGLFFFLDDITGFEITYLLELPEPFSFIFTWFAAVPFLVWLALTLTNAVVRDSLILKGPCPNCGTENVSFFGTILSVSSGGKTNNLKCSNCSTELVYDSKTRLITLPEGSNA

SEQ ID NO: 11535 - protein, 213 aa, Scabiosa columbaria
AIMSNEEFDNLKEELMWEGSSVVMLSSDEQKFLEAAMAYVTGKPIMTDAEYDKLKMQLKMDGSDIVAEGPRCSLRSRKVYSDLYVDYLKMFLLNVPAAVVALSLFFFLDDLTGFEITYLLELPEPFSFIFTWFAAIPLILYLSFSITNVVIKDFLILKGPCPNCGTENTSFFGTILSISSGGSTNTIKCSNCGTAMVYDSSKRLITLPEGSSA

SEQ ID NO: 11536 - protein, 324 aa, Manihot esculenta
MATKLAFSLTSPRVSSAPLRKPFSSLSSSPCSSSSRVQSIQLIGRHFSVRRRIFLLPIKATADQQGQVEENEVVDSKILQYCSIDKKDKKSIGEMEQEFLQALQAFYYEGKAIMSNEEFDNLKEELMWEGSSVVMLSSDEQKFLEASMAYVSGKPILSDEEFDNLKLRLKQEGSEIVVEGPRCSLRSRKVYSDLSVDYLKMFLLNVPATVVALGLFFFLDDLTGFEISYLLELPEPFSFIFTWFAAVPLIVWLSQSFTNAIVKDFLILKGPCPNCGTENQSFFGTILSVSSGGTTNNVKCSNCGTDMVYDSKTRLITLPEGSSA

SEQ ID NO: 11537 - protein, 113 aa, Rhizophora mangle
MASKLALTLTSPRASFTAPIPKPSSSVPSSSSAPFSSLTKVQFNGRQPCLRRRMFLLPVKATADQQGQVKKDEIVDSNVLQYCSIDKKKRSLWVKWSKSFFKLYRHSITREKL

SEQ ID NO: 11538 - protein, 302 aa, Thellungiella halophila
  misc_feature (233)..(233): Xaa can be any naturally occurring amino acid
  misc_feature (280)..(280): Xaa can be any naturally occurring amino acid
MGSKTLFSLTSPRLFSAVSRKPTVSFSPPSSSRSQWAQLSPGRSISLRRRFFLLPAKATTEQSGQVEGEEVDSNINAYCSINKAQKKSIGEMEQEFLQALQSFYYDGKAIMSNEEFDNLKDELMWEGSSVVMLSSDEQRFLEASMAYVSGNPILNDEEYDKLKLKLKMDGSDIVCEGPRCSLRSKKVYSDLAVDYFKMLLLNVPATVVALGLFFFLDDITGFEITYILELPEXFSFIFTWFAAVPLIVYLALSITKLIIKDFLILKGPCPNCGTENVSFXGTILTISSGGKTNAVKCSNNGV

SEQ ID NO: 11539 - protein, 329 aa, Juglans hindsii x Juglans regia
  misc_feature (55)..(55): Xaa can be any naturally occurring amino acid
  misc_feature (162)..(163): Xaa can be any naturally occurring amino acid
  misc_feature (176)..(177): Xaa can be any naturally occurring amino acid
  misc_feature (180)..(180): Xaa can be any naturally occurring amino acid
MATKLAFTLSSPSLHPPSVRRPLSPISSSVSSLSSSIRFQSVLFNGRHIRLRRRXLVLPTQATADQQDQVEGAQGGEVVDSKILPYCSIDKKEKKSVGELEQEFLQALQAFYYEGKAIMSNEEFDNLKEELMWEGSSVVMLSSDEQKFLEASMAYVAGKPIXXDEEYDQLKLRLKXXGSXIVVEGPRCSLRSRKVYSDLSVDYLKMLLLNVPATVVALGLFFFLDDLTGFEITYLLELPEPFSFIFTWFAAVPLLVWLALSLTNVIVKDFLILKGPCPNCGTENGSFFGTILSISSGGTTNTLKCSNCETALVYDSKTRLITLPEGSNA

SEQ ID NO: 11540 - protein, 322 aa, Cannabis sativa
MASKLAFTLTSPRRPFTTIIQRPFAPLSSSSTTKVQSFHFTGRQLCLRRRLSVIPSKATADQEGKVEEDGVVDSKILPYCSIDKKEKKSLGELEQDFLLALQSFYYEGKAIMSNEEFDNLKEELMWEGSSVVMLSGDEQRFLEASMAYVSGNPIMSDEDYDKLKLRLKSQGSDIVVEGPRCSLRSKKVYSDLSVDYLKMFLLNVPATVIALGLFFFLDDVTGFEITYLLELPEPYSFIFTWFAAVPLIVWLAQTLTNAIVKDFLILKGPCPNCGTENTSFFGTILSISNGGTSNTVKCSNCSTEMVYDSNSRLITLPEGSNA

SEQ ID NO: 11541 - protein, 322 aa, Citrullus lanatus
MATKLTLSLPSSSSLTVPIQNQKPAASLLSPSSRSQLVRASSRRLFLRRRLVLPPPRAATDQPGQVEGDEVVDSNVLQYCSIDKKEKKSIGELEQEFLQALQAFYYEGKAIMSNEEFDNLKEELMWEGSSVVMLSSDEQKFLEASMAYVSGTPIMTDKEFDELKLRLKMEGSEIVVEGPRCSLRSRKVYSDLSVDYFKMFLLNVPATVVALGLFFFLDDITGFEITYLLELPEPFSFIFTWFAAVPFLVWLALTLTNAVVRDSLILKGPCPNCGTENISFFGTILSVSSGGNINNIKCSNCATELVYNSKTRLITLPEGSNA

SEQ ID NO: 11542 - protein, 318 aa, Theobroma cacao
MAGKLTFSLTPPRLFTAPFQKPLVPFSSSSSTRVQSNGKQLCVRRRLFLLPTKATADQQGQLGEDEVVDSKILPYCSIDKKEKKSLGEMEQEFLQALQAFYYEGKAIMSNEEFDNLKEELMWEGSSVVMLSSDEQKFLEASMAYVSGKPILSDEEFDKLKQRLKMEGSEIVVEGPRCSLRTRKVYSDLSVDYLKMFLLNVPATVVALGLFFFLDDLTGFEITYILELPEPFSFIFTWFAAVPALVWLAQALTKVVVKDSLILKGPCPNCGTENVSFFGTILSVSSGGTTNNLKCSNCGTPLVYDSNTRLITLPEGSEA

SEQ ID NO: 11543 - protein, 327 aa, Gossypium hirsutum
MASKLAFTLMPPRFFTATIQKPVVCFSSSSSSSSSSSSSSTRVQPSGKHLCFRRRLLLLPLKATADQQGQVEGDEVVDSKILPYCSIDKKEKKSLGEMEQEFLQALQAFYYEGKAIMSNEEFDNLKEELMWEGSSVVMLSSDEQKFLEASMAYVSGKPILSDEEFDELKMRLKMEGSEIVVEGPRCSLRSRKVYSDLSVDYLKMFLLNVPATVVALGLFFFLDDLTGFEITYLLELPEPFSFIFTWFAAVPLIVYLAQSLTKVVVKDSLILKGPCPNCGTENVSFFGTILSISSGGTTNTLKCSNCETTLEYNAKTRLITLPEGSQA

SEQ ID NO: 11544 - protein, 325 aa, Ipomoea nil
MATKLVYSLTTPRFLHASFKRPFISAPSASLPSASRLPLIYFAGRKISVRRRFLVLCPKATTDQPGQVQEDEVEVDSNVLPYCSIDRKEKKSLGEMEQDFLQALQAFYYEGKAIMSNEEFDNLKEELMWEGSSVVMLSADEQRFLEASMAYVAGTPIMSDKEFDKLKMKLKMDGSDIVVEGPRCSLRSRKVYSDLSVDYLKMFLLNVPAAVVALGLFFFLDDLTGFEITYLLELPEPFSFIFTWFAALPFILWLSFSITGFIVKDFLILKGPCPNCGTENTSFFGTILSVSSGGSSNNVKCTNCGTDMVYDSSTRLITLPEGSSA

SEQ ID NO: 11545 - protein, 323 aa, Cucumis melo
MATKLTLSLPSSSSLAVPFQNQKPAVPLLPSSSRSSSQLIRVSSRRLFLRRKVVLPPPRATTDQPGQVEGDEVVDSNVLRYCSIDKEKKTIGELEQEFLQALQAFYYEGKAIMSNEEFDNLKEELMWEGSSVVMLSSDEQKFLEASMAYVSGNPIMTDKEFDDLKLRLKMEGSEIVVEGPRCSLRSRKVYSDLSVDYFKMFLLNVPATVVALGLFFFLDDITGFEITYLLELPEPFSFIFTWFAAVPFLVWLALTLTNAVVRDSLILKGPCPNCGTENVSFFGTILSVSSGGNTNNIKCTNCGSELVYNSKTRLITLPEGSNA

SEQ ID NO: 11546 - protein, 186 aa, Raphanus sativus
DEQRFLEASMAYVSGNPIMTDEEYDKLKMKLKMDGSEIVCEGPRCSLRSKKVYSDLAVDYFKMFLLNVPATVVALGLFFFLDDLTGFEITYLLELPEPFSFIFTWFAAVPAIVYLALSLTKLIIRDSLILKGPCPNCGTENTSFFGTILSISNDGSTNNVKCSGCGTAMVYDSSTRLITLPEGGNA

SEQ ID NO: 11547 - protein, 326 aa, Amsonia hubrichtii
MATKLGFTITIPRVYSAPFKKPFISVSFSPLLQSSASKVQPFCFNGGKLPIQRKLLLLSPKATTDQPGQVKKDEVEDSNIMPYCSIDRKQKKSLGEMEQDFLQALQAFYYEGKAIMSNEEFDNLKEELMWEGSSVVMLSADEQRFLEASMAYVSGKPIMSDEEYDKLKMQLKMDGSDIVFEGPRCSLRSRKVYSDLSVDYLKMFLLNVPAAVVALGLFFFLDDLTGFEITYLLELPEPFSFIFTWFAALPFILWLSFTLTRIVVKDFLILKGPCPNCGTENTSFFGTILSISSGGSINSVKCSNCGTDMVYDSTTRLITLPEVGKA

SEQ ID NO: 11548 - protein, 322 aa, Humulus lupulus
MASKLAFTLTSPRRPFTTIIQRPFAPISSSSSTKVQSFHFTGRQLCLRRRLSVIPNKATADQEGKVEEDEIVDSKILPYCSLDKKGKKSLGELEQDFLLALQSFYYEGKAIMSNEEFDNLKEELMWEGSSVVMLSGDEQRFLEASMAYVSGNPIMSDEDYDKLKITLKSQGSDIVVEGPRCSLRSKKVYSDLSVDYLKMFLLNVPATVIALGLFFFLDDVTGFEITYLLELSEPYSFIFTWFAAVPLLVWLALTLTNAIVKDFLILKGPCPNCGTENTSFFGTILSISSGGTTNTVKCSNCATEMVYDANTRLITLPEGSNA

SEQ ID NO: 11549 - protein, 322 aa, Humulus lupulus
MASKLAFTLTSPRRPFTTIIQRPFAPISSSSSTKVQSFHFTGRQLCLRRRLSVIPNKATADQEGKVEEDEIVDSKILPYCNIDKKGKKSLGELEQDFLLALQSFYYEGKAIMSNEEFDNLKEELMWEGSSVVMLSGDEQRFLEASMAYVSGNPIMSDEDYDKLKITLKSQGSDIVVEGPRCSLRSKKVYSDLSVDYLKMFLLNVPATVIALGLFFFLDDVTGFEITYLLELSEPYSFIFTWFAAVPLLVWLALTLTNAIVKDFLILKGPCPNCGTENTSFFGTILSISSGGTTNTVKCSNCATEMVYDANTRLITLPEGSNA

SEQ ID NO: 11550 - protein, 319 aa, Solanum lycopersicum
MATKFGFTITTSSRLFHATFRKKTIFSPNSVSPLINFGGRKLSIRRRLLVLSPKATADQPGQLREDEIEDSKILQYCSIDGKGKKSLGEMEQEFLQALQSFYYEGKAMMSNEEFDNLKEELMWEGSSVVMLSPDEQRFLEASMAYVSGNPIMTDKEYDKLKMKLKRDGSDIVVEGPRCSLRSRKVYSDLSVDYLKMFLLNVPAAVVALGLFFFLDDLTGFEITYLLELPEPFSFIFTWFAALPLILWLSFTITNAIVKDFLILKGPCPNCGTENTSFFGTILSVSNGGSSNKVKCSGCGTDLVYDSETRLITLPEGSSA

SEQ ID NO: 11551 - protein, 248 aa, Solanum melongena
KILQYCNLDRKQKKSMGEMEQEFLQALQAFYYEGKAIMSNEEFDNLKEELMWEGSSVVMLSADEQRFLEASMAYVSGNPIMTDKEFDKLKLKLKMDGSEIVAEGPRCSLRSRKVYSDLYVDYLKMFLLNVPAAVVALGLFFFLDDLTGFEITYLLELPEPFSFIFTWFAALPFILWLSFTITNIIIKDFLILKGPCPNCGTENTSFFGTILSISSGGKTNKVKCTNCATEMVYDSATRLITLPEGSSA

SEQ ID NO: 11552 - protein, 309 aa, Lotus japonicus
MASKLASTLTYQRPFTATTQPTSSISTPRAHLVQFNGRRNVCLRRRRLLLLSPKASADQQGKVEKDAVDSIKEKKSIGELEQDFLQALQAFYYEGKAIMSNEEFDNLKEELMWEGSSVVMLSSDEQKFLEAAMGYVSGKPIMSDKEYDELKLRLKMEGSEIVAEGPRCSIRSRKVYSDLSIDYLKMFLLNVPATVVALGLFFFLDDVTGFEINSLIEIPEPYSFILTWFAAVPFIVWLAQSITNAIINDFLILKGPCPNCGTENTSFFGTILSISSGNSTNKVKCVNCGTAMVYDSSTRLITLPEGSNA

SEQ ID NO: 11553 - protein, 319 aa, Capsicum annuum
MATKFGLTVTTNTHLFHAPFRKKPSFSPSSKVQLISFGGRKLSIRRKLLVLSPKGTNDQPGQVKDDEIEDRKILQYCSIDRKGKKSLGEMEQEFLQALQSFYYEGKAMMSNEEFDNLKEELMWEGSSVVMLSPDEQRFLEASMAYVSGNPIMTDKEYDKLKMKLKRDGSDIVVEGPRCSLRSRKVYSDLSVDYLKMFLLNVPAAVVALGLFFFLDDLTGFEITYLLELPEPFSFIFTWFAALPFILWLSFTITNAIVKDFLILKGPCPNCGTGNTSFFGTILSVSNGGSSNNVKCSGCGTDMIYDSETRLITLPEGSSA

SEQ ID NO: 11554 - protein, 327 aa, Populus trichocarpa
MASKLAFNLTSPRVFTAPIQKPIISSSSSLPSLSSPSCSTRVQLNGKQFSLRGRMLFLPTKATADQQTDQVQEDDMDDGKILQYCSIDKKGKKSLGEMEQDFLQALQAFYYEGKAIMSNEEFDNLKEELMWQGSSVVMLSSDEQKFLEASLAYVSGNPIMNDEEFDKLKIKLKTEGSEIVVEGPRCSLRSRKVYSDLSVDYLKMFLLNVPATVVALGLFFFLDDLTGFEITYLLELPEPFSFLFTWFAAVPLIVWLALTLTNAIVKDFLILKGPCPNCGTENGSFFGTILSISSGGASNTLKCSNCSTELVYDSKTRLITLPEGSEA

SEQ ID NO: 11555 - protein, 321 aa, Prunus persica
MATKLAFTLTSPTPFNPSSQRPFVSVSSPSTRVESFQFRGRQLCLRRRLLVLPSKATADQRQDKVEDEEVFDGKILQYCSIDKKGKKSLGELEQDFLQALQSFYYDGKAIMSNEEFDNLKEELMWEGSSVVMLSSDEQKFLEASMAYVSGKPILTDEEYDKLKMRLKTEGSDIVVEGPRCSLRTRKVYSDLSVDYLKMLLLNVPATVVALAAFFFLDDVTGFEITYLLELPEPYSFIFTWFAAVPVIVYLAQALTKLIVKDVLILKGPCPNCGTENVSFFGTILSISNGGATNTIKCSNCGTPLVYDSNTRLITLPEGSNA

SEQ ID NO: 11556 - protein, 211 aa, Nicotiana tabacum
MSNEEFDNLKEELMWEGSSVVMLSTDEQKFLEASMAYVSGNPIMTDKEYDKLKMKLKRDGSDIVVEGPRCSLRSRKVYSDLSVDYLKMFLLNVPAAVVALGLFFFLDDLTGFEITYLLELPEPFSFIFTWFAALPLILYLSFTITNIVVKDFLILKGPCPNCGTENTSFFGTILSISSGGSTNKIKCSGCGTDLVYDSDTRLITLPEGSTA

SEQ ID NO: 11557 - protein, 224 aa, Chelidonium majus
MALQSFYYEGKAVMSNEEFDNLKEELMWEGSSVVMLSSSEQKFLEASMAYVSGKPILSDKEYDQLKLQLKMDGSEIVVEGPRCSLRSRKVYSDLTVDYFKMFLLNVPAAVVALGLFFFLDDITGFEITYLLELPEPFSFIFTWFAALPLIFYLAQSITNVIVKDFLILKGACPNCGTENVSFFGTILSISSGGKTNKVKCSNCGTALEFDSRTRLITLPEPAEA

SEQ ID NO: 11558 - protein, 323 aa, Lippia dulcis
MASKLGSTVAKPRFFAAHGRKPFFSVSSLPSLAPGVQSVKFGAKKLSFRRRLLVISPKATTDQSGQFQEDEVVDSNVLPYCSIDQKQKKSLGEMEQEFLQALQAFYYEGKSIMSNEEFDNLKEELMWEGSSVVMLSADEQRFLEASMAYVSGNPIMSDEEFDKLKQKLKMDGSEIVVEGPRCSLRSKKVYSDLSVDYLKMFLLNVPAAVVALGLFFFLDDLTGFEITYLLELPEPFSFIFTWFAALPFILWLSFTITNVIIKDFLILVGPCPNCGTENTSFFGTILSVSSGGSVNTVKCANCGTDMIYDSKTRLITLPEGKAA

SEQ ID NO: 11559 - protein, 323 aa, Lippia dulcis
MASRLGCNLSKPNLFTAQIRKPFFSASSLPSPAPGVHSLQFAAKKLTFQRRLLVISPQATSEQPGQVQEDEVIDSNVLPYCTLDKKQKKTIGEMEQEFLQALQAFYYEGKSIMSNEEFDNLKEELMWEGSSVVMLSADEQRFLEASMAYVSGNPILSDEEYDKLKKQLKIDGSEIVVEGPRCSLRSKKVYSDLSVDYLKMFLLNVPAAVVALVLFFFLDDLTGFEITYLLELPEPFSFIFTWFAALPLILWLSFTFTNIIVKDFLILVGPCPNCGTENTSFFGTILSISSGGATNKVKCSNCGTDMVYDSKSRLITLPEGSEA

SEQ ID NO: 11560 - protein, 240 aa, Gossypium hirsutum
MEQEFLQALQAFYYEGKAIMSNEEFDNLKEELTWEGSSVVMLSSDEQKFLEASMAYVSGKPILNDEEFDGLKLGLKMEGSEIVVEGPRCSLRSRKVYSDLSVDYLKMVLLNVPATVVALGLFFFLDDLTGFEITYVLELPKPFSFIFTWFAAVPLIVWLAQSLTKLVVKDSLILKGLCPNCGTENVSFFGTILSISNGGTTNTLKCSNCGTPLEYNSKTRLITLPEGTLSLISRQCNSPF

SEQ ID NO: 11561 - protein, 318 aa, Heritiera littoralis
MASKLAFTLTPPRLFTAPIQKPLIIFSSSSSSRVQSNGKQLCFRRRWFLLPIKATADQQGQVGEDDVVDSKILPYCSLDRKEKKSLGEMEQEFLQALQAFYYEGKAIMSNEEFDNLKEELMWEGSSVVMLSSDEQKFLEASMAYVSGNQIMSDEEFDDLKLRLKMEGSEIVAEGPRCSLRSRKVYSDLSVDYLKMFLLNVPATVVALGLFFFLDDLTGFEITYLLELPEPFSFIFTWFAAVPFVVWLAQALTKVVVKDFLILKGPCPNCGTENVSFFGTILSISSGGTTNTLKCSNCGTSLEYNSKTRLITLPEGSQA

SEQ ID NO: 11562 - protein, 329 aa, Nicotiana benthamiana
MATKFGFTITSPRLFHAPFRKKPIFSSSSPSLQGASFSCSKLPLINFDGRKLAIRRRLLVLSPKATTDQSGQLNEDEVEDSKILQYCSIDGKGKKSLGEMEQEFLQALQSFYYEGKAMMSNEEFDNLKEELMWEGSSVVMLSTDEQKFLEASMAYVSGNPIMTDKEYDKLKMKLKRDGSDIVVEGPRCSLRSRKVYSDLSVDYLKMFLLNVPAAVVALGLFFFLDDLTGFEITYLLELPEPFSFIFTWFAALPLILYLSFTITNIVVKDFLILRGPCPNCGTENTSFFGTILSISSGGSTNKIKCSGCGTDLVYDSDTRLITLPEGSTA

SEQ ID NO: 11563 - protein, 326 aa, Populus trichocarpa
MAGKLAFTLTSPRVLIAPIQKPFISSSSSLPPPSCSSSTRVHFNVKQFSLRRRMLLPPTKATADQQADQAQEDEMVDGKILQYCSIDKRGKKSIGEMEQEFLQALQAFYYEGKAIMSNEEFDNLKEELMWEGSSVVMLSSDEQKFLEASMAYVSENPIMSDKEYDELKMKLKSEGSEIVVEGPRCSLRSRKVYSDLYVDYLKMFLLNVPATVTALGLFFFLDDLTGFEITYLLELPEPFSFLFTWFAAVPLIVWLALTLTNAIVKDFLILKGPCPNCGTENGSFFGTILSISSGGTTNTLKCSNCSTELVYNSKTRLITLPEGSEA

SEQ ID NO: 11564 - protein, 319 aa, Solanum phureja
MATKFGFTITTSSRLFHAPFRKKPIFSPNSVSPLINFGGRKLSIRRRLLFLSPKATTDQPGQVKEDEIEDSKILQYCSIDGKGKKSLGEMEQEFLQALQSFYYEGKAMMSNEEFDNLKEELMWEGSSVVMLSPDEQRFLEASMAYVSGNPIMTDEEYDKLKMKLKRDGSNIVVEGPRCSLRSRKVYSDLSVDYLKMFLLNVPAAVVALGLFFFLDDLTGFEITYLLELPEPFSFIFTWFAALPLILWLSFTITNAIVKDFLILKGPCPNCGTENTSFFGTILSVSNGGSSNKVKCSCCGTDLVYDSDTRLITLPEGSSA

SEQ ID NO: 11565 - protein, 157 aa, Arachis hypogaea
KLKMEGSDIVVEGPRCSLRSRKVYSDLSVDYLKMFLLNVPATVIALGLFFFLDDLTGFEITYLLELPEPFSFIFTWFAAVPLLVWLAQSLTSAIVKDFLILKGPCPNCGAENTSFFGTILSVSSGGKVNNVKCSECGTEMVFDSSTRLITLPEGSNA

SEQ ID NO: 11566 - protein, 77 aa, Brassica napus
MSGSRHQRMNAIRIRKENQVYSAEDKRALAMFNYEEKAKREAKVMSDLSRLVQRHMGEELGPNHDPFGAGKTDGADD

SEQ ID NO: 11567 - protein, 258 aa, Brassica rapa
  misc_feature (243)..(243): Xaa can be any naturally occurring amino acid
MNSLPRRFGRDQGYLDRDHRRGRRSGSDSDEELKGLSHEEYRRLKRLKMRKSGKHCIWRNTPSPPRDPNEVESDENAADEEVPEKDEEDPKSESGKSESESDRSRKKRKSKSSRSKRSRRYSDSESEDSESDDDSDEEDRRRRRRKKKQKSSRKRRGHRRKRRYSDSDDESEISASSSSGEERSKSKSKKDTDSKGKLEEAGKEPELDEEEMKMIIESKKKALPEDEEEEGEVGPMPLPKAEXHISYVVLYDPVKETL

SEQ ID NO: 11568 - protein, 185 aa, Brassica napus
SKSKSKKDTDSKGKLEEAVKEPELDEEEMKMIIESKKKALPEDEEEEGEVGPMPLPKAEGHISYGGALRPGEGDAIAQYVQQGKRIPRRGEVGLNADEIQRFEDLGYVMSGSRHQRMNAIRIRKENQVYSAEDKRALAMFNYEEKAKREAKVMSDLSRLVQRHMGEELGPNHDPFGAGKTDGADD

SEQ ID NO: 11569 - protein, 437 aa, Brassica napus
MSPPPSWFMENQGEVYEGRRRGSESDEELKGLSYQEYRRLKRIKMRNTGRFCIWNNTPSPPRDPNEDENADDDDDDNLTKAKGESDSGKSQSETDRSRKRRGMRSYDSDSESVGSESDSDKEDRRQRRRKIKSKRSRRSYDSDGESEESEEDRKKSTSIRKKRRYSDSDESSDASEISASSSGDEQHTKSKINRRKKLSGDGSDEGRRSKKKKRSRSSRKRPGHTRKSSDISASGEERSKSKSRRRKKLSGDGSDTDLKAKLEEKVKDTELDEEELKKFKEMVNESKKKSLAPEDEEEEAEVGPMPLPKAEGHISYGGALRPGEGDAIAQYVQQGKRIPRRGEVGLNADEIQRFEDLGYVMSGSRHQRMNAIRIRKENQVYSAEDKRALAMFNYEEKAKREAKVMSDLSRLVQRHMGEELGPNHDPFGAGKADGADD

SEQ ID NO: 11570 - protein, 312 aa, Brassica napus
QRRRKIKSKRSRRSYDSDGESEESEEDRKKSTSIRKKRRYSDSDESSDASEISASSSGDEQHTKSKINRRKKLSGDGSDEGRRSKKKKRSRSSRKRPGHRRKSSDISASGEERSKSKSRRRKKLSGDGSDTDLKAKLEEKVKDTELDEEELKKFKEMVNESKKKSLAPEDDEEEAEVGPMPLPKAEGHISYGGALRPGEGDAIAQYVQQGKRIPRRGEVGLNADEIQRFEDLGYVMSGSRHQRMNAIRIRKENQVYSAEDKRALAMFNYEEKAKREAKVMSDLSRLVQRHMGEELGPNHDPFGAGKADGADD

SEQ ID NO: 11571 - protein, 156 aa, Brassica napus
MVNESKKKSLAPEDEDEEAEVGPMPLPKAEGHISYGGALRPGEGDAIAQYVQQGKRIPRRGEVGLNADEIQRFEDLGYVMSGSRHQRMNAIRIRKENQVYSAEDKRALAMFNYEEKAKREAKVMSDLSRLVQRHMGEELGPNHDPFGAGKADGADD

SEQ ID NO: 11572 - protein, 378 aa, Raphanus sativus
MTMNSLPRRFGKNQGYLDRDHRRGRRSDSDSDEDLKGLSHEEYRRLKRLKMRKSGKYCIWENTPSPPRDPDEEESDENAADDEEVPEKDVDDPKQRKGESESGKSGSESDRSRKKRKSKRSRSKRRRRSDSESEEESESDDSDEEDRRRRRRNKKKKSRSSRKRRGHRRKRRYSDSDESSDEESEISASSGEERSKSKGKNIDVEEAVKEPELDEEEMKKFKEMIESKKKASAAAEDEEEAEVGPMPLPKAEGHISYGGALRPGEGDAIAQYVQQGKRIPRRGEVGLNADEIQRFEDLGYVMSGSRHQRMNAIRIRKENQVYSAEDKRALAMFNYEEKAKREAKVMADLSRLVQRHMGEELGPNHDPFGAGKTDGADD

SEQ ID NO: 11573 - protein, 187 aa, Brassica napus
KKLSGDSSDTDLKAKLEEKVKDTELGEEEESKKFREMVNNESKKKSLAPEDEEAEVGPKAEGHRGYGPALRPGEGDAIAQYVQQGKRIPRRGEVGLNADEIQRFEDLGYVMSGSRHQRMNAIRIRKENQVYSAEDKRALAMFNYEEKAKREAKVMSDLSRLVQRHMGEELGPNHDPFGAGKAVGADD

SEQ ID NO: 11574 - protein, 248 aa, Brassica napus
SESEISGDEQQHTESKINRRKKKLLSGDEEDRGRRTSEKKKTSTKKRGHRSASGEERSKRRKKLSGDGSDTDLKAKLEEKVKDTELGEEEESKKFREMVNNESKKKSLAPEDEEAEVGPKAEGHRGYGPALRPGEGDAIAQYVQQGKRIPRRGEVGLNADEIQRFEDLGYVMSGSRHQRMNAIRIRKENQVYSAEDKRALAMFNYEEKAKREAKVMSDLSRLVQRHMGEELGPNHDPFGAGKAVGADD

SEQ ID NO: 11575 - protein, 418 aa, Eutrema halophilum
MTMNSLPRRFGRNQGYLDRDYRKGRRSDSESDEELKGLSHEEYRRNKRLKMRKSGRFCFWENTPSPPRDQNEDSDEISDEILERDDNPKGKDRKGESDSGKSESESESDDLRSRKRKSKSSKRKRRRRRSYDSDSESEESESESEEEDRRRRRKKKSKSKSRRSSRKRRGHRRKRRYSDSDESSDGDSKMEESEISASSSGDELSKSKSRKRKKSSVSSSKRSKGKKTKSETESDGSDTDSKAQLEETVKDPELDEEELKKFKEMIESKKKASAPDDEEEADVGPMPLPKAEGHISYGGALRPGEGDAIAQYVQQGKRIPRRGEVGLNAEEIQKFEDLGYVMSGSRHQRMNAIRIRKENQVYSAEDKRALAMFNYEEKAKREAKVMSDLSRLVQRHMGEELGPNHDPFGAGKTDGADD

SEQ ID NO: 11576 - protein, 420 aa, Eutrema parvulum
MTMNSLPRRFGKNQGYLDRDYRKGRRSDSESDEELKGLSHEEYRRHKRLKMRKSGRFCFWENTPSPPRDPNEDSDVNADEVLDKDDDNPKGKERKGESDSGKSESESESDDLRSRKRKSKKSRSKRRRRRSYDSDSESEGSESDSDEEEEDRRRRRKKKKSRSSRSSRKRRGHRRKKSYSDSDESSDEDSKAEESEISASSSGEERTKSKSRRRKRSSGSSSKRSKGKKTKLETESGGSDTELKAKLEETVKDPELDEEELKKFKEMMESKKKSSAPEDEEEAEVGPMPLPKADGHISYGGALRPGEGDAIAQYVQQGKRIPRRGEVGLNAEEIQKFEDLGYVMSGSRHQRMNAIRIRKENQVYSAEDKRALAMFNYEEKAKREAKVMSDLSRLVQRHMGEELGPNHDPFGAGKTDGADD

SEQ ID NO: 11577 - protein, 186 aa, Eutrema parvulum
ESGGSDTELKAKLEETVKDPELDEEELKKFKEMMESKKKSSAPEDEEEAEVGPMPLPKADGHISYGGALRPGEGDAIAQYVQQGKRIPRRGEVGLNAEEIQKFEDLGYVMSGSRHQRMNAIRIRKENQVYSAEDKRALAMFNYEEKAKREAKVMSDLSRLVQRHMGEELGPNHDPFGAGKTDGADD

SEQ ID NO: 11578 - protein, 74 aa, Brassica napus
MSGSRHQRMNAIRIRKENQVYSAEDKRALAMFNYEEKAKREAKVMSDLSRLVQRHMGEELGPNHDPFGAGKADD

SEQ ID NO: 11579 - protein, 153 aa, Brassica oleracea
KFREMVNNESKMKSLAPEEEEAEVGPKAEGHMSGYGPALRPGEGDAIAQYVQQGKRIPRRGEVGLNADEIQRFEDLGYVMSGSRHQRMNAIRIRKENQVYSAEDKRALAMFNYEEKAKREAKVMSDLSRLVQRHMGEELGPNHDPFGAGKADD

SEQ ID NO: 11580 - protein, 299 aa, Raphanus sativus
GSPSLSYHKMSPPPRSWITENQGQANQGRRRGWDSSSESDEKDRRRKKSTSIRKKKKTRYTDSNESSDEYEISGDDEQHNKSKIKRRNKHGFDEEDSRSKNKIKRSSRKRRGGDTRKRRYTDSDDGSLKAKLEEKVKEPQLDQEESNKKALAPEDEEEDAVVGPMPLPKAGGHIRNYHGRDLRPGEGDAIAQYVQQGKRIPRRGEVGLNADEIQRFEDLGYVMSGSRHQRMNAIRIRKENQVYSAEDKRALAMFNYEEKAKREAKVMSDLSRLVQRHMGQELGPNHDPFGSGKTDGPDD

SEQ ID NO: 11581 - protein, 290 aa, Brassica napus
MRTPPTRRFRRRTRKIRNLSLVSRNLSLIDLGRRGRVRALGVSVVDDIVIARVMMIRMRKIGGEEGGRRSRRVVGRGEDIGGRGDIVILMMNLRLALLRLLGEERSKSKSKKDTDSKGKLEEAVKEPELDEEEMKMIIESKKKALPEDEEEEDEVGPMPLPKAEGHISYGGALRPGEGDTIAQYVQQGKRIPRRGEVGLNADEIQRFEDLGYVMSGSRHQRMNAIRITKENQVYSAEDKCVLAMFNYEEKAKREAKVMSDLSRLVQRHMGEELGPNHDPFGAGKTDGADD

SEQ ID NO: 11582 - protein, 118 aa, Brassica juncea
EYAGEGDAIAQYVQQGKRIPRRGEVGLNADEIQRFEDLGYVMSGSRHQRMNAIRIRKENQVYSAEDKRALAMFNYEEKAKREAKVMSDLSRLVQRHMGEELGPNHDPFGAGKAVGADD

SEQ ID NO: 11583 - protein, 113 aa, Brassica juncea
GDAIAQYVQQGKRIPRRGEVGLNADEIQRFEDLGYVMSGSRHQRMNAIRIRKENQVYSAEDKRALAMFNYEEKAKREAKVMSDLSRLVQRHMGEELGPNHDPFGAGKTDGADD

SEQ ID NO: 11584 - protein, 417 aa, Arabidopsis lyrata
MNSLPRRFGKNHGYLDRDYRNGRRSGSDSDEELKGLSHEEYRRQKRLKMRKSAKFCFWENTPSPPRDQNEDSDENVDEILDKNGGEKDNNSKGKEKKGTSDYSESESDGLRSRKRKSKSSRSKRRRRRSYDSDSESEESDSEDEDRRRRRKSSKKKKSRSRKKRSHYRKTRYSDSDESSDEDSKAEESEISASSSGEEDTKSKSKRRKKSSGSSSKRSKVKKTKSETESDGIEEDDSKMQLEETVKNTELELDEEELKKFKEMIESKKKSSAVDDEEEEADVGPMPLPKAEGHISYGGALRPGEGDAIAQYVQQGKRIPRRGEVGLNAEEIQKFEDLGYVMSGSRHQRMNAIRIRKENQVYSAEDKRALAMFNYEEKAKREAKVMSDLQRLVQRHMGEEVGPNHDPFGATKTDEADD

SEQ ID NO: 11585 - protein, 356 aa, Brassica napus
GVSYQEYRRLRRIKMRNTPRDPNVDERDDDNLPKAKVESDSGKSQSETDRSRKRRGRRSYDSDSESVESDSDEEDRRRQRSRRKIKSKSSRRSEESDSDEEDRKLGRKRKKSTSIRKKRRYSDSESEISASSSGDEQQHTKSKIKRLKKLSGDEEEDRGRRTSNKKKGSRKKRGHRSASGEEHSRSKSKRRKKLSGDGSDTDLKAKLEEKVKDTELELKKFREEEEAEVGPKAEGHMSGYGPALRPGEGDAIAQYVQQGKRIPRRGEVGLNADEIQRFEDLGYVMSGSRHQRMNAIRIRKENQVYSAEDKRALAMFNYEEKAKREAKVMSDLSRLVQRHMGEELGPNHDPFGAGKA

SEQ ID NO: 11586 - protein, 422 aa, Arabidopsis thaliana
MTMNSLPRRFGKNHGYLDRDYRNGRRSGSDSDEELKGLSHEEYRRQKRLKMRKSAKFCFWENTPSPPRDQNEDSDENADEIQDKNGGERDDNSKGKERKGKSDSESESDGLRSRKRKSKSSRSKRRRKRSYDSDSESEGSESDSEEEDRRRRRKSSSKRKKSRSSRSFRKKRSHRRKTKYSDSDESSDEDSKAEISASSSGEEEDTKSKSKRRKKSSDSSSKRSKGEKTKSGSDSDGTEEDSKMQVDETVKNTELELDEEELKKFKEMIELKKKSSAVDEEEEEGDVGPMPLPKAEGHISYGGALRPGEGDAIAQYVQQGKRIPRRGEVGLNAEEIQKFEDLGYVMSGSRHQRMNAIRIRKENQVYSAEDKRALAMFNYEEKAKREAKVMSDLQRLVQRHMGEEVGPNHDPFGAGKTEEDDD

SEQ ID NO: 11587 - protein, 134 aa, Plantago ovata
MPLPKAEGHISYGGALRPGEGDAIAQFVQQGKRIPRRGEVGLSADEISRFEDLGYVMSGSRHQRMNAIRIRKENQVYSAEDKRALAMFNYEEKAKREQKVMADLQRLVQRHIGEDTGPSHDPFGGGKAVEEADD

SEQ ID NO: 11588 - protein, 492 aa, Quercus alba
MGRPASTIEIPDKRHRSDRDNGRYSPDSDNSFDYSRRHHRRSPNYDAYDRYYDNHDRRHHNHNQERSSSPNPRSSKAQDSLPKRFGRDYRNGNRSESESDEELKGLNPEEYRRLKRQKMRRALTRCIWNCTPSPPRNENENENEKADEISDKYGGEDELIGGEKSDSSSKEKAKVSNRKGKSESQSNSESESESETDDSRSRRKRKRKSSISKSSKYESDESESESESEEEEEKRKQRKKSSSRNRSRHRSSKRSSRRKGSSSRRKSRYSNSDESDDSDASNRVRSKKKKRSRSRNLSETDKDIEVSNSEGSEVEKAAMMIEEDGEMKAESIAEALNFKEIFEAQKKPALDTEPVVGPMPLPRAEGHISYGGALRPGEGDAIAQYVQQGKRIPRRGEVGLSADEIQKFEGLGYVMSGSRHQRMNAIRIRKENQVYSAEDKRALAMFNYEEKAKREHKVMADLQRLVQRHIGQDVGPNHDPFGATKPADTADA

SEQ ID NO: 11589 - protein, 491 aa, Quercus alba
MGRPASTIEIPDKRHRSDRDNGRYTPDSDNSFDYNRRHHRRSPNYDAYDRYYDNHDRRHHNHNQQRSSSPNPRSSKAQDSLPKRFGRDSRNGNRSESESDEELKGLNPEEYRRLKRQKMRRALTRCIWNCTPSPPRNENENENEKADEISDKYGGEDELIGGEKSDSSSKEKAKVSNRKGKSESQSNSESESESETDDSRSRRKRKRKSSISKSSKYESDESESESESEEEEEKRKQRKKSSSRNRSRHRSSKRSSRRKGSSSRRKSRYSNSDESDDSDASNRVRSKKKRSRSRNLSETEKDIEVSNSEGSEVEKAAMMIEEDGEMKAESIAEALNFKEIFEAQKKPALDTEPVVGPMPLPRAEGHISYGGALRPGEGDAIAQYVQQGKRIPRRGEVGLSADEIQKFEGLGYVMSGSRHQRMNAIRIRKENQVYSAEDKRALAMFNYEEKAKREHKVMADLQRLVQRHIGQDVGPNHDPFGATKPADTADA

SEQ ID NO: 11590 - protein, 556 aa, Aquilegia formosa
MSRGERDYDNGGGGGGGGGGGYSSRRRDSRISSRVEIPERRRRSSSRDLHRESPERGNRRPSPSYSSYDHHHNYHNNDYNRRDYSDERNPRFNNGRYYERDNDNDRFDRNLGFHDRDYNNKNNNGGKVDESDSDEELKGLSYEEYRRLKRQKLRKSLKNCIWEITPSPPRRESDQLEPPLDESREDLGIEKENEGSGLKDESGKKRVDSEEEEGSDKSLSNSDSDSESEDLRSRRKKKKGSSRKGRRRRTKSSSSRKRRSKSYSASDMESDESGSESESEDSSSSSEKEKRRSKKSTSRRSKRGRERSKRKSKKARKTVGSDESCSKSDKYDSDGSSDDDARSKKRKGSSLDSDSIRSKKKKQSGSASESSGKGLSGSDTDAKNITLSDDLMKTEMNSEALEFRELLELQKKPDLDEEAVVGPMPLPRAEGHISYGGALRPGEGDAIAQYVQQGKRIPRRGEVGLSADEIQRYEDLGYVMSGSRHQRMNAIRIRKENQVYSAEDKRALAMFNYEEKAKREHKVMADLQRLVQRHIGEDVGPAHDPFKGKATDDADT

SEQ ID NO: 11591 - protein, 547 aa, Ceratodon purpureus
MERDRYGHGRSALRSVAVRPNYRREDEEDGSESDPELRRDPEYRRIKREKLRRQLKKCIWNVTPSPPRNRRDEEEGNGVGNGGGTVNGIHEQSESDREVAHHRKRSHERKSRGGDESEEEEEESEEERDKKHRKRSRDRRHKGDESEEERDRRRSSGKKSRRVEESEEDSEVDKKKRSGKKSRRVEESEDSEVDRKKRSGKKSQRRVRVEEELSSDSEVDRKKKHKKRKHDRKGEVSEEEDDEYRKRGRKSSKRSRKRRDSSDESESDREVEKRKRKGRSKRGGSDESSEEGSDLERKGGRKSKRGSSRRSSRRSKEKTRKREKSEEESEEEVEPTRSHRVEEELEGPGSSPSEAAAESSSGGSDSDEAEEGKALLEVAAPNELDEEAYKFKELLEAQRKGVAGDLESEPMIGPAPAPRAEGHISYGGALRPGEGDAIAQYVQQGKRIPRRGEVGLSADEISNFEDLGYVMSGSRHQRMNAIRIRKENQVYSAEDKRALAMFNYEEKAKREHKVMSDLQRLVQRHIGEEVAPNHDPFGTTKADEVPT

SEQ ID NO: 11592 - protein, 289 aa, Carica papaya
SEEESESESESDDDEEDRRRRRKSTRRKSSRKSISKRKRSRKKSRRQSDSDESSSEESEESDVGGSADDQAKSNKRENKRERPSGSRSKRSRRKKKSDAETESSYSDGNSGSGEDAKSKVKAEEAKKAEINAEALVFKEMIEAQKKPALDNEPVVGPMPLPKAEGHISYGGALRPGEGDAIAQYVQQGKRIPRRGEVGLSAEEIQKFESLGYVMSGSRHQRMNAIRIRKENQVYSAEDKRALAMFNYEEKAKREHKVMADLQRLVQRHIGQDVGPTHDPFAGKADGADA

SEQ ID NO: 11593 - protein, 174 aa, Quercus alba
MTIEEDEEMKAESIAEALNFKEIFEAQKKPALDSEPVVGPMPLPRAEGHISYGGALRPGEGDAIAQYVQQGKRIPRRGEVGLSADEIQKFEGLGYVMSGSRHQRMNAIRIRKENQVYSAEDKRALAMFNYEEKAKREHKVMADLQRLVQRHIGQDVGPNHDPFSATKPADTADA

SEQ ID NO: 11594 - protein, 522 aa, Arnica chamissonis
SAVKDPEGRRRNRNYSPEPAAPTDRRNRNSRRSPEYSRYDDDFNRSRNRRSPDHSRSSYQNSRVSRSRSRSPDYSKYENPKSYRRDNRSPDYSRFRRSPSPRVQTINSNRKSNYGDRNEQYLDRGFRNGNGPDSDSDEELKGASYEEYRRLKRQKMRKMLKNCIWNITPSPPRVDNDFDELEPEEIAEKDVEEKSELDSKARGRSSESDSESESESDDSLSDSDDSRSMTRRKKKNKNSTSRRRRKKSISASESESDYSVDDSEEDKRKKKKKKPKRSTKRKSKRNRRSNSRKRKDSDSEESSESDEGKESLKSIRSRGSSPKSSKKRGEKGSENATSDENSDSANDFKTNPKADELDKTEIDSELLMFKEKIESRKKLDLDDEPEVGPMPLPRAEGHISYGGALRPGEGDAIAQYVQQGKRIPRRGEVGLSADEISKFEDLGYVMSGSRHQRMNAIRIRKENQVYSAEDKRALAMFNYEEKAKREQKVMADLQRLVQRHIGEDSGPSHDPFGGKATDDPDA

SEQ ID NO: 11595 - protein, 318 aa, Euonymus alatus
MASGGGNAQAPSAPYKPYRLMKTLNAHSQSVSCVKFSNDGTLLASASLDKTLIIWSASSYSLITRLVGHSEGISDLAWSSDSHYICSASDDKTLRIWDSRSPFECLKILRGHSGFVFCVNFNPQSNLIVSGSFDETIRVWEVRTGKCTRVINAHSMPVTSVHFNRDGSLIASGSHDGCCKIWDVETGACLKSHAEDNSKAVSFVKFSPNGKFILLATLDSTLKLWNYTAGKFLKVYTGHTNKQYCITSTFSVTNGKYIVSGSEDNCVYIWDLQQKTMLQKLEGHNGTVISVSCHPIENKIASAGLDSDRTVRIWVQDA

SEQ ID NO: 11596 - protein, 224 aa, Flaveria ramosissima
SEEESESDGGKESLKSKRSRRSSSKSSKKRSEDSSENAASDENSDSETQLKTKPKVDDLEKTEVDNELLMFKERLESRKKLALDDEPEVGPMPLPRAEGHISYGGALRPGEGDAIAQYVQQGKRIPRRGEVGLSADEISKFEDLGYVMSGSRHQRMNAIRIRKENQVYSAEDKRALAMFNYEEKAKREQKVMADLQRLVQRHIGEDLGPSHDPFGGKATEDPDA

SEQ ID NO: 11597 - protein, 191 aa, Linum usitatissimum
DSDVNLDPESDAKSEEPIAVDAEAVIAERNAEALKFKEMIEAQKKPPGLDNEPAVGPMPLPRSEGHISYGGALRPGEGDAIAQYVQQGKRIPRRGEVGLSADEIQKFETLGYVMSGSRHQRMNAIRIRKENQVYSAEDKRALAMFNYEEKAKREHKVMADLQRLVQRHIGQDVGPSHDPFGTTKETDADDS

SEQ ID NO: 11598 - protein, 650 aa, Pinus pinaster
MENGRAEADGYPRQRGRLASKVEYVGRSSSNGTTGHPREHDGYHGHSKNYGRSRSRSRSPDPSRYEHKHYPSSNGNRLASPSRSRVSYGKALSPSPRVSDRGNSSKDIHDENPRTGGDTLLYKRRRSRSPDLEYETRPNLNDSHRQSFECRSSDPLRNNYGFYDRRRSPNPNDGRRTVNPNVDNESRRRDRRASPSYHPYDPSAGNRPLGFLDRGDGRRGRGNEQPESDDDDEDLKAVDFAEYRRLKRQKLRKKFKNCIWRITPSPPREEIEHAVARQTKGIEKDEQGITLGNDNTAIESKEEPLGKSSMGEKLDDGNAYRGKTSEGTGKKAGNLTKKTGGRRKPSPSSSGSDYTESSDDDEPRKDIKGSRSGRKKDRKSKHSSGSKKRRHVRVREYSEDDSVSEDDSASCSSENEKLKKKTNRQRNKQEKRKKSRNRTSGSKRPRVQSSEEEKSETHSDSHVPSDDSLELESGKNEERAGDVEPVEIDNEALRFKEMIESQEKIAAGLENEPIVGPLPLPKAEGHISYGGALRPGEGDAIAQYVQQGKRIPRRGEVGLSADEIQKFETLGYVMSGSRHQRMNAIRIRKENQVYSAEDKRALAMFNYEEKSKREHKVMSDLQRLVQRHIGQEVAPTHDPFAGKAPEAADG

SEQ ID NO: 11599 - protein, 168 aa, Tripterygium wilfordii
MAEEAMKAELDAEALQFKEMIESRKKPTLENEPVVGPMPLPRADGHISYGGALRPGEGDAIAQYVQQGKRIPRRGEVGLSAEEIQKFETLGYVMSGSRHQRMNAIRIRKENQVYSAEDKRALAMFNYEEKAKREQKVMSDLQRLVQRHIGQDVGPTHDPFGAKDGVDP

SEQ ID NO: 11600 - protein, 407 aa, Artemisia annua
NGNGNGYGNESESDEDLKGVNYEDYRRLKRQKYRKTLKRCIWNITPSPPRGEYDEVELDEEKEVEGDKEKLEDMKNSDSESESESESESESESDDSRSRRRKKGKGKSKSSRSKKRRSRMSVSESASESESESESESESSDDSEEDRRRKRKKSSKRSSKRKSRSSSRRSSKRKRRSGSRKSKDSEDSEESSDSEELSKRKRSRSSSKKRSEKGSDDSASEKDSGSENDAKGKVNVDDAEKPVSESELLAIKEMIESRKKVAVSEDDELVGPKPLPRAEGHISYGGALRPGEGDAIAQYVQQGKRIPRRGEVGLSADEISRYENLGYVMSGSRHQRMNAIRIRKENQVYSAEDKRALAMFNYEEKAKREQKVMSDLQRLVQRHIGEETGPSHDPFGGSGQATEDPDA

SEQ ID NO: 11601 - protein, 132 aa, Gnetum gnemon
MPLPKAEGHISYGGALRPGEGDAIAQYVQQGKRIPRRGEVGLSAEEIQKFESLGYVMSGSRHQRMNAIRIRKENQVYSAEDKRALAMFNYEEKAKREHKVMSDLQRLVQRHIGQDVGPTHDPFGAKGGDAAD

SEQ ID NO: 11602 - protein, 245 aa, Lactuca sativa
GLMACSRGRSPDYSRYDNQNSYRRTHRSPDYPRSKRSPSPRIKTMNTNRKPYYGDQKKQYLDRNNLNGNGNGPESESDEELKGASYEDYRRLKRQKLRKMLRNCIWNITPSPPRRDDDPDELEPEEIAEKDAEEDNEKYKDTKSELDSKERSHSSESESESEDSESDSDDSRSRRRKKSKRSSSRRKRRSRKSVSVSDSESDESTDDSEEEDRRRKKKKQKRKSTNERAAAGEIVREREEDLKKK

SEQ ID NO: 11603 - protein, 436 aa, Physcomitrella patens
MQMDRGRERGRDGYVHSHLRSVAVPVRDSNNYRHREEHDRLEDSDSDSELRRTQDPSEYRRLKREKMRRQFKNCIWNVTPSPPRHRGGEPEQESESDSDVDRKRRHKKMKHSRRVEESEEDSDVDRKRRHKSKKRSSRSHKRREASDDSQSDDKVSRRSRRVKSSKRRRSDDSSEEDSDVERKERARTKRGSSRRSSERRSKESRKKLRKLEDSSEETEEEVDLKLGLMSKEGLKPSGPPHSDGAAESSSGGSDSDEADVEEIGEEVANQNEVDEEAFKFKELLEAQRKAAAGGLENEPMIGPAPAPRAEGHISYGGALRPGEGDAIAQYVQQGKRIPRRGEVGLSADEISTFEDLGYVMSGSRHQRMNAIRIRKENQVYSAEDKRALAMFNYEEKAKREHKVMSDLQRLVQRHIGQEVAPNHDPFGTTKADEVPS

SEQ ID NO: 11604 - protein, 690 aa, Pinus taeda
MENGRAEADGYPRQRGRLASKVEYVGRSSSNGTTRHPREHDGYYGHSKNYGRSRSRSRSPDPSRYEHNHYPSSNGNRLASPSRSRVSYGKALSPSPRVSDRGNSSKDIHDENPRRGGDTLLYKGRRSRSPDLEYETRPNLNDSHRQRFECRSSDPLRNNYEFYDRRRSPNPNDGRRTLNPNVDNEPRHRDRRSSPSYHPYDPSAGNRPSGFLDRGDGRRGRGNEQPESDDDDEDLKAVDFAEYRRLKRQKLRKKFKNCIWRITPSPPREEIEHAVARHTKGIEKDEQGITLGNDARAIESKEEPLGKSSMGEKLDDGNASRSKISEDTGKKAGNLTKKNGGRRKPSPSSSGSDYSESSDDDEPRKGIKGSRSGGKKNRKSKHSKPSPSSSGSDYSESSDDDLPRKGIKGSRSGGKKNRKSKHSSGSKKRRHVRVREDSEDDSVSEDDSVSCSSENEKLKKKTERQRNKQEKRKKSRNRTSGSKRPRVQSSEEEKSETHSDSHVPSDDSLELESGKHEERAGDVEPVEIDNEALRFKEMIESQKRIAAGLENEPIVGPLPLPKAEGHISYGGALRPGEGDAIAQYVQQGKRIPRRGEVGLSADEIQKFETLGYVMSGSRHQRMNAIRIRKENQVYSAEDKRALAMFNYEEKSKREHKVMSDLQRLVQRHIGQEVAPTHDPFAGKAPEAADG

SEQ ID NO: 11605 - protein, 507 aa, Populus trichocarpa
MGRPLSTVEIPDRRYIPDRQNSRYTPESDASPDHRRRRDRGSPSYQSYDDRHREIDRGRRRRSSSPDYSRSPRRRTTRRSPSPRQRQTLDHPLPKKFGKGRSFLDRNGRESDEESDEELKGLSFEERRRLKRQKMRKSMSYCIWNVSPSPPRGDNEEEFEEKADKIEEKHGEDEKKSDDSSGKEKEKGNNGKGRMESENSGSSESESDDSREKRRRGLSSKRRRRRNSDSESDVSESEPDSEEDRKRRKKSRKSISRRRNSSKSIGRRRKSTRKKSKYSDSDYSGSEESDDDRVKSKKRSRSSGSQSKGSKKKRTTETEGENLDSNEGSGSEKNEVNDDDDADKAETDVEALMFKEMIEAQKKPALDNEPEVGPMPLPRAEGHISYGGALRPGEGDAIAQYVQQGKRIPRRGEVGLSADEIQKFENLGYVMSGSRHQRMNAIRIRKENQVYSAEDKRALAMFNYEEKAKREHKVMADLQRLVQRHIGEDVGPSHDPFAAKASDDADA

SEQ ID NO: 11606 - protein, 510 aa, Populus trichocarpa
MGRLSSTVEISDRRYIPDRQNSRDTPEFDSPDYRRHRERRSPSYQNYDDRHREIDRGRRRRSSSPEYSRSPRRRTTRRSPSPRYKETLDHSLPKKFGKGRSFLDRNGRESDEESDEDLKGLSFEEMRRLKRQKMRKSMRYCIWNITPSPPRRDDEEELVEKADEIEKYREDEVKSEDSSGKEKEKAKSESENSGSGESESKSEFESDDSREKRERRKSSSKRRRRNSDSKSDVSGSESESESDTEEDRKRGKKSRKSISRRIKSSKSSRRRKSRRKKSKYSDSDDSGGEESDSDDDRVKSKKRRRSSGSRSKGSKKKRGSETESENLDSLENSGSEKNKANDDEANKAEVDVEALMFKEIIEAQKKPALENEPVVGPMPLPRAEGHISYGGALRPGEGDAIAQYVQQGKRIPRRGEVGLSADEIQKFETLGYVMSGSRHQRMNAIRIRKENQVYSAEDKRALAMFNYEEKAKREHKVMADLQRLVQRHIGQDVGPSHDPFAAKASDGADA

SEQ ID NO: 11607 - protein, 287 aa, Selaginella moellendorffii
AKRRPSISSSNGSSSDDSESESDHRSRRRHGRRREHEKSRSVSRHKTSTSSRDRKSKSSSSSSSKHSKKKKRRRRARSPSPSSSSSPSSSASSELNDGAPSDDARGGDEAGEEQDSAKKMLEIDEEAIKFRGLLEAQKKAAMGSLESEPMVGPAPAPKTERHISYGGALRPGEGDAIAQYVQQGKRIPRRGEVGLSADEIQKFESLGYVMSGSRHQRMNAIRIRKENQVYSAEDKRALAMFNYEEKAKRERKVMSDLQRLVQRHIGADVGPTHDPFGKGTGAEVAEG

SEQ ID NO: 11608 - protein, 555 aa, Helianthus annuus
MGYPASTVNHPDRRRRNRNDSPEPSPPPDRRHRSSRRSPEHSRYDHDLNRSRNRRSPDYSKSTHQTRSISRSRSPDYSRYDNQTSYRRNHRSPENSRFRTSPNPRVHVDPNRKVNYGERNKQYLDRDRGGYRNGNGDGPESESDEELKGLSYEEYRRLKRQKIRKMLRNCIWNVTPSPPRGDNEFDEDEPEEVVEEKDELDLKAKGGGSSESDSESESGSDDSVSDSDDSRSRRRRKKSSRSRRRRKRSVSVSDSESDDSEEEDRRKKKKSSRSRARRKKSVSVSESESDYSTDDSEEERRKKKKSKRSTRRKSSSRKTSKRKRRSSSRKGTDSDSEESSESDRSKSKRSHRSSSKSSKKRSEKGSESSASDDNSDSANENKSKPKADDLEKTENDSEMLMFKEMMESKKKLALDDEPEVGPMPLPRAEGHISYGGALRPGEGDAIAQYVQQGKRIPRRGEVGLSADEISKFEDLGYVMSGSRHQRMNAIRIRKENQVYSAEDKRALAMFNYEEKAKREQKVMADLQRLVQRHIGEETGPSHDPFGGKATEDPDA

SEQ ID NO: 11609 - protein, 273 aa, Ambrosia trifida
KSVSVSESDDYSSDDSEEDRGKKKKKSKRSTRRKSSGRRSSKRKRRSSSRKGTDSDSEESSESDGSKSKRSRRSSSKKRSEKGSEGSTSDENSDSANDSKSKPKADDLVKIETDGEMLAFKEMMESRKKVVLDEEPEVGPMPLPRAEGHISYGGALRPGEGDAIAQYVQQGKRIPRRGEVGLSADEISKFEDLGYVMSGSRHQRMNAIRIRKENQVYSAEDKRALAMFNYEEKAKREQKVMADLQRLVQRHIGEDTGPSHDPFGGKATEDPDA

SEQ ID NO: 11610 - protein, 554 aa, Cirsium arvense
VTTASAVEVRQDRRRSHRDNRNYPPEPDSPTDRRNRTSRRSPDYSRYDNHDSNRSRNPSRNRSPDYSKSRNRNRSPSRSRSPDYSRYDDANGHGRDRRSPDYSRSRRNPSPRVETFNSNRKPSYGDQNRQYLDRDYRNGNGNGPESESDEELKGASYEDYRRLKRQKLRKMLKNCIWNVTPSPPRGDSELDEIEVDEVAEKDVEEDGEKYKDAKFELDSKTKGGSSESESDSDSKSESDDSLSDSDDSRSRRRRKKGKSSSSRRRRRSRKSVSVSESESDESMDDSEEEDRRKKKKSKRRSSKRKSSSSKSSKRKRRSKSRKSKDSDSEESSDSEELEEPPKLKRSRSTSSQPKSSKKRSENGSQNSASDVNSDSENDTNKPKVDDTENTEVDSELLMFKEMIESRKKPALDDEPEVGPMPLPRAEGHISYGGALRPGEGDAIAQYVQQGKRIPRRGEVGLSAEEISKFEDLGYVMSGSRHQRMNAIRIRKENQVYSAEDKRALAMFNYEEKAKREQKVMADLQRLVQRHIGEETGPSHDPFGGSGRATEDPDA

SEQ ID NO: 11611 - protein, 499 aa, Citrus clementina
MGRPSSTIEIPDRRRRSGGYPSDSENSPVYRYRSPFRSRSRSRSRSYSPKYRSPRRRRSPSPRRRRSPSPGRRRSPVGSNYETLDSLPKRFGKSNRDYRNGHDVESDFDEELKGLNFMEYRWRKRQKMRKSLKHCFWTATPSPPRYENDDLEDDKPDEILEKYGGDDSSGKEKDDSEAEHSKRSASASESDDPRSRKNRKKIESESESDDSRSRKKRKSRRSKPKSRKPSESEDDESDSDEEEDRRRRKRRGRRHKNRSSSKRKASRRKSRYSDSDESDSRGSETEQSDASQSSDDDNGKLKKPKLSLSKRSKKEQKSESESDESLGSEQKMDDGAKQAEINAEVLKFKEMIESQKKPALDNEPAVGPMPLPRAEGHISYGGALRPGEGDAIAQYVQQGKRIPRRGEVGLSAEEIQKFESLGYVMSGSRHQRMNAIRIRKENQVYSAEDKRALAMFNYEEKAKREHKVMADLQRLVQRHIGQDVGPTHDPFGGKDGGET

SEQ ID NO: 11612 - protein, 298 aa, Euphorbia peplus
KKKKKKKRSSRRRSRRSSGSDSESESDSSDENRKSRKKSRKSSGRKKKRSSRKPSKRKKTRYTDSDDESGSEESELDSKKRRRSSASGGSKRGKKKKKTSETESENLHHSESSGSEIDSMGKAKEVEELKKIELDDDGEAFILKEMIEAQKKNAALDNEPIVGPMPLPKAEGHISYGGALRPGEGDAIAQYVQQGKRIPRRGEVGLSADEIQKFENLGYVMSGSRHQRMNAIRIRKENQVYSAEDKRALAMFNYEEKAKREHKVMADLQRLVQRHIGQDVGPTHDPFGAKASSEAPDA

SEQ ID NO: 11613 - protein, 477 aa, Euphorbia peplus
MGRPSSTVEIPDRRYFPDRRRTPESDTPEDYRRRRRSPSYHSYDERHRETDRGRYSSRSSPRRRSRSPRPRKTLEDSLPKKFGGGGGRSYLDRGGGGHRNSGSESDEELNGLPFEERRRIKRQKMRKSIHRYCFWSITPSPPRVEDDDEGLEGEPDEVSDKDEEKSDKGKGKLESASEKSGSSDSESLSDESGKKKRKRRRSSRRRSRRSSESESESESDSEEDRKNRKKRSGRKKRSSKRSSRKRSKRKTRYTDSDDDSGSEEESELESKKRRRSSGKKKKTSESESENVNPSEISGSETDSKGKEKVEELKRIELDAEALILKEMIEAQKKPALDNEPIVGPMPLPKAEGHISYGGALRPGEGDAIAQYVQQGKRIPRRGEVGLSADEIQKFESLGYVMSGSRHQRMNAIRIRKENQVYSAEDKRALAMFNYEEKAKREHKVMADLQRLVQRHIGQDVGPTHDPFGAKTSEGPDA

SEQ ID NO: 11614 - protein, 249 aa, Fagopyrum esculentum
MARPASEVVVPDHRRRYSPVSDDSGERQRRRRSRSPSYARYSPAANHRGRRGRSKSPDFANPRRNLSRSWSRSRSPEYRKPRYEDRRGRSGGFLNRDGYRNARAPHDDSDEELRGLNNEEYRRMKRQKLRKSLTSCIWNATPSPPRTENDEFDREEDEIDDEDGPGKENGDVREKSGKGSEDRSGSESESESETEFDSDDSSSRKRSKGKTNPSPKVEIGNLRQILILKLDLNRFPMIPVLEEGRRVGS

SEQ ID NO: 11615 - protein, 515 aa, Citrus sinensis
MGRPSSTIEIPDRRRRSGGYPSDSENSPVYRYRSPFRSRSRSRSRSYSPKYRSPRRRRSPSPGRRRSPSPGRRRSPSPGRRRSPSPGRRRSPVGSNYETLDSLPKRFGKSNRDYRNGHDVESDSDEELKGLNFMEYRWRKRQKMRKSLKHCFWTATPSPPRYENDDLEDDKPDEILEKYGGDDSSGKEKDDSEAEHSKRSASASESDDPRSRKNRKKIESESESDDSRSRKKRKSRRSKPKSRKPSESEDDESDSDEEEDRRRRKRRGRRHKNRSSSKRKASRRKSRYSDSDESDSRGSETEQSDASQSSDDDNGKLKKPKLSLSKRSKKEQKSESESDESLGSEQKMDDGAKQAEINAEVLKFKEMIESQKKPALDNEPAVGPMPLPRAEGHISYGGALRPGEGDAIAQYVQQGKRIPRRGEVGLSAEEIQKFESLGYVMSGSRHQRMNAIRIRKENQVYSAEDKRALAMFNYEEKAKREHKVMADLQRLVQRHIGQDVGPTHDPFGGKDGGET

SEQ ID NO: 11616 - protein, 140 aa, Primula obconica
DNEPMVGPQPLPKAEGHISYGGALRPGEGDAIAQYVQQGKRIPRRGEVGLSADEISRFEDLGYVMSGSRHQRMNAIRIRKENQVYSAEDKRALAMFNYEEKAKRESKVMADLQRLVERHMGQDTEPAHDPFSARDDDAGD

SEQ ID NO: 11617 - protein, 479 aa, Trigonella foenum-graecum
MARLSSTIEISHHRSRHNDRRRTPDSDISDDRPRYRRSPRYDSYDDRHTHNHRRRSKSPETRNPRHHDNGNPNGNHLPKKFGNRNNGSYLDRGRNESESDEELKGLSYEEYRRLKRQKMRKSLKHCIWNVTPSPPRRENDDLEDYGKPEEISEKIDVKKDKEIKQKAKSESESKSEESESDSRKKRRKSSKKMRESDSVSDESESEEEEDRKRRKKKYSDSVSESEEDKKRRKRRKSSRRKRKSNRKKRRYSDSEESESDDGSDSDDSIRRRKRSKRSRKRTKKDSEPVSEDSEEIELDSDTAVAKNTEEIDVDEGKMAEMNEEALKLKELFELQKKPALDSEPPVGPMPLPRAEGHISYGGALRPGEGDAIAQYVQQGKRIPRRGEVGLSAEEISKFEELGYVMSGSRHQRMNAIRIRKENQVYSAEDKRALAMFNYEEKAKREHKVMADLQRLVQRHIGQDVGPTHDPFGAKDGSDD

SEQ ID NO: 11618 - protein, 595 aa, Theobroma cacao
MGRLTSTVEIPDRRHQSGRENGRHTSESDDSPNYCRRRRSPSYEAYERDHQSRNVNQQRNRFGSPEFRNPRRRSPVEIPERRHRFDRENGRYASESDDSTDYRRRRHSPSYDIYNRGQPRKRHPSESPDGRNPRRRSPVHDRPLNSLPKEFGKNRNYLDRDYRNGKHSESESDEELKGLNVEEYRRLKRQKMRKTMKFCVWENTPSPPRNEDDDLEDKADEISENHAEENDNEKSNSDKEKEKKSTKRVKVKTESEKSASSESESQLESDSESESDGSRSRKRKKGSSSKRRSRNSKRGSRKSSSYSDSESDESGSESDDEEDRRRRRKSRRKQSRQNKSSKKSSRGKRSRKNSRYSYSDESGSGESETDVSEMSRSSDDRVKSKKRKSSSNSRTRRSKKRIQSESDSQGSYSDKSSDSGVDAKSKVKADEAKVAEISAEALMFKEMIEAQKKPELDNEPMVGPAPLPRAEGHISYGGALRPGEGDAIAQYVQQGKRIPRRGEVGLSAEEIQKFESLGFVMSGSRHQRMNAIRIRKENQVYSAEDKRALAMFNYEEKAKREHKVMADLQRLVQRHIGQDVGPTHNPFAGKDGADA

SEQ ID NO: 11619 - protein, 325 aa, Citrus sinensis
MGRPSSTIEIPDRRRRSGGYPSDSENSPVYRYRSPFRSRSRSRSRSYSPKYRSPRRRRSPSPGRRRSPSPGRRRSPSPGRRRSPSPGRRRSPVGSNYETLDSLPKRFGKSNRDYRNGHDVESDSDEELKGLNFMEYRWRKRQKMRKSLKHCFWTATPSPPRYENDDLEDDKPDEILEKYGGDDSSGKEKDDSEAEHSKRSASASESDDPRSRKNRKKIESESESDDSRSRKKRKSRRSKPKSRKPSESEDDESDSDEEEDRRRRKRRGRRHKNRSSSKRKTSRRKSRYSDSDESDSRGSETEQSDASQSSDDDNGKLKKPQAFSV

SEQ ID NO: 11620 - protein, 591 aa, Gossypium hirsutum
MGRLTSTVEIPERRRQSDRENGRYTSESDGSPDYRRRRRSPSYEAYERDHQSRKGSQQRDPSGSSEYRNPRRRSPVESPERRRRFDGQNGRYASESDDSVDYRRRRRSPSYDVYDRDQPRNHHRSESPGDENPRRRNPAHDGTLNSLPKKFGKNRSYLDRDYRNGKHSESESDEELKGLNFEEYRRLKRQKMRKALRFCIWENTPSPPRNDGDDLEDKGDEISEKYGEDNGDGKSDSDKEREKTSNKRIKSKSESENSGSSESESESETESDDSRSRRRKKGSSSKIKSRKSKRRSRKTSSYSDSESDESECESDDEEDSKQRRKSRRKGSRRNRNSKKSSTRKRSRKKSRYSDSNESASERETDESDVSKSSDDRVKSKKRKSSSNSRSRKSKKRRGSETDSQASDSDKSSDSGVDAKSKTMVDEPKIAEINAAEALMFKEMIEAQKKPALDNEPMVGPAPLPRAEGHISYGGALRPGEGDAIAQYVQQGKRIPRRGEVGLSAEEIQKFESLGFVMSGSRHQRMNAIRIRKENQVYSAEDKRALAMFNYEEKAKREHKVMADLQRLVQRHIGQDVGPTHNPFAGKDGADA

SEQ ID NO: 11621 - protein, 591 aa, Gossypium hirsutum
MGRLTSTVEIPERRRQSDRESGRYASESDGSPDYRRRRRSPSYEAYERDHQSRKDYQQRNPSGSSEYRNPRRRSPVESPERRRRFDRENGRYASESDDSVDYRRRRRSPSYDVYDRDQPRNRHRSESPGDENPRRRNPAHDGTLNSLPKKFGKNRSYLDRDYRNGKHSESESDEELKGLNFEEYRRLKRQKMRKALRFCIWENTPSPPRNDGDDLEDKGDEISEKYGEDNGDGKSDSDKEREMTSNKRVKSKSESENSGSSESESESETESDDSRSRRRKKGSSSKSKSRKSKRRSRKTSSYSDSESDESECESDDEEDSKQRRKSRRKGSRRNRNSKKSSTRKRSRKKSRYSDSNESASERETDESDVSRSSDDRVKSKKRKSSSNSRSRRSKKRRGSETDSQASDSDRSSDSGVDAKSKTIIDEPKIAEINAAEALMFKEMIEAQKKPALDNEPMVGPAPLPRAEGHISYGGALRPGEGDAIAQYVQQGKRIPRRGEVGLSAEEIQKFESLGFVMSGSRHQRMNAIRIRKENQVYSAEDKRALAMFNYEEKAKREHKVMADLQRLVQRHIGQDVGPTHNPFAGKDGADA

SEQ ID NO: 11622 - protein, 149 aa, Actinidia deliciosa
  misc_feature (18)..(18): Xaa can be any naturally occurring amino acid
  misc_feature (50)..(50): Xaa can be any naturally occurring amino acid
  misc_feature (56)..(56): Xaa can be any naturally occurring amino acid
  misc_feature (73)..(73): Xaa can be any naturally occurring amino acid
KKPVLENEPVVGPMPLPXAEGHISYGGALRPGEGDAIAQYVQQGKRIPRXGEVGLXADEIQKFEGLGYVMSGXRHQRMNAIRIRKENQVYSAEDKRALAMFNYEEKAKRETKVMADLQRLVQRHMGQDAGPSHDPFAGAGGGADADADA

SEQ ID NO: 11623 - protein, 159 aa, Tropaeolum majus
MLRCSKFKELIEAQKKPTLNNEPVVGPMPLPKAEGHISYGGALRPGEGDAIAQYVQQGKRIPRRGEVGLSADEIQKFESLGYVMSGSRHQRMNAIRIRKENQVYSAEDKRALAMFNYEEKSKREHKVMADLQRLVQRHIGQDVGPTHDPFAPKADGSDA

SEQ ID NO: 11624 - protein, 360 aa, Arachis hypogaea
MGRPSSAIEVPNERRRFDHRRTTPDSDHSDGYRRSRRRRSPSYDSYDRNRDRRRDRRRSTSPERRSPRPTAYNDGLPNGDVLPKKFGRRSGGSYLDRDRRPDSDSDEELKGLSFEEYRRLKRQKMRKSLKHCIWNVTPSPPRRENEQESEEERAEEITVKFGVEKGDSSDKEVKPSEKSKSEPKSENFSESEAESDDSRSRTKRRRVSGLKRRRRSNSDSESEENESESEDSESESDDSIARRKRKRSSKSKHRRRRSNNDGESEGSDAEEEERKSRRGKRKSGKTRGNRKKRRYSDSDESEESESDDSDDSGRRKRKHSSRSKRSRRERRKRRSRKSESEKEVSESEEEKGFGDAKNKQ

SEQ ID NO: 11625 - protein, 399 aa, Cajanus cajan
QRSDSESDEELKGLSYEEYRRLKRQKMRKSLKYCIWNVTPSPPRRDNEDLEDYHKPDEISDRDAAVVKIEKAVKPKGKSELESDSESEKSVSSESEDSRSRKKRRKSSAGSSRRSYSESESESESESESDSEEEERSRRKSRRNRRRRSNKNKNRRYSDSDESEESDSDASDVSIRKRKKRSSSSRSKSKRSRRHRRTTKRNSETESEKSHSEEENGSGSGSGDAVTKAAVDEAMMTEMNAEAIKLKELFESQKKPALDNEPAVGPMPLPRAEGHISYGGALRPGEGDAIAQYVQQGKRIPRRGEVGLSAEEIQKFESLGYVMSGSRHQRMNAIRIRKENQVYSAEDKRALAMFNYEEKAKREHKVMADLQRLVQRHIGQDVGPTHDPFAAKASDGADA

SEQ ID NO: 11626 - protein, 159 aa, Senecio madagascariensis
AVVSTQSTGFKEMIESRKKVDLEEEPEVGPMPLPRAEGHISYGGALRPGEGDAIAQYVQQGKRIPRRGEVGLSADEISKFEDLGYVMSGSRHQRMNAIRIRKENQVYSAEDKRALAMFNYEEKAKREQKVMADLQRLVQRHIGEETLPNHDPFGGKATT

SEQ ID NO: 11627 - protein, 498 aa, Glycine max
MGRPSSTIEIPHERHRHNGRRTPDSDISDDYRRRRSPSYDSYDRHTERHRRCSESPEHRSPRHTNGTHNDNTLPKKFGRRNGAYLDRDRGDWQRSDSESDEELKGLNYEEFRRLKRQKMRKSLKHCIWNVTPSPPRRDNEDPEDYSKPDEISDRDDGAGKIDKEIKAKAKAKSESESDSDSESEKSVSSESDGSRSRKKKRKSSAGSSRRSYSESESESESESESESESESEEEERRRRKSRRNRRKRSNRSRKKRRYSDSDEREDSESDDSDSSGRKKKKRSSSSKSRSKRIRRSRKRTNRSPETEGEGSDLEEENGSGSGDAKSKTTVDEVMKTEINAEAIKLKELFESQKKPALDNEPAVGPMPLPRAEGHISYGGALRPGEGDAIAQYVQQGKRIPRRGEVGLSAEEIQKFESLGYVMSGSRHQRMNAIRIRKENQVYSAEDKRALAMFNYEEKAKREHKVMADLQRLVQRHIGQDVGPTHDPFAAKASDGADA

SEQ ID NO: 11628 - protein, 487 aa, Glycine max
MGRPSSTIEIPHERYRHNDRRTPDPDVSDDYRRRRSPSYDSYDRHPERRRRRSVSPEHRNPRHTNGTHNDNALPKKFGRRNGAYLDRDRGDWQRSDSESDEELKGLNFEEYRRLKRQKMRKSLKHCIWNVTPSPPRRENEDLEDYSKPDEISDRNDGAGKIDTEVKAKTKAKPESESDSESEKSASSESDDSRSRKKRRKGSAGSSRKSYSESESESDSESEEEERRRRKSRKNRRKRSNRSRKKRRYSDSDESEESESDDSESSGRKKKKRSSSSRSRSKRIRRSSKRTKGSSETESAGSGSEEEENGSGDAKSKAMVDEVKMTEINAEAIKLKELFESQKKPALDNEPAVGPMPLPRAEGHISYGGALRPGEGDAIAQYVQQGKRIPRRGEVGLSAEEIQKFENLGYVMSGSRHQRMNAIRIRKENQVYSAEDKRALAMFNYEEKAKREHKVMADLQRLVQRHIGQDVGPTHDPFAAKASDGADA

SEQ ID NO: 11629 - protein, 267 aa, Picea glauca
RKRRHISVREHSEDDSDSVSEDDSSSYSSENEKLKKQTNRRRNRHEKQKISAKRMSGSKRSRVQSSEDEEKSEPPSESHVSSDDSLELESGKHEEEVGDDEPVEIDNEALRFKEMIEFQKKSVAGLENEPLVGPLPVPKAEGHISYGGALRPGEGDAIAQYVQQGKRIPRRGEVGLSADEIQKFETLGYVMSGSRHQRMNAIRIRKENQVYSAEDKRALAMFNYEEKSKREHKVMSDLQRLVQRHIGQEVAPTHDPFAGKAPEVADV

SEQ ID NO: 11630 - protein, 153 aa, Euphorbia esula
  misc_feature (8)..(8): Xaa can be any naturally occurring amino acid
MIEAQKKXAALDNEPIVGPMPLPKAEGHISYGGALRPGEGDAIAQYVQQGKRIPRRGEVGLSADEIQKFENLGYVMSGSRHQRMNAIRIRKENQVYSAEDKRALAMFNYEEKAKREHKVMADLQRLVQRHIGQDVGPTHDPFGAKASSEAPDA

SEQ ID NO: 11631 - protein, 477 aa, Triphysaria pusilla
MGRISSAVEIPDRRRTSSHHRDNDRYSPEPRRSYHRRERSYSRSRSPIRRRSRSRSPTKNGHNRYHRSSPDYSYPNLAETQRLSDRNKLNYDNRNKSYLDRDHRNGQFPEPESDEELKSLPYEEYRRLKRQKMRKSLRNCIWSCTPSPPRAPNEKSDAEMDEVIEVEEEKQIRVSKPEVKKSPESESESVSESESESDGFRSKKSRKSRSRRKRKSRRSKSVSESGSESESDSSDEDDRRRRRKSVKKKKKKSKSSKKSTRRKKGIKKRHSSSESESETEHSDHVKSKTHSDSEPEAITKDVVALPEEDELMITDEMNEEMLKFKEMIEQRNKPILEDEPVVGPMPLPRADGHISYGGALRPGEGDAIAQYVQQGKRIPRRGEVGLSADEISRFETLGYVMSGSRHQRMNAIRIRKENQVYSAEDKRALAMFNYEEKAKREQKVMADLQRLVQRHIGEDTGPSHDPFGGRAVEGDED

SEQ ID NO: 11632 - protein, 120 aa, Scabiosa columbaria
GALRPGEGDAIAQYVQQGKRIPRRGEVGLSADEISKFETLGYVMSGSRHQRMNAIRIRKENQVYSAEDKRALAMFNYEEKAKREQKVMADLQRLVQRHIGEDTGPSHDPFGGRATEGADT

SEQ ID NO: 11633 - protein, 311 aa, Abies balsamea
RKSSPPTSESDYSESSDDGESRKDIKGGRSSRKKRRKLKQSGRSRKRRYISRREHSEDDSDSVSDDNSSSYSSEDEKPKKQTNRRRNRQEKEKKSGKRMSGSKRSGVQSSEDEATSEPLSESRVSSDDSLELESGKDEEKAGDDEPVEIDKEALRFKEMIESQKKAAAGLENEPLVGPLPIPKAEGHISYGGALRPGEGDAIAQYVQQGKRIPRRGEVGLSADEIQKFETLGYVMSGSRHQRMNAIRIRKENQVYSAEDKRALAMFNYEEKSKREHKVMSDLQRLVQRHIGQEVAPTHDPFGGKAPEVADG

SEQ ID NO: 11634 - protein, 535 aa, Amsonia hubrichtii
MGRPSSAIEIPEERRSHRDYRRYSSERYGSEDFRSRNRSVSRSPSLRRSRSRSFSRSRTRSRSPIYNGYSRYDHRDRRPSPDYSYPRRSPRPDTIKSERAYGDRKKPFLDRDYKNNRHAGSESDEELKGLSFEEYRRLKRQKLRKMLKSCIWNCTPSPPRDPNEPEDQAFEEDIAGKVNEQEETGGKEKKKDQISKVDTKSSSESGSESDSDSTEFSDSESDDSRRRRRKSRKSSSRRRKRRSKSVSETESESNDSSEESEEKDRKARRRKLRKKESRRNRSSRRSSKRKRKSGRKAYSDESESNDESGSEDSEVSPSSDDRATTKKLKHSQSKHSKKKRESETDREVSESDKSSDSIDDKDKQMVTEEAKMDEVNSEVLKFKELIEARKKAALENDPPVGPMPLPRAEGHISYGGALRPGEGDAIAQYVQQGKRIPRRGEVGLSAEEIQKFEGLGYVMSGSRHQRMNAIRIRKENQVYSAEDKRALAMFNYEEKAKREQKVMADLQRLVQRHIGQDSGPSHDPFGGRSTEGAEA

SEQ ID NO: 11635 - protein, 587 aa, Chelidonium majus
EPKLSSKVEIPQRRHRRHDDSPDSGRSPSPYHSDYHHRRNHSRSPINNHRTRSYHESNRRRSPSGSRSPINNHRTKSYHESNRRRSPSGSRSPINNQRTRYHREPDRRRERSLSNGYSNPRGSPTYENLDLGNQRHGHTDHEDRLAPFLHRGGRNGRLSDSDSDEELKGLEFSEFRRLKRQKLRKRMKNCIWNVTPSPPRSEREGSLDELQETEIVDKTVEDERNGRNNAIDSGGKSESDESGKSLSETESESESDSDSSRSRRKRRKGGKHRRKSRKSSSSRRKRSKKASTDTESSEDSESESSDYSSEEDRKSRKKSKSRRSSQGKKRSRRSSKKTRGSKKRRKDSESDESKSEESGSEESDSGPSSDRARTGKKKSSKLSSHSKRSKNKKRSESGSESSAEGASGSEVDAKNYTELDDAVKDENNSEMLMFKELIESQKKPPVDNDAPVGPMPLPKAEGHISYGGALRPGEGDAIAQYVQQGKRIPRRGEVGLSADEIQKFESLGYVMSGSRHQRMNAIRIRKENQVYSAEDKRALAMFNYEEKAKREHKVMADLQRLVQRHIGQDVGPTHDPFSGKASDAADA

SEQ ID NO: 11636 - protein, 159 aa, Utricularia gibba
GEVLKFKEMMELKKKTNFDDEPLVGPMPLPRAEGHISYGGALRPGEGDAIAQYVQQGKRIPRRGEVGLSAEEIQKFENLGYVMSGSRHQRMNAIRIRKENQVYSAEDKRALAMFNHEEKAKREQKVMSDLQRLVQRHIGQDAGPSHDPFGGRAADAADE

SEQ ID NO: 11637 - protein, 250 aa, Vinca minor
SKRKSSSRRKACSDESESKNETESEGSEVDRSPGDRAKSKRSRKHSRSKHGKKKMESEADSEVSDINKSSDSADDKNTQKVAEEAKITEVNSEVLKFKELLDTQKIAALGNEPAVGPMPLPRAEGHISYGGALRPGEGDAIAQYVQQGKRIPRRGEVGLSADEISKFEDLGYVMSGSRHQRMNAIRIRKENQVYSAEDKRALAMFNYEEKAKREQKVMADLQRLVQRHIGQEPDPSHDPFGGRSGEGAEA

SEQ ID NO: 11638 - protein, 521 aa, Manihot esculenta
MGRPASMIEIPDGRYRPERRTDRYTPESDTSADYHRYRDRRSPSYESYDERLRGTARGRYGSSSPEYSSPRRRSPSPRPMKNMETLPKKFGRGRPYLDRGGSRNLRNSESESDEELMGLSFEERRRLKRQKMRKNIARYCIWTLTPSPPRDENEEDLEGQADEISERYGEDEEKSDFSEKEKGKARDGKGVSESDSGKSLSSDSRSVSKSESESNDSRSRKKRGSGSKRRGRKTSVDSDSESDEDASESGSEAESDSEEDRRRRKKSRKSGSSRRRKSSKRSSRKGKSQRKRKSRYSDSDDIGCEGSDYESKKRIRISGSKRSKKKRSETESASSYPDKSSGSDIDAKGKLKADEMKIPEINTEPLIFKEKMESLKIPALDNEPTVGPMPLPRAEGHISYGGALRPGEGDAIAQYVQQGKRIPRRGEVGLSAEEIQKFEYLGYVMSGSRHQRMNAIRIRKENQVYSAEDKRALAMFNYEEKAKREHKVMADLQRLVQRHIGQDVGPTHDPFATKASDGADA

SEQ ID NO: 11639 - protein, 524 aa, Ricinus communis
MGGRPASTIEFPDRRYRPDRNNGRYTPESDISPNYNRHGDRRSPSYHSYDERHRETNPRRYHSRSPDNYPTSRRSRRSPSPRPLKDLDSLPKKFGGRGRAYLDRNGKDSESESDEELKGLSFEERRRLKRQRMRKNIARYCIWNLTPSPPRNDNDENEDFEDKADEISEKYGEDDEKKSYSNEKEKVKKEGKGKPESDSQNSEMSDSETDSESEDESESDDSRSWKKRRSSSSKRRTRRLSSESESEPNDDENESGDLSESDSEGDRKRSKKSRKKSSSRQKKSSKRSGRRRRKSRYSDSDDSESEESDHKSKKRRRNSGSKSKSSKKKRSETESEKSYSDEDSGSELDAKGISNADEVQTAEIDAEALIYKEMIEAQKKPALDNEPVVGPMPLPRAEGHISYGGALRPGEGDAIAQYVQQGKRIPRRGEVGLSAEEIQKFESLGYVMSGSRHQRMNAIRIRKENQVYSAEDKRALAMFNYEEKAKREHKVMADLQRLVQRHIGQDVGPTHDPFAGKATDGSDA

SEQ ID NO: 11640 - protein, 233 aa, Coffea canephora
EDESGSEDSDASPSSGDRVNSKKQKSLRSKRSKKKRKTESDDEASLSAKSSDSAVEAKSKPKAAEEKPMLNEVDSEVLQFKELIESRKRAALENEPVVGPMPLPRAEGHISYGGALRPGEGDAIAQYVQQGKRIPRRGEVGLSAEEIQKFETLGYVMSGSRHQRMNAIRIRKENQVYSAEDKRALAMFNYEEKAKREQKVMADLQRLVQRHIGQDAGPSHDPFGGKSTEGAEA

SEQ ID NO: 11641 - protein, 486 aa, Medicago truncatula
MARLSSTIETPYQRHRHNDRRRTPDSDVSNDRPRYRRSPSYDSYDDRHTDRHRRRSISPENRNPRHHDNGNSNGNHLPKKFGHRNNGSYLDRNDSRRNESESDEELKGLSYEEYRRLKRQKMRKSLKHCIWNVTPSPPRRENDDLEDYGKPEEISEIIDVKKDKEIKQKAKSESESEESKESDSELRKKRRKSYKKSRESDSESESESEVEDRKRRKSRKYSESDSDTNSEEEDRKRRRRRKSSRRRRKSSRKKRRCSDSDESETDDESGYDDSGRKRKRSKRSRKSKKKSSEPVSEGSEEIELGSDSAVAKINEEIDDVDEEKMAEMNAEALKLKELFESQKKPALDDDEPPVGPMPLPRAEGHISYGGALRPGEGDAIAQYVQQGKRIPRRGEVGLSAEEISKFEELGYVMSGSRHQRMNAIRIRKENQVYSAEDKRALAMFNYEEKAKREHKVMADLNRLVQRHIGQDVGPIHDPFGAKDGSD

SEQ ID NO: 11642 - protein, 545 aa, Mimulus guttatus
MGRISSAVEIPERRRPLSHREDGRSSPDSRYHRRNVSYSRSRSPSLNRHHRRSPSPRPNRDRRRSPSPNRDRRRIPSPNRVLRRSFSRSRSRSGSPIRNGQNRNFRSSPDYSYPVHGENQISVDQKKFNFDNRKQPYLDRDSRNGQFPEPESDEELKGLPYEEYRRLKRQKLRKLMRNSIWNCTPSPPRDPNENSDAELDEDLVAEEEKQTKVLKAVAKKSKKSDSESESEESESESDDSRSKRGRKSGSRKKKSRRAKSVSESESVSEQSSDEDSEEDRKRKKKGGKKSRKGRSSKRSSRRKRSSRKKSLTSESESASDDSETSAGAKSKQRKHRSSSRSKKGKKKREVDSENSDSNGSASDQEAGGKELVHKADEVKVNDEMDDELLIFKEMMELRKKSNNLEEEQVVGPMPLPRAEGHISYGGALRPGEGDAIAQYVQQGKRIPRRGEVGLSAEEISKFETLGYVMSGSRHQRMNAIRIRKENQVYSAEDKRALAMFNYEEKAKREQKVMADLQRLVQRHIGQDTGPSHDPFGGRAVEGADD

SEQ ID NO: 11643 - protein, 496 aa, Orobanche aegyptiaca
MGRLTSAVEIPGRHRSAGLRENGRYSPRSHHRRDRSYSRSRSRSRSPTNNGYNRYRRSSPDYSYPNLDETQKFGDRKKLNYDIRKNPYLDRDNRNGRHAQSESDEELKGLNYEEYRRLKRQKLRKSLKNCIWNCTPSPPRDPNEKSDGELEENISKGEEEKQSKGSRLDAKNSREGESESESEDSDSESDDSRSRKGRKSRSRRKSRRLKSVSESESLSDDESSDSDSEEDRRRRRRERGKRNRSKRSSKKSSKRKRNSKKKHSKSESKSESESEDSDTSDRVKSKRKKQRSSSRSKRSKSKRESDSGLSDSRLDSEPDGKEVVPMADDVKVNDDMNEELLKFKEMIEQRKKPNIDDEPVVGPMPLPRAEGHISYGGALRPGEGDAIAQYVQQGKRIPRRGEVGLSADEISKFEDLGYVMSGSRHQRMNAIRIRKENQVYSAEDKRALAMFNYEEKAKREQKVMADLQRLVQRHIGQDTGPSHDPFSGKAGEGGDD

SEQ ID NO: 11644 - protein, 470 aa, Sciadopitys verticillata
MFSYTSMKSDRDVRRSGNDQLESDDEELKGLDFAEYRRLKRQKLRKKLRDCIWRITPSPPRDEMGRIENDKIANVAAINGINEADGKSKVKNDREISEDQGRKGGIVKKKGSRKYSDSESSDAEDSMSEKSSDDAVTSDLEDRRRRRKKKGNSRGKRSRNSGKSRKRKDRSEREESEEGSLSGDSYSSGGEVERPSKSRKGGNRHAKPKKKLRRRTGRSSKRSRARGSKDSSESASESEDGSHSTENEGSGRKKSKSSSVSKHSDLPKCKQKSSPESDEFSDHRSSEFELVGTEEEEKGDMSKLVEIDDEALIFKEMIESQKKLAAAGLENEPFVGPAPAPRAEGHISYGGALRPGEGDAIAQYVQQGKRIPRRGEVGLSAEEIQKFETLGYVMSGSRHQRMNAIRIRKENQVYSAEDKRALAMFNYEEKAKREHKVMSDLQRLVQRHIGQDVGPTHDPFAAKLPEDADG

SEQ ID NO: 11645 - protein, 687 aa, Picea glauca
  misc_feature (37)..(37): Xaa can be any naturally occurring amino acid
  misc_feature (44)..(44): Xaa can be any naturally occurring amino acid
  misc_feature (56)..(56): Xaa can be any naturally occurring amino acid
  misc_feature (68)..(68): Xaa can be any naturally occurring amino acid
  misc_feature (218)..(219): Xaa can be any naturally occurring amino acid
  misc_feature (225)..(225): Xaa can be any naturally occurring amino acid
  misc_feature (584)..(584): Xaa can be any naturally occurring amino acid
IQNSQMEDGRAAADGYPKERRRLASKVEYAGRSSSNXITGHPTXHEGFRGHSKNYXRSRSRSPDQSRXEHYRYPSSNGNRSTSHSKNYGRSRSRSPDPSRYEHYRYPSSNGNRSTSPSRSRGCYGKALSPNPRVSDRCYSPNEILDENPKRGGDTLRYERRPSTSPDLKYDQRPNSNLSHRQRFEDRSPNPPRNNNGLYDRRRSPNPNDGRRSPNPNXXNEPRHXDRRASPNYHPYDPSSGNRPPVFLDRGDPRRGRGNEQPESDEDEDLKAVDFAEYRRLKRQRLRKKLKNCIWRITPSPPRDEIEQAVARQMMDIEKGGNGIMLGNGAGAIENKEEFHGRSSKGGKGDDGDASRSKASGDSGKKAGDLTKKSGGRRKPSPTNSGSDYSESSDDGESRKDIKGGRSSRKKKSKSKHSGKRKRRHISVRESTEDDSDSVSEDDSSSCSSENEKMKKQTNRRRNRQEKRKKSLKRISGSKRSRVQSSEDEEKSEPHPESHVLSDDSLELESGKNEERASDDDPVEIDNEALRFKEMIESQKKVAAGLENEQIVGPLPLPKAEGHISYGGALRPGEGDAIAQYVQXGKRIPRRGEVGLSADEIQKFETLGYVMSGSRHQRMNAIRIRKENQVYSAEDKRALAMFNYEEKSKREHKVMSDLQRLVQRHIGQEVGPTHDPFGGKAPEVADG

SEQ ID NO: 11646 - protein, 158 aa, Taxus baccata
MFKEMIESQKKSATGGLENEPFVGPAPAPRAEGHISYGGALRPGEGDAIAQYVQQGKRIPRRGEVGLSADEIQKFESLGYVMSGSRHQRMNAIRIRKENQVYSAEDKRALAMFNYEEKSKREHKVMSDLQRLVQRHIGQDVGPTHDPFAAKDSEVADG

SEQ ID NO: 11647 - protein, 273 aa, Nicotiana tabacum
  misc_feature (19)..(19): Xaa can be any naturally occurring amino acid
LMRPLEESSDDSEEEERRXRRKKSWRKQSSRRRDKRGKKKRSKRKSYSDESESKSQSQESDSDDSDASKKQKRDLKSKKKKDDGDSDIPEKSLELDGDARINEKADETTIDEVDSELLEFKELIEARKKSNLDNEPQVGPMPLPRAEGHISYGGALRPGEGDAIAQYVQQGKRIPRRGEVGLSADEISKFEGLGYVMSGSRHQRMNAIRIRKENQVYSAEDKRALAMFNYEEKAKREQKVMADLQRLVQRHIGQDTGPSHDPFGGKSEEGADA

SEQ ID NO: 11648 - protein, 119 aa, Cedrus atlantica
ALRPGEGDAIAQYVQQGKRIPRRGEVGLSADEIQKFETLGYVMSGSRHQRMNAIRIRKENQVYSAEDKRALAMFNYEEKSKREHKVMSDLQRLVQRHIGQEVAPTHDPFAGKAPEVADG

SEQ ID NO: 11649 - protein, 552 aa, Malus domestica
MALSLFSLSAPPLCVRLETVCVRGHHPPSTYRRDDTVPITRTAGTHRTPTHPATTATSVAAPATKTTTATITAATETPLERPLDEALGATEEARNPWLGVAAPAMRTTSGTTTAATEIARARLITRTLDEALGLMGGQTLCRRNSGVAGTVWTGMEGREESEDSDEELKGLSFEEYRRLKRQKLRKSGKFCIWELTPSPPRVENDEFELVGKADVISERYGEEENIESQDKKKEKEKSESESESDSESEDLRSRKRKKSSGSKRRSRKSRYSDSESESESVSDDESDEEEDRRTRKKSKSRSKRSRSRRERRRKRKSRRSSSSELDESEDSESEVSDSKKKKKQRKSRSRSKKKESETEMESEISDSEKGLDSEVDAKAATLVEEEMMKDESNAEALKFKEIFEAQKKLSLDDEPVVGPMPLPRAEGHISYGGALRPGEGDAIAQYVQQGKRIPRRGEVGLSADEIQKFENLGYVMSGSRHQRMNAIRIRKENQVYSAEDKRALAMFNYEEKAKREHKVMADLQRLVQRHIGQDVGPTHDPFSGKEKEIADA

SEQ ID NO: 11650 - protein, 211 aa, Cephalotaxus harringtonia
MVSKISDSRKNKQISPSESNDFSEHSNSESEPVGTEEEKEDNSQPIEIDSEALMFKEMIESQKKSAAGGLENEPFVGPAPAPRAEGHISYGGALRPGEGDAIAQYVQQGKRIPRRGEVGLSAEEIQKFETLGYVMSGSRHQRMNAIRIRKENQVYSAEDKRALAMFNYEEKSKREHKVMSDLQRLVQRHIGQDVGPTHDPFAAKASEVADG

SEQ ID NO: 11651 - protein, 165 aa, Distylium racemosum
MEIDDEALMFKEMIESQKKSAAGLENEPFVGPAPAPRADGHISYGGALRPGEGDAIAQYVQQGKRIPRRGEVGLSAEEIQKFESLGYVMSGSRHQRMNAIRIRKENQVYSAEDKRALAMFNYEEKSKREHKVMSDLQRLVQRHIGQDVGPTHDPFAAKVPEVADG

SEQ ID NO: 11652 - protein, 378 aa, Lippia dulcis
YRRLKRQKLRKSLVKCIWNCTPSPPRNPNEKSDDELEEDFAGEDEKQNNGLKSGTKRSSESASEFEDSESESEPESDDSRSRKSRKSGSRRKSRRSKSVSESESESEESSSEEDSDEERRRRRRKSGKKSGRRKSSKRSSRRKKSSRKKRSTSESESNSEDSDMSDHVKPKKRKHRSKRNKKKRETDSESSDKSGTDSDAEVKDVAPMADEVKVNDDNEAELLKFKEMIESRKKTNIDDEPMVGPMPLPRAEGHISYGGALRPGEGDAIAQYVQQGKRIPRRGEVGLSAEEISKFENLGYVMSGSRHQRMNAIRIRKENQVYSAEDKRALAMFNYEEKAKREQKVMADLQRLVQRHIGQDTGPSHDPFGGRAGEAADD

SEQ ID NO: 11653 - protein, 159 aa, Pteridium aquilinum
MKFKVLLDAQKKSAVGLENEPIVGPAPAPKAEGHISYGGALRPGEGDAIAQYVQQGKRIPRRGEVGLSAEEIQKFEGLGYVMSGSRHQRMNAIRIRKENQVYSAEDKRALAMFNYEEKAKREHKVMSDLQRLIQRHIGQDVGPTHDPFAAKQPDAPADT

SEQ ID NO: 11654 - protein, 535 aa, Solanum lycopersicum
MGRLSSAVEIPDDRHRSHRNGDGGRYSPQRSSHYDNRRRYRSPSRSRSPIRNRNRNRSLSRSVSGSRSRSPAYSPYRSQQASHTNGRSNRRSFSPDRSYRRPSPTNEPPRRFGRGKKPYLDRDHKSGRTADSDSDEELKGLSFEEYRRLKRQKLRKQLKNCIWNCTPSPPRKENEPEYEEPDEIAEKIEDEMVKKEDGSKKDVKRSKTKSSGSEPDSESESDASDSDSEASDSEPRKSRKRKKSSSKRRSRRSRRKSVSESEEESTDDSSSEEERNKRRKKSRRKESSRRHKRGSSSRKKRSKRKSYSSESESKSKSESEDGEIDDSDASKKQKSALKSKRKKEGDSDIPEKSLELSDDAGINETKADEAMIDEVNGEVLEFKELIEARKRSNFEDEAPVGPMPLPRAEGHISYGGALRPGEGDAIAQYVQQGKRIPRRGEVGLSADEISKFEGLGYVMSGSRHQRMNAIRIRKENQVYSAEDKRALAMFNYEEKAKREQKVMADLQRLVQRHIGQDTETSHDPFGGKSTEAADD

SEQ ID NO: 11655 - protein, 525 aa, Aristolochia fimbriata
MGREDGEYENGDYRRSRLASRVEYPDRDRRADYRNGSRTPERGKRSSPRYSPFDAEDNRRRQNGYRNHSVEIDRRRDYDEGFSSPRRSPRRSPRRSPALESRRRHYDNRDGRAPYLDRNGGRHSDSEDDEELKGLTYEEHRRLKRQKLRRSLKNCVWNVTPSPPHHERGSFGPSDDEKEDIDSPSDNGKKSDIRDRPSASESERILSSETSRSQSESDTGRTPPRKTKKGRTMRRKNRTSSRSRRSDSSSGSDEEYSSSKSSSEEDDAKRKKKPKRRQRKKSSRDTRRSAKRSRKGRRGRSSDESTSTETESSDYSSSQSSDYEKTKKKKLSTRSKKNKNDSEGSDSDADVETNAKVDEIKIPEINTEVLKFKEIIELQKKPSLDNESFVGPVPLPRAEGHISYGGALRPGEGDAIAQYVQQGKRIPRRGEVGLSAEEIQKFESLGYVMSGSRHQRMNAIRIRKENQVYSAEDKRALAMFNYEEKAKREHKVMADLQKLVQRHIGQDVGPTHDPFGTKGSDTADT

SEQ ID NO: 11656 - protein, 152 aa, Cichorium intybus
MIESRKKATIDDDEPEVGPMPLPRAEGHISYGGALRPGEGDAIAQYVQQGKRIPRRGEVGLSAEEISKFEDLGYVMSGSRHQRMNAIRIRKENQVYSAEDKRALAMFNYEEKAKREQKVMADLQRLVQRHIGQDTGPSHDPFGGRVTEDPDA

SEQ ID NO: 11657 - protein, 112 aa, Festuca arundinacea
RPGEGDAIAQYVQQGKRIPRRGEVGLSADEIQKFEDLGYVMSGSRHQRMNAIRIRKENQVYSAEDKRALAMFNYEEKSKREHKVMADLQRLVSRTIGEETGPSHDPFAATDD

SEQ ID NO: 11658 - protein, 211 aa, Nicotiana benthamiana
  misc_feature (131)..(131): Xaa can be any naturally occurring amino acid
  misc_feature (205)..(205): Xaa can be any naturally occurring amino acid
DDSDACKKQKHSLKSKKNNDDGDSDIPEKSLELDREAGINEKADEPKIDEVDNELLEFKELIEARKKSNLDNEPQVGPMPLPRAEGHISYGGALRPGEGDAIAQYVQQGKRIPRRGEVGLSADEISKFEGXGYVMSGSRHQRMNAIRIRKENQVYSAEDKRALAMFNYEEKAKREQKVMADLQRLVQRHIGQDTGPSHDPFGGKXEEGADA

SEQ ID NO: 11659 - protein, 535 aa, Solanum tuberosum
MGRLSSAVEIPDDRHRSHRDGDGGRYSPQRSSHYDNRRRYRSPSRSRSPVRNRNRSLSRSVSGSRSRSRSPVYSPYRVQQASHTNGRNNRRSFSPDRSYRRPSPTNEPPRRFGRGKKPYLDRDHKSGRTADSDSDEELKGLSFEEYRRLKRQKLRKQLKNCIWNCTPSPPRKENEPEYEEPDEIAEKIEDEMVKKEDGSKKDVKKSKTMSSGSESNSKYESDASDSDSEASDSEPRKSRKRKKSSSRRRSRRSRRKSVSESEEESTDDSSEEEERNKRRKKSKRKESSGRHKRGSSSRKKRSKKKSYSSESESKSKSESEDGEIDDSDASKKQKSALKSKKKKEEDSDIPEKSLELNDDAGINEMKADEAMIDEVNGEVLEFKELIEARKRSNFEDEAPVGPMPLPRAEGHISYGGALRPGEGDAIAQYVQQGKRIPRRGEVGLSADEISKFEGLGYVMSGSRHQRMNAIRIRKENQVYSAEDKRALAMFNYEEKAKREQKVMADLQRLVQRHIGQDTETSHDPFGGKSTEAADD

SEQ ID NO: 11660 - protein, 331 aa, Pseudotsuga menziesii
KLLKTAERKRGDLMKKNGGRRKSSTPTTGSDYSESSDDDRSRRDIKGGRSSRKRKRKTKHSGKSRKRRSISVKEYSEDDSDSVSEDDSSSYSSENEKSKKQTNRRRNRDEKQKKSEKRMSGSKRSRVKSSEDEEKSETHSESHVSSDDSLELESIKHEERAADNDPVEIDNEALRFKEMIESQKRVAAGLENEPIVGPLPLPKAEGHISYGGALRPGEGDAIAQYVQQGKRIPRRGEVGLSADEIQKFETLGYVMSGSRHQRMNAIRIRKENQVYSAEDKRALAMFNYEEKSKREHKVMSDLQRLVQRHIGQEVAPTHDPFASKEPEVADG

SEQ ID NO: 11661 - protein, 476 aa, Triphysaria pusilla
MGRISSAVEIPYRRRTSSHHRDNDRYSPEPRRSYNRRERSYSRSRSPIRRRTLSRSRSRSPINNGHNRYRRYSPDYSYPNPAETQRPSDRNKLNYDNRKTPYLDRDHLNGRFPEPESNEELKSLPYEEYRRLKRQKFRKLLRYCIWSCSPSPPRAPNEKSDVEIEEDFQVEEENEIRVSRPDAKKSPDSKSKSDSESESESESGDSSSKKGRKSRSRRRSKRSKSVSESESESDTSDSDSEEDRRRRRKSSKKKRKSSKKSGRRKKSNRKKHLSSESEGSDRVNSKARSDSEPDDNTAEDVVALPEADEVMINGEMNEELLMFKEMIEQRKTHALDEEPPVGPMPLPRAEGHISYGGALRPGEGDAIAQYVQQGKRIPRRGEVGLSAEEISNFETLGYVMSGSRHQRMNAIRIRKENQVYSAEDKRALAMFNYEEKAKREQKVMADLQRLVQRHIGQDTGPSHDPFGGRAGEGGDD

SEQ ID NO: 11662 - protein, 167 aa, Juglans hindsii x Juglans regia
ATMVEIDAEALRFKEMIDAQKKLPALDNEPVVGPMPLPRAEGHISYGGALRPGEGDAIAQYVQQGKRIPRRGEVGLSAEEIQKFEGLGYVMSGSRHQRMNAIRIRKENQVYSAEDKRALAMFNYEEKAKREHKVMADLQRLVQRHIGQDVGPTHDPFGGKASDDPDA

SEQ ID NO: 11663 - protein, 461 aa, Triticum aestivum
SVESGLDHASPKPLPRTPPRRSPSPFRDRRRQWSPYHNERGRDMDRVRDVEPPARRGGGGGGEWSASDDDDEDLKGLTYFEYRRVKRQKLRKSLKKCIWKVTPSPPRRDDEADEYQYSEEEEEKKESPKKESSEKSDEENKDSSESETDESGSLSDSSESDYSRKKKKGRKDRRSSSKRSRRAHRRHRKSDVESESDSKVDEDSEGSDDSEDSRDKRRSKRSRRHKKSKRRGRSSRRKKSKSLDVPSDVSSEEVEVLVSSPISTDSKKMGKSSRKKSSSQSDSEDSIPSDAIIDEKEIEETDEPEIDPEAIKFKEMLEAQKKAALENEMPVGPMPLPRADGHISYGGALRPGEGDAIAQYVQQGKRIPRRGEVGLSADEIQKFEDLGYVMSGSRHQRMNAIRIRKENQVYSAEDKRALAMFNYEEKSKREHKVMADLQRLVSRTIGQETGPSHDPFAATDD

SEQ ID NO: 11664 - protein, 528 aa, Malus domestica
MGRPSSTIHIPDRRRRSDHENGRYPRHSDSSGDNRYQRRSPSYESYDNRGHRNPSGSPPRRSPRGNRGGPDSLARRRSPSYEDYDRRTHRNRSGTPDYPNPRRSPRANGGPDSLPKKFGRGGNMDRGRRSESEESDDELKGLSFEEYRRLKRQKMRKSGKFCIWELTPSPPRFENDEFELVGKADEILERYGEEEKMEPKDKKNEKEKSESESESDLESEDLRSRGRKKSSGSKRRSRKSKYSDSESESESESESDYESDEEEDRRRRKKSKSRSKRSRSRRERRRKRKSRHGSSSESDESEDSESEGSDLKKKKKQRKSRSRNKKKESETEMESEKSDSEEKGLDSEVDAKAAALVEEEVMKDESNAEALKFKEIFEAQKMLSLDDEPVVGPMPLPRAEGHISYGGALRPGEGDAIAQYVQQGKRIPRRGEVGLSADEIQKFENLGYVMSGSRHQRMNAIRIRKENQVYSAEDKRALAMFNYEEKAKREHKVMADLQRLVQRHIGQDVGPTHDPFSGKEKEIEFADT

SEQ ID NO: 11665 - protein, 105 aa, Brassica juncea
RGGKRIPRRGEVGLNADEIQRFEDLGYVMSGSRHQRMNSIRIRKENQVYSAEDKRALAMFNYEEKAKREAKVMSDLSRLVQRHMGQDLGPNHDPFGAGKTDPPDD

SEQ ID NO: 11666 - protein, 424 aa, Amorphophallus konjac
PNPSRSRSPLDDPRRPSNGYSTYDCRRSKSPLDEPRHHSNGHPTFDRRRASRSPESLVPTSFRGRGGGESRGDRYGRRGSYLDRDARGGGGRRSGSDDSDDEELKGLEYHEYRRLKRQKLRKKLKNCIWRVTPSPPPGEWQPPSDAEAEPETKEEEKKAGGAGGGRSDGSEGSPSKDSDSGSGSGSESEGDGSPKRSRDRRSRSRRHRGKRSRGTKSSSRRGRRRGRSGDERSDEDSSGESESSYGSASDEEERKRRKRRSSDKGRSRKSRKSSNKNGKRRRSRSSSLDESEESEASHFSDMSDEPKRRKHSKNSKKRKRTESEASDSDGEARQDDVKMPEIDPEALMFKEMIESQKKQMLENEPFVGPAPLLGRKGTYDMVVLSGLVREMLLPSTCSRGSVSPEEEKSACLLKKFRSLRTWGT

SEQ ID NO: 11667 - protein, 439 aa, Eucalyptus grandis
MGGPYSGAVSGRRDRYHGEDGRRRHSPESDRPAEYRRRRSPSYESFDRRDDRRGREPDRRDRRGRSPSLSPSYDDRYDDRRDGSGQRRRRGSPRASDSRRSPRADGALDSLPRQFGKKRPYLDRDYRGNGRFSESDSDEELKGLSTEEYRRLKRQKMRKAMKFCIWNCTPSPPRYEGDEMEEKAEEIDEKYGEDLEKSDSSGKEDGKAKGKGKSKSDSEESSDGGADSESEPSASGSRKKKRSSSSKRRSRELSGTESESESERESESDDPASKKKKKGKSSSFVKGRVGKCVIPRVNWRTKVNRRIPLRGGGRGGRVLKGGARESAIARVDRRSRARKNQMRKRIKKGRKDPGNGLVGGQGVGEEVAGDEAVGKARGDIVNLMIARVKIAKLRILMSNQRRTRAHQDWARKVAVRVRVVLRMIAMFRIRARDHNLSLI

SEQ ID NO: 11668 - protein, 451 aa, Phalaenopsis aphrodite
MGRENSRVSPAPARHAADDWRSRRNPISETSPRRRRRWSPYHDRPISRRSENSSEEEDLKGLSYFEYRRIKRQRLRKKLKNCIWKVTPSPPGSDRELSEPPQEEPERSADLPSDDDKRKMKESGSEGSDGSGRSSGDSGSGSESPHRKSRSRRSGRTSKRRRYSVSSDSASETDSDASSDFDSRSYSDYLSDSDDQSRRRKRSSAKRRGRGTESVHSRNNRKRSSRSSRKKKRKEVTSDYSDSSDSESSPSARKKRTTTSKKKTINRQSKLENMFESDGNVGAPDANKPEIDPEAVKFMEMIELQKKQALDSESLVGPMPLPRAEGHISYGGALRPGEGDAIAQYVQQGKRIPRRGEVGLSAEEIQKFENLGYVMSGSRHQRMNAIRIRKENQVYSAEDKRALAMFNYEEKAKREHKVMADLQRLVQRHIGPDMGPTHDPFAPKALEGDDA

SEQ ID NO: 11669 - protein, 216 aa, Silene vulgaris
SEGERKRKRNKKKKVVRESSEDGSGSDSGKAKSELDIDETGLKIVETGNVDDDEINPEVLKFKVMLEAQKMEAAMVNEPIVGPQPLPKAEGHISYGGALRPGEGDAIAQYVQQGKRIPRRGEVGLSADEISKFEDLGYVMSGSRHQRMNAIRIRKENQVYSAEDKRALAMYNFEEKAKREGKVMTDLKRLVQRTIGQDVAPNHDPFGAKDEGDVEP

SEQ ID NO: 11670 - protein, 183 aa, Sorghum bicolor
RSDSEESVPSDATPVDAKEIEETIVPEIDPEAIKFKEMLEAQKKAALENDMPVGPMPLPRAEGHISYGGALRPGEGDAIAQYVQQGKRIPRRGEVGLSAEEIQKFEDLGYVMSGSRHQRMNAIRIRKENQVYSAEDKRALAMFNYEEKSKREHKVMADLQRLVQRTIGHDVGPSHDPFATTDG

SEQ ID NO: 11671 - protein, 550 aa, Tabernaemontana elegans
DYRRYSPEPYRSEDFRRRNRSLSRSPSLSRSRSRSFSRSRSRSPIYNGYSRYDHRDRRPSPDYSYPRRSPKSDRGYGDRKKPFLDRDYRNNRHTGSESDEELKGLNFEEYRRLKRQKLRKMLKDCIWNCTPSPPRDPNEPEDQAFEEDLVGKGDEQDETRDKEKKKDQMSKSDIRSPSESGSEPDSESTEVSDSESDHSGSRKKRKSRKSSSRRGKRRSKSVSESESESDELSEDSEDDLGSRKKKKSRVSSSRRGKRRSKSVSETESESDELSEDSEEDRKARRRKSRKKGSRQSRSSRSSSKRKRNSRQKAYSDESESKDENESDDSEANRSSDDRAKTKRPKHSRSKHSKKRESETDSEVSYSGRSSGSPDDEHKQKVTEEAQISDVNSEVLKFKELLEARKKATLENEPAVGPMPLPRAEGHISYGGALRPGEGDAIAQYVQQGKRIPRRGEVGLSAEEIQKFEGLGYVMSGSRHQRMNAIRIRKENQVYSAEDKRALAMFNYEEKAKREQKVMADLQRLVQRHIGQDSGPSHDPFGGRSSEGPEA

SEQ ID NO: 11672 - protein, 511 aa, Valeriana officinalis
MARRISSIVQAPENRSRSSRDNRRNSPDYAPYEDRRRITSRDSRRSYSRSRSPVNNQKRYDHSPVYRNSRSPDYSNRRRSPRSDNLRSERRSNYVEPKKTYLDRDFRNGDGPASESDEELKGLSFEDYRWQKRQKMRKVLRNCIWNVTPSPPRNDDELIDYNDKDSSDEEKEKEARLKLESSKVVSGSESDKSEPDSESELDDSDRRSRRKRKSKRKSSSSKRRSKKSVTDSEGESDDESSDDDDDTSRRRKRRSSKTKSRRSKKSSKKSSRRKRIKDSSSDKSSEDDEESEEEASKLKRIKGGSSSESRKRKKRRDSVSKSPSKDEKSDSEPETKIIPHIDEPESNEVDDELIMFKEMLESRKKLALETEQVVGPMPLPRAEGHISYGGALRPGEGDAIAQYVQQGKRIPRRGEVGLSAEEISKFETLGYVMSGSRHQRMNAIRIRKENQVYSAEDKRALAMFNYEEKAKREQKVMADLQRLVQRHIGQDTGPSHDPFGGRSTAAEPADP

SEQ ID NO: 11673 - protein, 403 aa, Hordeum vulgare
GGGGEWSASDDDDEDLKGLTYFEYRRVKRQKLRKSLKKCIWKVTPSPPRRDDEADEYQYSEEEEEKKESPKKDSSDKSDEEKNKDSSESESDASGSLSDSSESDYSRKKKKGRKGRRSSSKRSRRAHRRHRKSDMESESDSKDEDSEGSYDSEDSRDKKRSKRSWRHKKSKRRGRSSKRKKSKSLDVPSDASSEEVEVVGSSPISTDSKKTGKSSRKKSSSQSDSEDSIPSDAIIDEKEIEETDEPEIDPEAIKFKEMLEAQKKAALENEMPVGPMPLPRADGHISYGGALRPGEGDAIAQYVQQGKRIPRRGEVGLSADEIQKFEDLGYVMSGSRHQRMNAIRIRKENQVYSAEDKRALAMFNYEEKSKREHKVMADLQRLVSRTIGQETGPSHDPFATTDD

SEQ ID NO: 11674 - protein, 520 aa, Brachypodium distachyon
MSRTGSRLASVVRLPDRSRVSASPSPHRRALSRSPSPRRQRRRDRSPSPARVRRRDRSPSPSRVRRRDRSPSPYQDRRRDRSPSPFRDRRRQWSPYHNDRGRDRDRVRDVEPPARRGGDGGGAWSASDDDDEELKGLTYFEYRRLKRQKLRKNLKRCIWNITPSPPRRDDEADEYHYSEEEEDKEKKESPKKDSSDKSEDEENKNSSESESGESGSLSDSSESDYSRRKKKGRKGHRRSSSSKRSRRAHRHHSSDMGSESDGKVDEDSEGSSDSEDSRDKRSRKRSRRHKKSKRRGRSSGRKKRKSLDLPSDGSSEEVEVSGSSPERKTGKSSRKKRSKQSDSEDSIPHDPNAEKEVEETDVPEIDPEAIKFKEMLEAQKKAALENEMPVGPMPLPRAEGHISYGGALRPGEGDAIAQYVQQGKRIPRRGEVGLSADEIQKFEDLGYVMSGSRHQRMNAIRIRKENQVYSAEDKRALAMFNYEEKSKREHKVMADLQRLVSRTIGQDSGPSHDPFATTDG

SEQ ID NO: 11675 - protein, 531 aa, Cucumis sativus
MGRLGSTVEIPERRHRSDRENGTHRYSPDSDASRGDYRRRRSPSYENYDRYNHRRRSVSPGYEDVRRSPRVDGDQNGLPKRFGRPGGRAYLDRNGRASDESDSDEELKGLNYEEYRRLKRQKLRKSLKHCIWRVTPSPPRNGNEEYEEKYEEILEKYGGDGDGDGGVKSGLNEKKQLEEKYVSDKTKNSDSDSDSELSDRKLERRESKSSGSRRRSRKSSPSDSESCSDTESESESESEEESRRRRKKSTSRRSRKHKNIKSSKKKKNRYSDTEDSEESETGDSDVSDHVKSRKRSRSKRSKNSRKRKYSDSEESEDSEGEKLRKRKSSSTLSKSRSKRKRQSETESKSCSSAEEDSGSEDIDDKSKLMVDGETMAEINAAEALKIKEILEAQKKPAFDNEMPVGPMPLPRAEGHISYGGALRPGEGDAIAQYVQQGKRIPRRGEVGLSAEEIQTFETLGYVMSGSRHQRMNAIRIRKENQVYSAEDKRALAMYNYEEKAKRERKVMDDLQRLVQRHIGHDVGPSHDPFAG

SEQ ID NO: 11676 - protein, 364 aa, Solanum melongena
RTENEPEYEEPDEIVEKIEDEMVKDDGFKKDVKRSKTKSSEGESDSESESDASDTDSESSDSEPRKSRKRKKSSSRRRSRRSRRKSESESAEEPTDDSSSEEDRSTRRKKSRRKVTNRRRKRGSSSRKKRSKRKSYSSESESESKSESEDGEIDDSDASEKQKGALKSKKKKDVDSEVPEKSSESNGDARINEKMVDKTMKDEVNSEVLEFKELIEARKKSNFEDEAPVGPMPLPRAEGHISYGGALRPGEGDAIAQYVQQGKRIPRRGEVGLSADEISKFEGLGYVMSGSRHQRMNAIRIRKENQVYSAEDKRALAMFNYEEKAKREQKVMADLQRLVQRHIGQDTETSHDPFGGKSAEGADA

SEQ ID NO: 11677 - protein, 540 aa, Vitis vinifera
MGRPSSTVEIPDKRHRIENGGHSPDSDSPRDHRRRRSPDYGRYDPDSERRHRRRSDSPDYPNPRRSPRSDARRVGSGDRKNRSATFLDRDYKNGRYSESESDEELKGLSFEEYRRLKRQKLRRMLRNCIWNVTPSPPRNANEEEFEPEPEEFTEKYVVEEDKRENNDLKKEIKGSAKSELERSERSESESESESDSESEDSRSRRKRKGSRSRRRTGKSSYSDSESDGDDSESDDYEDSRSRKKGKSSSSRRNKKSSYSDSDSEDDASESDDEKEDNRRKKKSSRSRSRRSGSSRKSSKRKRRSRRSYSDESDSEVSGSDESDRPRSQKQGQALSTKSKRSKKKSRSETYSESSYSDKSSDSEVDAKSKMKAEDVMINEVNAEALIFKEMIESQKKPALDNEPTVGPMPLPRAEGHISYGGALRPGEGDAIAQYVQQGKRIPRRGEVGLSAEEIQKFEGLGYVMSGSRHQRMNAIRIRKENQVYSAEDKRALAMFNYEEKAKREHKVMADLQRLVQRHIGQDVGPTHDPFAVKGAEGTDT

SEQ ID NO: 11678 - protein, 364 aa, Vitis vinifera
KSELERSERSESESESESDSESEDSRSRRKRKGSRSRRRTGKSSYSDSESDGDDSESDDYEDSRSRKKGKSSSSRRNKKSSYSDSDSEDDASESDDEKEDNRRKKKSSRSRSRRSGSSRKSSKRKRRSRRSYSDESDSEVSGSDESDRPRSQKQGQALSTKSKRSKKKSRSETYSESSYSDKSSDSEVDAKSKMKAEDVMINEVNAEALIFKEMIESQKKPALDNEPTVGPMPLPRAEGHISYGGALRPGEGDAIAQYVQQGKRIPRRGEVGLSAEEIQKFEGLGYVMSGSRHQRMNAIRIRKENQVYSAEDKRALAMFNYEEKAKREHKVMADLQRLVQRHIGQDVGPTHDPFAVKGAEGTDT

SEQ ID NO: 11679 - protein, 499 aa, Zea mays
MSRSERRLASAVVRLPGRSRVSASPSPRRRSQSPSPRRDRRRRDRSPIPYRDRSPSPYRARRRDRSPSPYRDRRDRSPSPYRDRRRQWSPYHNDRGRDRDRVLPVRSGGGAWSDDDDDDKELQGLSYFEYRRLKRQKLRKSKKRCIWNITPSPPRVEGDEENYGYSDVEEEKVSPKASPEASEEESKDASESESGESDSLSESSGSEASMRKKKGRNKSRRSSKRSRQRHRHRSYSSEIEDESKSDDDSVGSYDSEESRDRSKKRSRRHNRSKKRSRSSRRKKRRSQDTASEQSSEEEEEEDSKKKNKGLKRKRSKRSDSEESVPSDATPDDVKEIEETKVPEIDPEAIKFKEILEAQKKASLENDMPVGPMPLPRAEGHISYGGALRPGEGDAIAQYVQQGKRIPRRGEVGLSAEEIQKFEDLGYVMSGSRHQRMNAIRIRKENQVYSAEDKRALAMFNYEEKSKREHKVMADLQRLVQRTIGHDVGPSHDPFATTDG

SEQ ID NO: 11680 - protein, 293 aa, Avena sativa
TTYSSRRSRRAHRRRRSSDITSDSDGNADEDSEGSYDSEDSRDRRRSKRSRRHRKSKRSGRSSRRKKSKSLNIPSDGRSEEEEKDVSGSSPISMDSKKSGKSSKKKRSKESDSEDSIPSDAVASADDKEVENTDEPGIDPEAIKFKEMLEAQKKAALENEMPVGPMPLPRADGHISYGGALRPGEGDAIAQYVQQGKRIPRRGEVGLSADEIQKFEDLGYVMSGSRHQRMNAIRIRKENQVYSAEDKRALAMFNYEEKSIREHKVMADLQRLVSRTIGQETGPSHDPFAATDD

SEQ ID NO: 11681 - protein, 77 aa, Elaeis guineensis
MSGSRHQRMNAIRIRKENQVYSAEDKRALAMFNYEEKAKREAKVMVDLQRLVHKHIGQDMGPTHDPFAPKASDAADS

SEQ ID NO: 11682 - protein, 587 aa, Podocarpus macrophillus
GIAVSRTEETGITNAEGIEPPILRRREDEEDYGRKTYGRSRSRSRDRSRYERYIPSKNGKRSSTSPMLRRSYSPNPNPNNPNYSHRRNPRSEIQCNGNRMESRSPSPNYDRRGSPDYNPYKTSGNRQGFLDRETRRRGEDSDSEDEELKGLDFAEYRRLKRQKLRKKLKNCIWRITPSPPRDGRVSYDEYEGALNGNGDVCVGKLEGKEVGEGFEEGKEGKKADVVVKKVLKKSSGSVFDSESEDDSEDLSEDEDSSDGGDRKVTKKRRNYSRKGGRHSGKRKHGKTSVRVKTVERMIVGLEIPSLIVVRMRGIERGGKVGAGVRRVRTRKRLEERLRDRGRSLRKPKHSSESASGSEDDSDSSESDGNVRKKSSVSMLSDRRRHKRRPSSDNDLSTDRSNSGFETDLKGSEEENEDNTKSAEIDNEALIFKEMIESQKKSAAAGLENEPFVGPAPAPRAEGHISYGGALRPGEGDAIAQYVQQGKRIPRRGEVGLSAEEIQKFESLGYVMSGSRHQRMNAIRIRKENQVYSAEDKRALAMFNYEEKAKREHKVMSDLQRLVQRHIGQDVGPTHDPFAPKPSEAVDA

SEQ ID NO: 11683 - protein, 531 aa, Prunus persica
MGRPSSTIHIPDKRHRSEHENGRYPPHSDSSGDNRYQRRSPSYESYDRYNNNRNRHRNRSGSPDRPNPRRSPRTNGDPGSLAQRRSPSYDRYNNHRDRNRSGSPDYPNRRSPRAKGGPDSLPNKFGRGGNRMDRNGRRSESEESDEELKGLSFEEYRRLKRQKLRKTLKYCIWNVTPSPPRVENDEFELEDKADEISERYGEEEKSESGEKKKEKAKSESESESEDLRSRKRKKGLSSKRRGRNSKYSDGESESESDDESESDEEDDRRQRKKSKKRSKRSKSRRERRRRRKSRRSSSDSDESEKSESEGSDSESEDRLRSKKKGKSSSRSKTKKESGIDRESSDSEKGLDSEVDAKPVTMVEEEVIKDESNVEALKLKDIFEAQKKPALDSEPVVGPMPLPRAEGHISYGGALRPGEGDAIAQYVQQGKRIPRRGEVGLSADEIQKFESLGYVMSGSRHQRMNAIRIRKENQVYSAEDKRALAMFNYEEKSKREHKVMADLQRLVQRHIGQDVGPTHDPFSGKASESADT

SEQ ID NO: 11684 - protein, 188 aa, Pseudoroegneria spicata
KKKSSSQSDSEDSIPSDAVIDEKEIEETDEPEIDPEAIKFKEMLEAQKKAALENEVPVGPMPLPRADGHISYGGALRPGEGDAIAQYVQQGKRIPRRGEVGLSADEIQKFEDLGYVMSGSRHQRMNAIRIRKENQVYSAEDKRALAMFNYEEKSKREHKVMADLQRLVSRTIGQETGPSHDPFATTDD

SEQ ID NO: 11685 - protein, 212 aa, Sequoia sempervirens
DRRKHKQQSPSENNALSEPSNCDSEPVGIEEDKEDKSLPVEIDDEALMFKEMIESQKKSAAAGLENEPFVGPAPAPRAEGHISYGGALRPGEGDAIAQYVQQGKRIPRRGEVGLSAEEIQKFESLGFVMSGSRHQRMNAIRIRKENQVYSAEDKRALAMFNYEEKSKREHKVMSDLQRLVQRHIGQDVGPTHDPFAAKASEVADGRFLWMVC

SEQ ID NO: 11686 - protein, 504 aa, Sorghum bicolor
MSHRSERRLASAVVRLPGRSRVSASPSPRRRSQSPSPRRDRRRRDRSPIPYRDRSPSPYRNRRRDRSPSPYRDRRGRSPSPYRDRRRQWSPYHNDRGRDRDRVPPVRSGGGAWSDDDDDDKELQGLSYFDYRRLKRQKLRKSKKRCIWNITPSPPRVEGDEENYGYSDVEEEKASPKGSPEASEEESKDASESESGESDSLSESSESEASKRKKKGRKSSRHRSKRSRRRHRHRSYNSEIEDESESDDDSEGSYDSEDSRDRSKKRSRRHNRSKKRGRSSRRKKRRSQDTASEQSSEEEEEEEEEEDSKKKSKSSKRKRSKRSDSEESVPSDATPVDAKEIEETIVPEIDPEAIKFKEMLEAQKKAALENDMPVGPMPLPRAEGHISYGGALRPGEGDAIAQYVQQGKRIPRRGEVGLSAEEIQKFEDLGYVMSGSRHQRMNAIRIRKENQVYSAEDKRALAMFNYEEKSKREHKVMADLQRLVQRTIGHDVGPSHDPFATTDG

SEQ ID NO: 11687 - protein, 515 aa, Sorghum bicolor
MSHRSERRLASAVVRLPGRSRVSASPSPRRRSQSPSPRRDRRRRDRSPIPYRDRSPSPYRNRRRDRSPSPYQDRRGRSPSPYRDRRGRSPSPYRDRRRQWSPYHNDRGRDRDRVPPVRSGGGAWSDDDDDDKELQGLSYFDYRRLKRQKLRKSKKRCIWNITPSPPRVEGDEENYGYSDVEEEKASPKGSPEASEEESKDASESESGESDSLSESSESEASKRKKKGRKSSRHRSKRSRRRHRHRSYNSEIEDESESDDDSEGSYDSEDSRDRSKKRSRRHNRSKKRGRSSRRKKRRSQDTASEQSSEEEEEEEEEEDSKKKSKSSKRKRSKRSDSEESVPSDATPVDAKEIEETIVPEIDPEAIKFKEMLEAQKKAALENDMPVGPMPLPRAEGHISYGGALRPGEGDAIAQYVQQGKRIPRRGEVGLSAEEIQKFEDLGYVMSGSRHQRMNAIRIRKENQVYSAEDKRALAMFNYEEKSKREHKVMADLQRLVQRTIGHDVGPSHDPFATTDG

SEQ ID NO: 11688 - protein, 513 aa, Fragaria vesca
MARPSSTVHVPNRRFRSDHDNGRRSPPDYDNSPDGRRQRRSPSYERYDRHRKRSYSPDFPSPRRSPRSNGGRRLGRAGNDRSYSPDYSNPRRSPRSNGGPDSLPRRFGRAGDDRDRNGRRPELEDSDEELKGLNFEEFRRLKRQKLRKALRGCIWNVTPSPPRNEDDEFELEDKAEEIPEGFGGEDEDSGEKLKEKGKSESESESESEDLKSRKRNKSSGSKRRRKSSKYSDSESESVSDDESDEEEDRRRRRKSRTRSKRKKSRRERRRRRKSRRSSDSDESEVSDSESSDSDRVKSKKKKRKVSSKSKKKKYSETESEDSGSEKSLDSEVDAKPKALVAVEEPEMDENSIEALKLKEILEAQRNPSLDLDNEPVVGPMPLPRAEGHISYGGALRPGEGDAIAQYVQQGKRIPRRGEVGLSAEEIQKFEGLGYVMSGSRHQRMNAIRIRKENQVYSAEDKRALAMFNYEEKAKREHKVMADLQRLVQRHIGQDVGPTHDPFSSKASEDPDDD

SEQ ID NO: 11689 - protein, 535 aa, Eucalyptus grandis
MGGPYSGAVSGRRDRYHGEDGRRRHSPESDRPAEYRRRRSPSYESFDRRDDRRGREPDRRDRRGRSPSLSPSYDDRYDDRRDGSGQRRRRGSPRASDSRRSPRADGALDSLPRQFGKKRPYLDRDYRGNGRFSESDSDEELKGLSTEEYRRLKRQKMRKAMKFCIWNCTPSPPRYEGDEMEEKAEEIDEKYGEDLEKSDSSGKEDGKAKGKGKSKSDSEESSDSEADSESEPSASGSRKKKRSSSSKRRSREFESGSEVESEKESDEEEDQKGKKRSRKRSSRRTRSGRRSSRRRSSRKSKRRYSESDDSEGEDSEAEDSDVKPKKDKGSSRLGKKSRSQSKSGIEDDSDVSNSSERPQSEPDLNGLDSEVKAEIDAEALMFKEMIESQKKPALDNEPVVGPMPLPRAEGHISYGGALRPGEGDAIAQYVQQGKRIPRRGEVGLSAEEIQKFEGLGYVMSGSRHQRMNAIRIRKENQVYSAEDKRALAMFNYEEKAKREHKVMADLQRLVQRHIGQDIGPTHDPFAGKAADGPEA

SEQ ID NO: 11690 - protein, 188 aa, Salvia sclarea
APDLEVDTEDVTEKMANEIVVGEDVNDEILKFKEMIELRKKQNMEDEEEVVGPMPLPRAEGHISYGGALRPGEGDAIAQYVQQGKRIPRRGEVGLSAEEISKFETLGYVMSGSRHQRMNAIRIRKENQVYSAEDKRALAMFNYEEKAKREQKVMADLQRLVQRHIGQDTGPSHDPFGGSGRAAEVSDD

SEQ ID NO: 11691 - protein, 486 aa, Zostera marina
MGRGEHNRRLSSTVEVSRRRQYSSSPDYSNYVNSRQHRRRSPSPYQSPRRHETFRENDSARGRSKQDWRNGNHWERMEDERNEEEEDEELKGLNYEEYRRLKRHKLRKTLKCCIWRATPSPPPDEGWDDGEEEEEEKVEEKVPPIQEKKKIKDRSFSNKVGKRVDSFSDSSDSESSQNKSEEERKSKKRNRRRSLSDDEDDRKKRGKKRRNDRQRKSKRSHKHGRNSRRTSSYDSSDYSEEEDTKKRRNSRSKTKRSNNKKKIRISESESSTDDQSSSSYSSYRSSESGAKMKPSKRVEKVMINGQGDSLCLDNVSDSQMGEKITQEKDESKSVVFAGVLELSQKQTDVDIDDDDDSVVGPMPLPRAEGHISYGGALRPGEGDAIAQYVQQGKRIPRRGEVGLSADEIQKFENLGYVMSGSRHQRMNAIRIRKENQVYSAEDKRALAMFNYEEKAKREQKVMVDLQRLVQRHIGQDVGPTHDPFAS

SEQ ID NO: 11692 - protein, 500 aa, Pseudotsuga menziesii
PDPSRYERDRYLSSNGKRSTSPSPSRSRVCYSKALSPSSRVSDHYYSPNEILDENPRRGADNLRYERRRSRSPDLKYDPRPNPNLSHRQSFEDRSSNPPPRHNNGSYDRRRSPNPNDRRRSPNPNDRGRSPNLIDRRQSPNPNNRRRSPNLNFDNEQQHRDRRASPSYHPYDPSTGNRPPAFLDRGDAQRGRGNGQVESDDEDEDLKAVDFAEYRRLKRQKLRKKLKNCIWRITPSPPRDEIEQAVARQTMDNEEGGHGVMFGNVGRAIESKEESHGRSSKGGKGDDGDASRSKASEDSGKKAGDLMKKKGGRRKSKHSGKSRKRRSISVKEYSEDDSDSVSEDDSSSYSSENEKLKKQTNRRSNRHEKQKKSGKRMPGSKRSRVKSSEDEEKSETHSEIHVSSDDSLELESIKHEERAADDDPVEIDNEALRFKEMIESQKRVAAGLENEPIVGPLPLPKAEGHIGYGGALRPGEGDAIAQYVQQGKRIPRRGESGFCR

SEQ ID NO: 11693 - protein, 511 aa, Oryza sativa
MGRTEGRLASVVHLPGRSRVSASPSPRRRRSPSRSPSPRRNRRRDRSPSPYRSRRDRSPSPYRDRRRQWSPYHRDRGRDVEREWARDRDHPAPRRGGGGAGAGAWSASDDDDDEQLKGLTYFEYRRVKREKLRKSMKRCIWNITPSPPRREGEDEDYGYSDEEEEEEEKKESPKKVASSDKSEEEDSKGSSESDSGESDSLSDSSKSDDTRRKKKGRKGSHRSSKRSRHRRRHHSSDTEGDDNSKAEEDSEGSYDSEDSMDRRKKKRSRRHKKSKRRGRSSRRKKRKSNDTASEGSSEEEAVAAASGSSPSPLRDSKKKSRSSRRKRSKQSDSEDQAPSDADLGVKEIDETNEPEIDPEAIKFKEMLEAQKKAALENEMPVGPMPLPRAEGHISYGGALRPGEGDAIAQYVQQGKRIPRRGEVGLSAEEIQKFEDLGYVMSGSRHQRMNAIRIRKENQVYSAEDKRALAMFNYEEKSKREHKVMADLQRLVQRTIGNDVGPSHDPFATADG

SEQ ID NO: 11694 - protein, 183 aa, Saccharum officinarum
RSDSKESVLSDATRDDVEEVEETKVPEIDPEAIKFKEMLEAQKKAALENDMPVGPMPLPRAEGHISYGGALRPEEGDAIAQYVQQGKRIPRRGEVGLSAEEIQKFEDLGYVMSGSRHQRMNAIRIRKENQVYSAEDKRALAMFNYEEKSKREHKVMADLQRLVQRTIGHDVGPSHDPFATTDG

SEQ ID NO: 11695 - protein, 329 aa, Panicum virgatum
SPKKKDSPEASEEDSKNSSGSESGESDSLSESSESECSRRKRKGRKSSRRSSKRSRRRHRRRSYNSESDVESESNADLEGSFDSDSRDRSKKRSRRHTKSRRGRSSRRKKKSHDTASEQSSEEAEHSDHSARDSNKKSKSSKRKRSKRSDSEESLPSDANPDVKEDEEIKEPVIDPEAIKFKEMLEAQKKAALENDMPVGPMPLPRAEGHISYGGALRPGEGDAIAQYVQQGKRIPRRGEVGLSAEEIQKFEDLGYVMSGSRHQRMNAIRIRKENQVYSAEDKRALAMFNYEEKAKREHKVMADLQRLVQRTIGNDVGPSHDPFATTDS

SEQ ID NO: 11696 - protein, 135 aa, Ipomoea batatas
MPRTDGQPVNYGGALRPGEGDAIAQYVQQGKRIPRRGEVGLSAEEISKFESLGYVMSGSRHQRMNAIRIRKENQVYSAEDKRALAMFNYEEKAKREQKVMADLQRLVQRHIGPDVGPSHNPFAGVAGRSADMADA

SEQ ID NO: 11697 - protein, 86 aa, Sarracenia psittacina
MYIWMKLIHLCIYLFQSNIYIYLLILRLLLEEINLSMDLTDLKLFFMDFARLKLLIMLLSAETPSLPFVFYAYLDVENIHGSKLIS

SEQ ID NO: 11698 - protein, 403 aa, Setaria italica
RGDGGGAWSASDDDNDKELQGLSYFEYRRIKRQKLRKSKKRCIWNITPSPPRAEGDDENYGYSDVEEEKKESPEKKSSPEGSEEDSKDASGSESGESDSLSESSESEGSRRKRKGRKSSRRSSKRSRRRHRRRSYHSESEDESVSNDDSEGSLDSEDSRDRRSKKRSRRHRKSRRGRSSRKKKRSQDTASEQSSEEAEHSDPSPRDSKKKSKTSKRKRSKRSDSEESLPSDTNPDVKEDDEEIKEPEIDPEAIKFKERLEAQKKAALENDMPVGPMPLPRAEGHISYGGALRPGEGDAIAQYVQQGKRIPRRGEVGLSAEEIQKFEDLGYVMSGSRHQRMNAIRIRKENQVYSAEDKRALAMFNYEEKSKREHKVMADLQRLVQRTIGNDVGPSHDPFATTDS

SEQ ID NO: 11699 - protein, 504 aa, Setaria italica
MSRSERRLASAVVRLPGRSRVSASPSPRRRSPSPPPRRDRRRDRSPSPYRDRRRNDRSPSPYRDRRRDERSPSPYRDRRRQWSPYHNDRGRDRDRAPPFRGGGDGGGAWSASDDDNDKELQGLSYFEYRRIKRQKLRKSKKRCIWNITPSPPRAEGDDENYGYSDVEEEKKESPEKKSSPEGSEEDSKDASGSESGESDSLSESSESEGSRRKRKGRKSSRRSSKRSRRRHRRRSYHSESEDESVSNDDSEGSLDSEDSRDRRSKKRSRRHRKSRRGRSSRKKKRSQDTASEQSSEEAEHSDPSPRDSKKKSKTSKRKRSKRSDSEESLPSDTNPDVKEDDEEIKEPEIDPEAIKFKERLEAQKKAALENDMPVGPMPLPRAEGHISYGGALRPGEGDAIAQYVQQGKRIPRRGEVGLSAEEIQKFEDLGYVMSGSRHQRMNAIRIRKENQVYSAEDKRALAMFNYEEKSKREHKVMADLQRLVQRTIGNDVGPSHDPFATTDS

SEQ ID NO: 11700 - protein, 383 aa, Cucumis melo
MGRLGSTVEIPERRHRSDRENGTHRYSPDSDASRGDYRRRRSPSYESYDRYNNRRRSVSPGYENVRRSPRADGDQNGLPKRFGRAGGRAYLDRNGRASDESDSDEELKGLNYEEYRRLKRQKLRKSLKHCIWRVTPSPPRNGNEEYEEKYDDILEKYGGDGDGDGGDKSGLNEKKQLEEKYVSDKTKNSDSDSDSELSDRKTERRKSKSSGSRRRSRKSSPSDSESYSNTESESESESEEESRRRRKKSKSRRSRKHKNIKSSKKKKSRYSDTEDSEESETDDSDVSDHVKSRKRSRSKRSKNSRKRRYSDSDESEDSEGEKLRKRKSSLTSSKSRSKRKDSQKRRVRVALLLRRILVLKTLMIRVNQWLMERKWPRLMLLKL

SEQ ID NO: 11701 - protein, 341 aa, Pennisetum glaucum
GYSDVEEKKESPKKKSSPEGSEEDSKDASGSESGESDSLSESSESEGSRRKRKGRKSSRSSSKRSRRRHRRRSYSESEDESESNDDSEGSLDSEDSRDRRSKKRSRRHKKSRRGRSSRKKKRSQDTASEQISEEAEHSDPCPRDSKKKSKTSKRKRSKRSDSEESLPSDTNPDVKEDDEEIKEPEIDPEAIKFKESLEAQKKAALENDMPVGPMPLPRAEGHISYGGALRPGEGDAIAQYVQQGKRIPRRGEVGLSAEEIQKFEDLGYVMSGSRHQRMNAIRIRKENQVYSAEDKRALAMFNYEEKSKREHKVMADLQRLVQRTIGNDVGPSHDPFATTDS

SEQ ID NO: 11702 - protein, 116 aa, Catharanthus roseus
PGEGDAIAQYVQQGKRIPRRGEVGLSAEEIQKFESLGYVMSGSRHQRMNAIRIRKENQVYSAEDKRALAMFNYEEKAKREQKVMADLQRLVQRHIGQDSGPSHDPFGGRSSEVPEA

SEQ ID NO: 11703 - protein, 113 aa, Eucalyptus grandis
GDAIAQYVQQGKRIPRRGEVGLSAEEIQKFEGLGYVMSGSRHQRMNAIRIRKENQVYSAEDKRALAMFNYEEKAKREHKVMADLQRLVQRHIGQDIGPTHDPFAGKAADGPEA

SEQ ID NO: 11704 - protein, 121 aa, Marchantia polymorpha
FRPGEGDAMAQYVQQGKRIPRRGEVGLSADEISKFEDLGYVMSGSRHQRMNAIRIRKENQVYSAEDKRALAMFNYEEKAKREHKVMSDLQRLVQRHIGADVGPTHDPFSTTKANNGEATEA

SEQ ID NO: 11705 - protein, 472 aa, Brassica rapa
  misc_feature (132)..(132): Xaa can be any naturally occurring amino acid
  misc_feature (134)..(136): Xaa can be any naturally occurring amino acid
VAQTLDIAIPPPRPKRKPNNPYPRKTGTGSLPISKPGLNDGKESLGSGKVSLPETTNEDLQEDNCSDCLTHQHLSAASNASTFLEFLPSREQEQGNNKESNSANYSEPQTYPRHIPLLVPLGSSITTSLSHXPXXXPDENSHHPHTVSGHHQSFPDHIMSTLLQTPALYTAASFASTFGGGGPQGNLAAMAAATVAAASAWWAANGMLPLCAPFSSGGLTCHPPATAYGPSGEVDHTKTVDQEHSEASKARSSLESEEAKNGSKPDCHHHPCAATETDAKGSDGARDRKQVDRSSCGSNTPSSSDDVEADALVERQENGGTTNEEVKEVDGDTTNNPQTSESNARRSRISSSNLADPWKSVSDEGRIAFRALFAREVLPQSFTYKREEGQQQRYPMELDLNSAADDQEENRNIAFLGASKQQLLSRGRTGFKPYKRCSMEAKESRVISNTNPIISVEQKDPKRIRLETQTST

SEQ ID NO: 11706 - protein, 166 aa, Brassica napus
MRSFTSGHPPATYEVNAVTKTVDQEHSEASKARSSLDSEEAKNGSKPDCHHHPCAATETDAKGSDGARDRKQVDRSSCGSNTPSSSDDVEADALVERQENGGTTNEEVKEVDGDTTNNPQTSESNARRSRISTSNLADPWKSVSDEGRIAFSSSVCKRSVATKFYI

SEQ ID NO: 11707 - protein, 232 aa, Brassica napus
MDQEHSEASKARSSLESEETKNGSQPDCHHHTCAATETDAKGSDGARDRKQVDRSSCGSNTPSSSDDVEADALVERQENGGTTNEEVKEVDGDTTNNPQTSESNARRSRISSSILADPWKSVSDEGRIAFRALFAREVLPQSFTYQREEGQQQSYPMELDLNSTADDQEENRNIAFLGASKQQLSRGRTGFKPYKRCSMEAKESRVINNTNPIISVEQKDPKRIRLETQTST

SEQ ID NO: 11708 - protein, 51 aa, Brassica rapa
MISQFFVLSQRGDNIVFRDYRAEVPKGSTETFFRKVKFWKEDGNAEAPPIF

SEQ ID NO: 11709 - protein, 287 aa, Brassica napus
MPGTAVTKSVVANDPSGRRREEIFVDIIEKISVTFSSSGYILTSEIDGTIQMKSYLFGNPEIRLALNEDLNIGRGGASVYDYRSSSGSGVILDDCNFHESVRLDSFDSDRTLSLVPPDGEFPVMNYRMTQEFKPPFHVNTLIEEAGRLKAEVIIKIRAEFPSDVVANTITIQMPLPNYTSRASFELELGATGQKTDFKETSKMLEWSFKKIVGGAEHTLRAKLTFSQEFHGNITKEAGPVSMTFTIPMYNVSKLQVKYLQIAKNSTSQNPYRWVRYVTQANSYVARI

SEQ ID NO: 11710 - protein, 207 aa, Brassica juncea
DYRSSSGSGVILDDCNFHESVRLDSFDSDRTLSLVPPDGEFPVMNYRMTQEFKPPFHVNTLIEEAGRLKAEVIIKIRAEFPSDIIANTITVQMPLPNFTSRASFELEPGAAGQKTDFKESNKMLEWSLKKIVGGAEHTLRAKLTFSQEFHGNITKEAGPVSMTFTIPMYNVSKLQVKYLQIAKKSSSYNPYRWVRYVTQANSYVARI

SEQ ID NO: 11711 - protein, 218 aa, Amsonia hubrichtii
NIGRGGRSIYDYGGSSGSGAVILDDCNFHESVHLDSFDVDRTLSLVPPDGEFPVMNYRITQEFKPPFRINTLMEEAGQLKAEVILKIRAEFLSSVTANTIVVQMPLPKYTTRVSFELEPGAVGQTTDFKESNRRLEWSLKKIVGGSEHTLRAKLTFSQESHGNITKEAGPVSMTFTIPMYNPSRLQVKYLQIAKKSKTYNPYRWVRYVTQANSYVARI

SEQ ID NO: 11712 - protein, 330 aa, Silene vulgaris
FGYMQTTSTEALKSYVFNEPIVVDAARMPALGPGSIFMQGNNRMPGTAVTKSVVANEPGGRKREEIFVDIIEKISVTFSSSGYILTSEIDGTIQMKSYLTGNPEIKLALNEDVTIGRGGSSAYGYSSSGSGAVILDDCNFHESVHLDNFDLDRTLSLVPPDGEFPVMNYRMTQEFKPPFRINALIEEAGSLKAEVILKIRAEFPSTATANTIVVQMPLPTYTTRVSYELEPGAVGQTTDFKEANKKLEWNLKKIVGGAEHTLRAKLTFSQELHGNLTKEAGPVSMNFTIPMYNASKLQVKYLQIAKKSKSFNPYRWVRYVTQANSYVARI

SEQ ID NO: 11713 - protein, 164 aa, Euphorbia esula
MNYRMTQEFKPPFRINTLIEEAGALKAEVILKISAEFPSSITANTITVQMPLPKYTTRATFEMEAGAIGQTTDFKEANKRLEWGLKKIVGGSEHTLRAKLTFLQEFHGNLTKEAGPVSMTFTIPMYNASRLQVKYLQIAKKSNTYNPYRWVRYVTQANSYVARI

SEQ ID NO: 11714 - protein, 197 aa, Solanum melongena
ILDDCNFHESVQLDSFDVDRTLTLVPPDGEFPVMNYRITQEFKPPFRINTLIEEAGSLKAEVILKVRAEFPSDITANTILVQMPLPTYTSRVSFELEPGAVGQTTDFKESNKRLEWSLKKVVGGSDHTLRAKLTFSQESHGNITKEAGPVSMTFTIPMYNPSRLQVKYLQIAKKSKTYNPYRWVRYVTQANSYVARI

SEQ ID NO: 11715 - protein, 170 aa, Raphanus sativus
  misc_feature (45)..(45): Xaa can be any naturally occurring amino acid
  misc_feature (48)..(48): Xaa can be any naturally occurring amino acid
  misc_feature (70)..(70): Xaa can be any naturally occurring amino acid
DGEFPVMNYRMTQEFRPPFHVNTLIEEAGRLKAEVIIKIRAEFPXDIXANTITIQMPLPNYTSRASFELXLGATGQKTDFKETSKMLEWSFKKIVGGAEHTLRAKLTFSQEFHGNITKEAGPVSMTFTIPMYNVSKLQVKYLQIAKNSSSHNPYRWVRYVTQANSYVARI

SEQ ID NO: 11716 - protein, 234 aa, Catharanthus roseus
YLTGNPEIRLALNDDLSIERGGRSIYEYGGSSGAGAVILDDCNFHESVHLESFDVDRTLSLVPPDGEFPVMNYRITQEFKPPFRINTLIEEAGQLKAEVILKIRAEFLSSITANTIVVQMPLPKYTTRVSFELEPGATGQTTDFKESNRRLEWNLKKIVGGSEHTLRAKLTFSQESHGNITKEAGPVSMTFTIPMYNPSRLQVKYLQIAKKSKTYNPYRWVRYVTQANSYVARI

SEQ ID NO: 11717 - protein, 187 aa, Cleome spinosa
IWCRSCDTLYDCNFHESVRLDSFDMDRTLSLVPPDGEFPVMNYRMTQEFKAPFHVNTLIEEAGRLKAEVIIKIRAEFPSDVVANTITVQMPLPKYTSRASFEVETGAAGQRTDFKESSKMLEWNLKKIVGGAEHTLRAKLTFAQESHGNITKEAGPVSMTFTIPMYNVSRLQVKYLQIAKKSSTYNP

SEQ ID NO: 11718 - protein, 426 aa, Petunia hybrida
KGSAEIFFRKVKFWKEDGGEEAPPVFNVDGVNYFHVKVVGLLFVATSRTNTSPSLVLELLQRIARVTKDYLGVLNEDSLRKNFVLVYELLDEVIDFGYVQTTSTEILKSYIFNEPIMVDAGRLPPLGPAAMFMQGTKRMPGTAITKSVVANEPGGRKREEIFVDIIEKISITFSSSGYILTSEIDGTIQMKSYLTGNPEIRLALNEDLSIGRAGGRSVYDYGGSAGSGAVVLDDCNFHESVHLDSFDVDRTLSLVPPDGEFPVMNYRITQEFKPPFRINTLIEEAGSLKAEVILKIRAEFPADVTANTILVQMPLPTYTSRVSFELEPGAVGQTTDFKESNKRLEWNLKKVLGGTDHTLRAKLTFSQSHGNITKEAGPVSTTFTIPMYNPSRLQVKYLQIAKKSKAYNPYRWVRYVTQANSYVARI

SEQ ID NO: 11719 - protein, 237 aa, Vinca minor
MKSYLTGNPEIRLALNDNLNIGRGGRSIYDYGDSSGSGAVILDDCNFHESVHLDSFDVDRTLSLVPSDGEFPVMNYRITQEFKPPFRINTLIEEAGQLKAEVILKLRAEFLSSVTANTIAVQMPLPKFTTRVSFELETGAIGQTTDFKESNRRLEWNLKKIVGGSEHTLRAKLTFSQESHGNITKEAGPVSMTFTIPMYNPSRLQVKYLQIAKKSKTYNPYRWVRYVTQANSYVARI

SEQ ID NO: 11720 - protein, 415 aa, Valeriana officinalis
KFWKEDGEEEAPPVFNVDGVNYFHVKVAGLLFVATTRANVSPSLVLELLQRIARVTKDYLGVLNEDSLRKNFVLVYELLDEVIDFGYVQTTSTEVLKSSVFNEPIVVDSARLQPLGPAGLFMQGTKRMPGTAVTKSVVANEPGGRKREEIFVDIIEKISVTFSSSGYILTSEIDGTIQMKSYLSGNPEIRLALNDDLSIGRSGRSVYDYGGSTGSGAVILDDCNFHESVHIDSFDVDRTLTLVPPDGEFPVMNYRMTQEFKPPFRINTLIEEAGALKAEVILKIRAEFPSSITANTIVIQMPLPTYTTRVSFELEAGAIGQVTDFKESNKKLEWGLKKIIGGSEHTLRAKLTFSQEAHGNLMKEAGPVSMNFTIPMYNCSRLQVKYLQIEKKSKAYNPYRWVRYVTQANSYVARI

SEQ ID NO: 11721 - protein, 342 aa, Cirsium arvense
MYELLDEVIDFGYVQTTSTEVLKSCVFNEPIMVDAARMPPLGPAALFMQGSKRMPGTAVTKSVVANEPGGRKREEIFVDIIEKISVTFSSSGYILTSEIDGTIQMKSYLSGNPEIKLALNEELNIGSSSGRSLYDYSGSTGSGAVILDDCNFHESVRLDSFDVDRTLTLVPHDGEFPVMNYRMTQEFKPPFRINTLIEEAGSLKAEVILKIRAEFPQNITANTVVVQMPVPSYTSRISFEMESGAVGQVTDFKESNKKLEWGLKKVVGGSEHTLRAKLTFSQESHGNITKEAGPISMTFTIPMYNCSRLQVKYLQIAKKSKTYNPYRWVRYVTHANSYVARI

SEQ ID NO: 11722 - protein, 193 aa, Linum usitatissimum
MTVCHESVRLRALTQTDLVSGAPDGDFPVMNYRMIPEFKPPFRINTLIEEAERLRAEVILKFSAEFPSNITANTIIVQMPLPKYTARATFELEPGAVGQTTDFKESTKKLEWGLKKVSGGSEHTLRAKLTFSQELHGNITKEAGPVSMTFTIPMYNVSKLQVKYLQIAKKSSSYNPYRWVRYVTQANSYVARI

SEQ ID NO: 11723 - protein, 256 aa, Vaccinium corymbosum
VTFSSSGYILTSEIDGTIQMKSYLSGNPEIRLALNDDLSIGRGGRSIYDYSGSSGSGAVILDDCNFHESVHLDSFDVDRTLSLVPPDGEFPVMNYRITQEFKPPFRINALIEEAGPLKAEVILKVRAEYASSINANTILVQMPLPTYTTRVSFELEPGAVGQVTDFKESNKRLEWGLKKIVGGSEHTLRAKLTFSQESHGNITKEAGPVSMNFTIPMYNASRLQVKYLQIAKKSKTYNPYRWVRYVTQTNSYVARI

SEQ ID NO: 11724 - protein, 292 aa, Thalictrum flavum
ALNGCQGQLLRNLLLPMSLVVRKREEIFVDIIEKISVTFSSSGYILTSEIDGTIQMKSYLTGNPEIRLALNEDLNTGRGGRSVYDYGSSSRAGSVILDDCNFHESVHLESFDVDRTLSLVPPDGEFPVMNYRMTQEFKPPFRINALIEEAGAFKAEVILKVRAEFPSSVTANTIVVQMALPKYTTRVSFELESGAVGHTTDFKEANKKLEWGLKKIVGGSEHTLRAKLTFVQESHGNIMKEAGPVSMTFTIPMYNASKLQVRYLQIAKKSKTYNPYRWVRYVTQANSYVARL

SEQ ID NO: 11725 - protein, 382 aa, Phaseolus coccineus
ATTRVNVSPSLVLELLQRIARVIKDYLGILNEDSLRKNFVLVYELLDEVIDFGYVQSTSTEMLKAYVFNEPLVVDAARLSPLGPASIFAQGTKRMPGIAVTKSVVATEPGGRRREEIFVDIIEKISITFSSSGYILTSEIDGTIQMKSYLSGNPEIRLALNDDLSIGRSQGSAYGYRSSSGSGTVVLDDCNFHESVRLDSFDIDRTLSLIPPDGEFPVMNYRMTQEFRPPFRINALIEEAGSLKAEVILKVSAEFASSVTANTIKVQMPLPKCTSRVSFELESGAVGQTTDFKEANKRLEWSLKKIVGGSEHTLRAKLTFAQESHVNITKESGPVSVTFTIPMYNASRLQVKYLQIAKKSATHEPYRWVRYVTQANSYVARI

SEQ ID NO: 11726 - protein, 164 aa, Cucurbita pepo
MNYRMTQEFKPPFRINALIEEAGSLKAEVILKVRAEFASNITANTINIQMPLPTFTTRVSFELEPGAVGNTTDFKEANKRLEWGLKKIVGGSEHTLRARLTFSQESHGNIVKEAGPVSMTFTIPMYNVSRLQVKYLQIAKKSNTYNPYRWVRYVTQANSYVARL

SEQ ID NO: 11727 - protein, 103 aa, Flaveria ramosissima
YILTSEIDGTIQMKSYLTGNPEIRLALNEDLNIGRGGRSVYDYGGSSGSGAVILDDCNFHESVHLDSFDVDRTLTLVPPDGEFPVMNYRMTQEFKPPSVLTPD

SEQ ID NO: 11728 - protein, 80 aa, Lippia dulcis
MISQFFVLSQRGDNIVFRDYRGDVQKGSAEIFFRKVKFWKEDGKEEAPPVFNLDGVNYFHVKMVGLLFVCPPQGSTCLLL

SEQ ID NO: 11729 - protein, 137 aa, Lippia dulcis
MDSFDVDRTLSLVPPEGEFPVMNYRITQEFKPPFTINTLIEEAGSLKAEVILKIRAEFPSSVTANTILIEMPLPTYTTRVNFDLERGIVGQNADFKESQKKLEWNIKKIVGGSEHTLRAKLNFSQELHEISLKKLGL

SEQ ID NO: 11730 - protein, 439 aa, Silene vulgaris
GDNIVFRDYRGDVPKGTTEVFFRKVKFWKEDGEEEAPPVFNVDGVNYFHLKIVGLFFVATTRANVSPSLLLELLQRISRVIKDYLGILSEESLRRNFVLVYELLDEMIDFGYTQATSTEALKSYVFNEPIVVDAARMPALGPAAMFMQGNKRMPGTAVTKSVMANEPGGRKREEIFVDIIEKISVTFSSSGYILTSEIDGTIQMKSYLTGNPEIKLALNEDVTIGRDGSSAFGHSSSGSGVVILDDCNFHESVNLDNFDIDRTLSLVPPDGEFPVMNYRMTQEFKPPFRITALIEEAGALKAEVILKIRAEFAASATANTIVVQMPLPTYTSRVSFELEQGAVGQTTDFKEANKRLEWSLKKIVGGAEHTLRAKLTFSQESHGNLTKEAGPVTMNFTIPMFNASRLQVKYLQFATKSKTYNPYRWVRYVTQANSYVARL

SEQ ID NO: 11731 - protein, 401 aa, Manihot esculenta
NVDGVNYFHVKVVGLFFVATSRVNVSPSLVLELLQRVARVIKDYLGILNEDSLRKNFVLVYELLDEVIDFGYVQTTSTELLKSYVFNEPIVIDAGRLQPLNPATIFTQGTKRMPGMAVTKSVVANEPGGRKREEIFVDIIEKISVTFSSSGYILTSEIDGTIQMKCYLTGNPEIRLALNEDLSIGGGSGRSVYDSRSSFGSGAVMLDDCNFHESVRLDNFDLDRTLTLVPPDGEFPVMNYRLTQEFKPPFRINTLIEEAGALKAEVILKISAEFPSSITANAVSVQMPLPKYTTRATFELEPGAIGQTTDFKEANKRLEWGLNKIVGGSEHTLRAKLAFSRELHGNITKEAGPVSMTFTIPMYNASRLQVKYLQIAKKSNTYNPYRWVRYVTQANSYVARL

SEQ ID NO: 11732 - protein, 234 aa, Brassica napus
VVHDVDLQKLPVRFAMDRAGLVGADGPTHCGAFDVTFMACLPNMIVMAPSDEAELFHMVATASAIDDRLLFRYPRGNGIGVALPPGNKGVPLEVGKGRILKEGERVALLGYGSAVQSCLGAAAMLQERGLNITVADARFCKPLDRALIRSLAKSHEVLITVEEGSIGGFGSHVVQFLALDGLLDGKLKWRPMVLPDRYIDHGSPADQMAEAGLMPSHIAATALNLIGAPWEALY

SEQ ID NO: 11733 - protein, 165 aa, Raphanus sativus
LVPYPRGNGVGVALPPGNKGVPIEVGKGRILKEGERVALLGYGSAVQSCLGAAVMLQERGLNITVADARFCKPLDRALIRSLAKSHEVLITVEEGSIGGFGSHVVQFLALDGLLDGKLKWRPMVLPDRYIDHGSPADQMAEAGLMPSHIAATALSLIGAPWEALY

SEQ ID NO: 11734 - protein, 420 aa, Brassica napus
MHQLAAKVDEYARGMISGTGSTLFEELGLYYIGPVDGHNIDDLVAILKEVKSARTTGPVLIHVITEKGRGYPYAERADDKYHGVVKFDPATGKQFKTTNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEAELYNIVATAAAIDDRPSCFRYPRGNGIGVALPPGNKGVPVEVGKGRILKEGERVALLGYGSAVQSCLGAAVMLQERGLNVTVADARFCKPLDRALIRSLAKSHEVLITVEEGSIGGFGSHVVQFLALDGLLDGKLKWRPMVLPDRYIDHGSPADQMAEAGLMPSHIAATALNLIGAPREALY

SEQ ID NO: 11735 - protein, 180 aa, Brassica juncea
FNMVATAAAIDDRPSCFRYPRGNGIGVALPPGNKGVPIEVGKGRILKEGERVALLGYGSAVQSCLGAAVMLQERGLNVTVADARFCKPLDRALIRSLAKSHEVLITVEEGSIGGFGSHVVQFLALDGLLDGKLKWRPMVLPDRYIDHGSPADQMAEAGLMPSHIAATALNLIGAPREALY

SEQ ID NO: 11736 - protein, 206 aa, Brassica juncea
CGAFDVTFMACLPNMIVMAPSDEAELFHMVATASAIDDRPSCFRYPRGNGIGVALPPGNKGVPVEVGKGRILKEGERVALLGYGSAVQSCLGAAVMLQERGLNVTVADARFCKPLDRALIRSLAKSHEVLITVEEGSIGGFGSHVVQFLALDGLLDGKLKWRPMVLPDRYIDHGSPADQMAEAGLMPSHIAATALNLIGAPREALY

SEQ ID NO: 11737 - protein, 442 aa, Raphanus sativus
  misc_feature (37)..(37): Xaa can be any naturally occurring amino acid
SNPALRELREVAKGVTKQIGGPMHQLAAKVDEYARGXISGTGSTLFEELGLYYIGPVDGHNIDDLVAILKEVKSARTTGPVLIHVITEKGRGYPYAERADDKYHGVVKFDPATGKQFKTTNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEAELFNIVATAAAIDDRPSCFRYPRGNGIGVALPPGNKGVPIEVGKGRILKEGERVALLGYGSAVQSCLGAAVMLQERGLNVTVADARFCKPLDRALIRSLAKSHEVLITVEEGSIGGFGSHVVQFLALDGLLDGKLKWRPMVLPDRYIDHGSPADQMAEAGLMPSHIAATALNLIGAPREALY

SEQ ID NO: 11738 - protein, 468 aa, Brassica napus
NVVAVIGDGAMTAGQAYEAMNNAGYLDSDMIVILNDNKQVSLPTATLDGPSPPVGALSSALSRLQSNPALRELREVAKGVTKQIGGPMHQLAAKVDEYARGMISGTGSTLFEELGLYYIGPVDGHNIDDMVAILKEVKSARTTGPVLIHVVTEKGRGYPYAERADDKYHGVVKFDPATGKQFKSSNKTQSYTTYFAEALVAEAEVDKDVVAIHAAMGGGTGLNLFQRRFPTRCFDVGIAEQHAVTFAAGLACEGLKPFCAIYSSFMQRTYDQVVHDVDLQKLPVRFAMDRAGLVGADGPTHCGAFDVTFMACLPNMIVMAPSDEAELFHMVATASAIDDRPSCFRYPRGNGIGVALPPGNKGVPLEVGKGRILKEGERVALLGYGSAVQSCLGAAAMLQERGLNITVADARFCKPLDRALIRSLAKSHEVLITVVEGSDCGFGVHVVQFLALDGLLDGKTQVETNGVA

SEQ ID NO: 11739 - protein, 382 aa, Thellungiella halophila
  misc_feature (120)..(120): Xaa can be any naturally occurring amino acid
  misc_feature (300)..(300): Xaa can be any naturally occurring amino acid
HIFYLVAILKEVKSARTTGPVLIHVITEKGRGYPYAERADDKYHGVVKFDPATGKQFKSSNKTQSYTTYFAEALVAEAEVDKDVVAIHAAMGGGTGLNLFQRRFPTRCFDVGIAEQHAVXFAAGLACEGLKPFCAIYSSFMQRAYDQVVHDVDLQKLPVRFAMDRAGLVGADGPTHCGAFDVTFMACLPNMIVMAPSDEAELFNIVATAAAIDDRPSCFRYPRGNGIGVALPPGNKGVPIEIGKGRILKEGERVALLGYGSAVQSCLGAAMMLQERGLNITVADARFCKPLDGALIRSLXKTHEVLITVEEGSIGGFGSHVVQFLALEGLLDGKLKWRPMVLPDRYIDHGSPADQMAEAGLMPSHIAATALNLIGAPREALF

SEQ ID NO: 11740 - protein, 273 aa, Eutrema halophilum
FPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEAELFNIVATAAAIDDRPSCFRYPRGNGIGVALPPGNKGVPIEIGKGRILKEGERVALLGYGSAVQSCLGAAMMLQERGLNITVADARFCKPLDGALIRSLAKTHEVLITVEEGSIGGFGSHVVQFLALEGLLDGKLKVLQSGDQWYCLIGTLTMAHQLIKWLKLGSCRLTLQQRLLT

SEQ ID NO: 11741 - protein, 146 aa, Brassica juncea
TREVGKGRILREGERVALLGYGSAVQNCLEASSILDKRGLKITVADARFCKPLDVALIRNLARSHEVLITVEEGSIGGFGSHVVQFLALDGLLDGKLKWRPMVLPDRYIEHGSPLDQLAEAGLTASHIAATVLNLIGTPRETLYWK

SEQ ID NO: 11742 - protein, 262 aa, Brassica napus
MGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEAELFNMVATAAAIDDHPSCFRYPRGNGVGVSLPPGNKGVPLEVGKGRILREGERVALLGYGSAVQNCLEASSILDKRGLKMTVADARFCKPLDIALIRNLAKSHEVLITVEEGSIGGFGSHVVQFLALDGLLAESSSGDQWYYLTGILSMDHH

SEQ ID NO: 11743 - protein, 679 aa, Eutrema halophilum
MTLSAFGFPFYLSRETSIDYCKSTSLSSSQSLATYLTSLCRRSTISLSKIRTRVNGSLVEKGEYDSIRPPTPILDTINHPIHMKNLSIKELKVLSDELRSDIIFHVSKTGGHLGSNLGVVELTVALHYIFNTPHDKILWDVGHQILTGRREKMKTLRQTNGLSGFTKRGESEHDSFGTGHSSTTISAGLGMAVGRDLKGRNNNVVAVIGDGAMTAGQAYEAMNNAGYIDSDMIVILNENKQVSLPTANLDGPTPPVGALSSALSKLQPKRPLRELREAAKGVTKKIGGSMHQLASKVDEYARRVISGTGSTLFEELGLYYIGPVDGHDIDDLVTILKEVKRTRTIGPVLLVVKFDPATGKQFKNIGETQSYSTYFAEALIAEAEEDKNVVAIHAAMGGGTGLNLFQRRFPTRCFDVGIAEQHAVTFAAGLACEGLKPFCAINSSFMQRAYDQVVHDVDLQKLPVRFAIDRAGLHFDVMFMACLPNMIVMAPSDEAELFNMVATAAAIDDRPSCFRYPRRNGIGVSLPHGNKGVPLQIGKGRILREGERVALLGYGSAIQNCLEASSILDKRGLKITVADARFCKPLDIALIRNLAKSHELLITVEEGSIGGFGSHVVQFLALDGLLDGKLKWRPMVLPDRYIEHGSPLDQLAEAGLTASHIAATVLNLIGTPREALFWE

SEQ ID NO: 11744 - protein, 534 aa, Nicotiana benthamiana
  misc_feature (349)..(349): Xaa can be any naturally occurring amino acid
  misc_feature (383)..(383): Xaa can be any naturally occurring amino acid
  misc_feature (387)..(387): Xaa can be any naturally occurring amino acid
  misc_feature (417)..(417): Xaa can be any naturally occurring amino acid
  misc_feature (423)..(423): Xaa can be any naturally occurring amino acid
  misc_feature (533)..(533): Xaa can be any naturally occurring amino acid
GHSSTTISAGLGMAVGRDLKGKNNNVIAVIGDGAMTAGQAYEAMNNAGYLDSDMIVILNDNRQVSLPTATLDGPAPPVGALSSALSRLQSNRPLRELREVAKGVTKQIGGPMHELAAKVDEYARGMISGSGSTLFEELGLYYIGPVDGHNIDDLISILKEVRSTKTTGPVLIHVITEKGRGYPYAERAADKYHGVAKFDPATGKQFKVSAKTQSYTTHFAEALIAEAEADKDIVAIHAAMGGGTGMNLFHRRFPTRCFDVGIAEQHAVTFAAGLACEGLKPFCAIYSSFLPRAYDQVVHDVDLQKLPVRFAMDRAGLVGADGPTHCGAFDVTFMACLPNMVVMAPSDEXELFHMVATAAAIDDRPSCFRYPRGNGIGVELPVXNKGXPLEVGKGRILVEGERVALLGYGSAVQNCLXAAAVLXTRGLQVTVADARFCKPLDGALIRSLAKSHEVLITVEEGSIGGFGSHVAQFMALDGLLDGKLKWRPIVLPDRYIDHGSPADQLAEAGLTPSHIAATVFNILGQTREALEVXT

SEQ ID NO: 11745 - protein, 134 aa, Cleome spinosa
MEGDRVALLGYGSAVQNCLAAASMLKERDVKITVADARFCKPLDRDLIRSLAKSHEVLITVEEGSIGGFGSHVVQFLALDGLLDGKLKWRPIVLPDRYIEHGSPVDQLAEAGLTPSHIAATVMNLLGSPREALF

SEQ ID NO: 11746 - protein, 203 aa, Solanum tuberosum
TYMACLPNMVVMAPSDEAELFHMVATAAAIDDRPSCFRYPRGNGIGVELPAGNKGIPLEVGKGRILIEGERVALLGYGSAVQNCLDAAIVLESRGLQVTVADARFCKPLDHALIRSLAKSHEVLITVEEGSIGGFGSHVVQFMALDGLLDGKLKWRPIVLPDRYIDHGSPVDQLAEAGLTPSHIAATVFNILGQTREALEVMT

SEQ ID NO: 11747 - protein, 560 aa, Flaveria ramosissima
MHTIRQTNGLAGFTKRSESEHDCFGTGHSSTTISAGLGMAVGRDLKGGTNDVVAIIGDGAMTAGQAYEAMNNAGYLDSDMIVILNDNKQVSLPTATLDGPIPPVGALSSALSRLQSNRPLRELREVAKEVTKQIGGPMHELAAKVDEYARGMISGSGSTLFEELGLYYIGPVDGHSIDDLVAILKEVKSTKTTGPVLIHVITEKGRGYPYAEKAADKYHGVAKFDPATGKQFKSSAATQSYTTYFAEALIAEAEVDKKIVGIHAAMGGGTGMNLFHRRFPSRCFDVGIAEQHAVTFAAGLACEGLKPFCAIYSSFLQRGYDQVVHDVDLQKLPVRFAMDRAGLVGADGPTHSGSFDVTYMACLPNMVVMAPSDEAELFHMVATAAAIDDRPSCFRYPRGNGIGAPLPPGNKGVPLEVGKGRILIEGERVALLGYGTAVQSCLVAARLVQERGLNITVADARFCKPLDHNLIRALAKSHEVLITVEEGSIGGFGSHVAHFMALDGLLDGKLKWRPLVLPDRYIDHGAPADQLAEAGLTPSHIAATVFNVLGQTREALEVMS

SEQ ID NO: 11748 - protein, 239 aa, Cucurbita pepo
QVVHDVDLQKLPVRFAMDRAGLVGADGPTHCGSFDVTFMACLPNMVVMAPSDEAELFNMVATAAAIDDRPSCLRYPRGNGIGVELPPGNKGIPIEVGKGRILLEGERVALLGYGTAVQNCLAAASMLERHGLRITVADGRFCKPLDRALIRNLAKSHEILITVEEGSIGGFGSHVIQFLALDGLLDGSLKWRPLVLPDRYIDHGSPADQLAEAGLTPSHIAATVFNMLGQTREALEIMS

SEQ ID NO: 11749 - protein, 490 aa, Linum usitatissimum
NNAGYLDSDMIVILNDNKQVSLPTANLDGPIPPVGALSSALSRLQSNRPLRELREVAKGVTKQIGGPMHELAAKVDEYARGMISGSGSTLFEELGLYYIGPVDGHSIDDIVAILKEVKSTKATGPVLIHVVTEKGRGYPYAEKAADKYHGVAKFDPATGQQFKSSAPTQSYTTYFAEALIAEAEADKDVVAIHAAMGGGTGLNQFLRRFPTRCFDVGIAEQHAVTFAAGLACEGLKPFCAIYSSFLQRAYDQVVHDVDLQKLPVRFAMDRAGLVGADGPTHCGAFDVTFMACLPNMVVMAPSDEAELFHMVATAAAIDDRPSCFRYPRGNGLGVELPPGNKGVPLEVGQGRILIEGERVALLGYGAAVQSCLAAASLVEPHGLKVTVADARFCKPLDQALIRSLAKTHEVLITVEEGSIGGFGSHVVQFLALDGLLDGNLKWRPLVLPDRYIDHGSPADQMLEAGLTPSHIAATVFNILGQKREALQIMS

SEQ ID NO: 11750 - protein, 302 aa, Pteridium aquilinum
IHAAMGGGTGLNLFLRRFPERCFDVGIAEQHAVTFAAGLACEGLKPFCAIYSSFMQRAYDQVVHDVDLQKLPVRFAMDRAGLVGADGPTHCGAFDVTFMACLPNMVVMAPSDEAELFHMVATAAAIDDRPSCFRYPRGNGLGVQVPPGNKGVPLEIGKGRVLIEGERVALLGYGSAVQSCLGAASLLASHGLRLTVADARFCKPLDHTLIRKLAKSHEVLITVEEGSIGGFGSHVAQFLALDGLLDGTVKWRPLVLPDRYIDHGSPADQLAEAGLTPSHIAATVFNVLGQKREALEIMSSRN

SEQ ID NO: 11751 - protein, 708 aa, Cucumis sativus
QVKKRPGGICASLSETGEYPSQRPPTPLLDTINYPIHMKNLSVKELYQLADEVRSDVIFNVSKTGGHLGSSLGVVELTVALHYVFNAPQDRILWDVGHQSYPHKILTGRRDKMSTIRQTNGLSGFTKRSESEFDSFGAGHSSTTISAGLGMAVGRDLKGRKNNVIAVIGDGAMTAGQAYEAMNNAGYLDSDMIVILNDNKQVSLPTATLDGPVPPVGALSSALSRLQSNRPLRELREVAKGVTKQIGGPMHELAAKVDEYARGMISGSGSTLFEELGLYYIGPVDGHNVDDLVSILKEVKSTKTTGPVLIHVVTEKGRGYPYAEKAADKYHGVTKFDPATGKQQKAKAPTQSYTTYFAEALIAEAERDKDIIAIHAAMGGGTGLNLFQRRFPTRCFDVGIAEQHAVTFAAGLACEGLKPFCAIYSSFMQRAYDQASIGFMPILDTPLAKGIKFICFLKKFQRNLSVFKLQVVHDVDLQKLPVRFAMDRAGLVGADGPTHCGSFDVTFMACLPNMVVMAPSDETELFNMVATAAAIDDRPSCFRYPRGNGIGVELPPGNKGIPIEVGKGRILLEGERVALLGYGTAVQNCLAAASMVERHGLRITVADGRFCKPLDRALIRSLAKSHEILITVEEGSIGGFGSHVIQFLALDGLLDGSLKWRPLVLPDRYIDHGSPADQLAEAGLTPSHIAATVFNMLGQTREALEIMT

SEQ ID NO: 11752 - protein, 595 aa, Panicum virgatum
HYVFNAPQDRILWDVGHQSYPHKILTGRLDKMPTMRQTNGLAGFTKRAESEYNCFGTGHSSTTISAALGMAVGRDLRGGKNSVVAVIGDGAMTAGQAYEAMNNAGYLDSDMIVILNDNKQVSLPTATLDGPVPPVGALSSALSKLQSSRPLRELREVAKGVTKQIGGSVHELAAKVDEYARGMISGPGSTLFEELGLYYIGPVDGHNIDDLVSILNDVKSTNTTGPVLIHVVTEKGRGYPYAERAADKYHGVAKFDPATGRQFKSPAATLSYTNYFAEALIAEAEQDGRVVAIHAAMGGGTGLNYFHRRFPSRCFDVGIAEQHAVTFAAGLACEGLKPFCAIYSSFLQRGYDQVVHDVDLQKLPVRFAMDRAGLVGADGPTHCGAFDVTYMACLPNMVVMAPADEAELCHMVATAAAIDDRPSCFRYPRGNGVGVPLPPNYKGTPLEVGKGRILREGDRVALLGYGSAVQYCLAAAALVERHGLRVTVADARFCKPLDHALIRSLAKSHEVLITVEEGSIGGFGSHVAQFMALDGLLDGKLKWRPLVLPDRYIDHGSPADQLAEAGLTPSHIAATVFNVLGQNREALAIMAVPNA

SEQ ID NO: 11753 - protein, 226 aa, Euonymus alatus
MDRAGLVGADGPTHCGSFDVTFMACLPNMVVMAAADEAELFNMVATAAAINDRPSCFRYPRGNGIGVQLPPGNKGIPLEVGKGRILIEGERVALLGYGTAVQSCLAAASLVVPHGLKITVADARFCKPLDRDLIRSLAKSHEVLITVEEGSIGGFGSHVAQFMALDGLLDGKLKWRPIVLPDRYIEHGSPADQFAEAGLTPNHIAATVFNILGQTREALETMSLRS

SEQ ID NO: 11754 - protein, 306 aa, Flaveria ramosissima
MALCGFAFPANMNHRAIGSHAPVVQHCFFGKDLQHPQSSHKPFNQLSKRVGVVQATMADRGEYHSQRPPTPLLDTINYPIHMKNLSIKELKQLADELRSDVIFNVSKTGGHLGSSLGVVELTVALHYVFNTPQDKILWDVGHQSYPHKILTGRRDRMHTIRQTNGLAGFTKRSESEHDCFGTGHSSTTISAGLGMAVGRDLKGGTNDVVAIIGDGAMTAGQAYEAMNNAGYLDSDMIVILNDNKQVSLPTATLDGPIPPVGALSSALSRLQSNRPLRDCVSCQEVTKQIAGPCMNSLLKLTNMLVV

SEQ ID NO: 11755 - protein, 209 aa, Olea europaea
TFMACLPNMIVMAPSDEAELFHMVATAAAIDDRPSCFRYPRGNGVGVELPLGNKGIPLEVGKGRILIEGERVALLGYGSAVQSCLAAAALVESRGLQLTVADARFCKPLDHSLIRSLAKSHEILITVEEGSIGGFGSHVAQFMALDGLLDGNLKWRPVVLADRYIDHGSPADQLMEAGLTPSHIAATVFNIIGKAREALEIMSESVRSL

SEQ ID NO: 11756 - protein, 297 aa, Tripterygium wilfordii
GTGLNLFLRQFPTRCFDVGIAEQHAVTFAAGLACEGIKPFCAIYSSFLQRAYDQVVHDVDLQKLPVRFAMDRAGLVGADGPTHCGSFDVTFMACLPNMVVMAPADEAELFNMVATAAAINDRPSCFRYPRGNGVGVPLPPGNKGIPLEVGKGRILIEGERVALLGYGTAVQSCLAAASLVEPHGLKLTVADARFCKPLDCALIRSLAKSHEVLITVEEGSIGGFGSHVAQFMALDGLLDGKLKWRPLVLPDRYIDHGSPAYQFAEAGLTPSHIAATVFNILGQTREALAIMSLSHSV

SEQ ID NO: 11757 - protein, 629 aa, Arabidopsis thaliana
MALSVFAFPSYINRNPSLKYLKPSSMSSTKYSKVRATTFSEKGEYYSNRPPTPLLDTINHPMHMKNLSIKELKVLSDELRSDVIFNVSKTGGHLGSNLGVVELTVALHYIFNTPHDKILWDVGHQSYPHKILTGRRGKMKTIRQTNGLSGYTKRRESEHDSFGTGHSSTTLSAGLGMAVGRDLKGMNNSVVSVIGDGAMTAGQAYEAMNNAGYLHSNMIVILNDNKQVSLPTANLDGPTQPVGALSCALSRLQSNCGMIRETSSTLFEELGFHYVGPVDGHNIDDLVSILETLKSTKTIGPVLIHVVTEKGRGYPYAERADDKYHGVLKFDPETGKQFKNISKTQSYTSCFVEALIAEAEADKDIVAIHAAMGGGTMLNLFESRFPTRCFDVGIAEQHAVTFAAGLACEGLKPFCTIYSSFMQRAYDQVVHDVDLQKLPVRFAIDRAGLMGADGPTHCGAFDVTFMACLPNMIVMAPSDEAELFNMVATAAAIDDRPSCFRYHRGNGIGVSLPPGNKGVPLQIGRGRILRDGERVALLGYGSAVQRCLEAASMLSERGLKITVADARFCKPLDVALIRSLAKSHEVLITVEEGSIGGFGSHVVQFLALDGLLDGKLKVYRTWITNGSTS

SEQ ID NO: 11758 - protein, 209 aa, Curcuma longa
SGAFDVAYMACLPNMVVMAPSDEAELFHMVATAAAIDDRPSCFRYPRGNGIGVPLPPGNKGVPLEIGKGRILIEGERVALLGYGTSVQSCLAAASMVELQGLKITVADARFCKPLDRSLIRSLAKSHEVLITVEEGSIGGFGSHVAQFMALDGLLDGKLKWRPLVLPDRYIDHGSPSDQLAAAGLTPSHIAASVFNVIGQTREALKMMS

SEQ ID NO: 11759 - protein, 146 aa, Ipomoea batatas
EVGRGRILMEGERVALVGYGTAVQSCLSAAALLETRGLRVTVADARFCKPLDHALIRSLAKSHEVMITVEEGSIGGFGSHVAQFMALDGLLDGNLKWRPVVLPDRYIDHGAPADQLAEAGLTPSHIAATVFNILGQAREALEIMTT

SEQ ID NO: 11760 - protein, 553 aa, Pennisetum glaucum
GFTKRAESEYDSFGTGHSSTTISAALGMAVGRDLKGGKNHVVAVIGDGAMTAGQAYEAMNNAGYLDSDMIVILNDNKQVSLPTATLDGPAPPVGALSSALSKLQSSRPLRELREVAKGVTKQIGGSVHELAAKVDEYARGMISGPGSSLFEELGLYYIGPVDGHNIDDLISILNDVKSTKTTGPVLIHVVTEKGRGYPYAERAADKYHGVAKFDPATGKQFKSPAKTLSYTNYFAEALIAEAEQDSKIVAIHAAMGGGTGLNYFLRRFPNRCFDVGIAEQHAVTFAAGLACEGLKPFCAIYSSFLQRGYDQVVHDVDLQKLPVRFAMDRAGLVGADGPTHCGAFDVTYMACLPNMVVMAPADEAELCHMVATAAAIDDRPSCFRYPRGNGVGVPLPPNYKGTPLEVGKGRILQEGDRVALLGYGSAVQYCLAAATLVERHGLRVTVADARFCKPLDQALIRSLAKSHEVLITVEEGSIGGFGSHVAQFMALDGLLDGKLKWRPLVLPDRYIDHGSPADQLAEAGLTPSHIAATVFNVLGQNREALAIMAVPNA

SEQ ID NO: 11761 - protein, 61 aa, Arachis hypogaea
MALDGLLDGKLKWRPMVLPDRYIDHGSPADQLSEAGLAPTQIAATVFNILGQTREALEVMS

SEQ ID NO: 11762 - protein, 223 aa, Tragopogon dubius
MDRAGLVGADGPTHSGSFDVTFMACLPNMVVMAPSDEAELFHMVATAAAIDDRPSCFRYPRGNGIGAPLPPGNKGIPLEIGKGRIVIEGQRVALLGYGSAVQSCLAAAALVQDRGLSITVADARFCKPLDHSLIRALAKSHEVLITVEEGSIGGFGSHVAHFMALDGLLDGKLKWRPLVLPDRYIEHGAPADQLAEAGLTPSHIAATVFNVLGQTREALEVMS

SEQ ID NO: 11763 - protein, 223 aa, Ambrosia trifida
MDRAGLVGADGPTHSGSFDVTYMACLPNMVVMAPSDEAELFHMVATAAAIDDRPSCFRYPRGNGIGVPLPPGNKGIPLEVGKGRIMLEGERVALLGYGTAVQSCLAAAGLVKQRGLNITVADARFCKPLDHHLIRALAKSHEVLITVEEGSIGGFGSHVAHFMALDGLLDGKLKWRPLVLPDRYIDHGAPDDQLAEAGLTPSHIAATVFNVLGKTREALEVMS

SEQ ID NO: 11764 - protein, 156 aa, Cirsium arvense
PLPPGNKGVPLEIGKGRIMIEGQRVALLGYGTAVQSCMAAAALVQERGLNITVADARFCKPLDHSLIRTLAKSHDVLITVEEGSIGGFGSHVAHFMALDGLLDGNLKWRPLVLPDRYIDHGAPNDQLAEAGLTPSHIAATVFNVIGQTREALEVMS

SEQ ID NO: 11765 - protein, 411 aa, Fagopyrum esculentum
MISGSGSTLFEELGLYYIGPVDGHNIDDLVAILKEVKSTNTTGPVLIHVVTEKGRGYPYAEKADDKYHGVVKFDPATGKQFKSQSLTKSYTTYFAEALIAEAEADKDVVAIHAAMGGGTGLNLFQRRFPSRCFDVGIAEQHAATFAAGLACEGLKPFCTIYSSFMQRAYDQVVHDVDLQKLPVRFAMDRAGLVGADGPTHCGAFDVTFMACLPNMVVMAPSDEAELFHMVATATAIDDRPSCFRYPRGNGIGVELPPGNKGIPLEIGKGRILKEGERVALLGYGTAVQSCLAASALVEARGLRLTVVDARFCKPLDQALIRSLAKSHEVLITVEEGSIGGFGSHVAQFMALDGLLDGNLKWRPMVLPDRYIEHGAPADQMAEAGLTPAHIAATIFNILGQTREALEVLAYK

SEQ ID NO: 11766 - protein, 175 aa, Fraxinus spp
TKLFPLSQRNGGLELPPGNKGIPLEVGRGRILIEGERVALLAYGSAVQSCLAAAALVEPRGLRLTVADARFCKPLDHSLIRSLAKSHEILITVEEGSIGGFGSHVAQFMALDGLLDGNLKWRPLVLPDRYIDHGSPADQLMEAGLTPSHIAATVFNILGKAREALEIMSESVRIA

SEQ ID NO: 11767 - protein, 301 aa, Pisum sativum
DIIAIHAAMGGGTGMNLFHRRFPTRCFDVGIAEQHAVTFAAGLACEGLKPFCAIYSSFLQRAYDQVVHDVDLQKLPVRFAMDRAGLVGSDGPTHSGTFDVTFMACLPNMVVMAPSDEAELCHMVATAAAIDDRPSCFRYPRGNGVGVELPAEYKGIPLEIGKGRILIEGERVALLGYGSAVQSCLAAASLVERHGLRLTVADARFCKPLDRSLIRSLAKSHEVLITVEEGSIGGFGSHVAQFMALDGLLDGKLKWRPVVLPDRYIDHGSPNDQLSMAGLTPSHIAATVFNILGQTREALEV

SEQ ID NO: 11768 - protein, 220 aa, Trigonella foenum-graecum
CFDVGIAEQHAVTFAAGLACEGLKPFCAIYSSFLQRAYDQVVHDVDLQKLPVRFAMDRAGLVGSDGPTHCGSFDVTFMACLPNMVVMAPSDEAELCHMVATAAAIDDRPSCFRYPRGNGIGVELPTEYKGNPLEIGKGRILIEGERVALLGYGSAVQSCLAAASLVEHHGLRLTVADARFLQTIRSILDSQPGKITRGSDHRRRRINWRIWFSCCSVHGP

SEQ ID NO: 11769 - protein, 134 aa, Citrullus lanatus
ERVALLGYGTAVQNCLAAASMVERHGLRITVADGRFCKPLDRALIRSLAKSHEILITVEEGSIGGFGSHVIQFLALDGLLDGTLKWRPLVLPDRYIDHGLPADQLAEAGLTPSHIAATVFNMLGQTREALEIMS

SEQ ID NO: 11770 - protein, 362 aa, Artemisia annua
HVITEKGRGYPYAEKAADKYHGVGKFDPATGKQFKSSAPTQSYTTYFAEALIAEAEADKKIVGIHAAMGGGTGMNLFLRRFPTRCFDVGIAEQHAVTFAAGLACEGLKPFCAIYSSFLQRGYDQVVHDVDLQKLPVRFAMDRAGLVGADGPTHSGSFDVTFMACLPNMVVMAPSDEAELFNMVATAAAIDDRPSCFRYPRGNGIGVPLPPGNKGVPLEVGKGRIMLEGQRVALLGYGTAVQSCMAAATIVQERGLNITVADARFCKPLDHSLIRALAKTHEVLITVEEGSIGGFGSHVAHFLALDGLLDGNLKWRPLVLPDRYIDHGAPADQLAEAGLTPSHIAATVFNVLGQTREALEVMS

SEQ ID NO: 11771 - protein, 507 aa, Castanea mollissima
AVIGDGAMTAGQAYEAMNNAGYLDSDMIVILNDNKQVSLPTATLDGPIPPVGALSSALSRLQSNRPLRELREVAKGVTKQIGGPMHELAAKVDEYARGMISGSGSTLFEELGLYYIGPVDGHNIDDLISILKEVKSTKTTGPVLIHVVTEKGRGYPYAEKAADKYHGVAKFDPATGKQFKTKAPTQSFTTYFAEALIAEAEIDKDIVAIHAAMGGGTGLNLFLRRFPTRCFDVGIAEQHAVTFAAGLACEGVKPFCAIYSSFMQRAYDQVVHDVDLQKLPVRFAMDRAGLVGADGPTHCGAFDVTFMACLPNMVVMAPSDEAELFHMVATAAAIDDRPSCFRYPRGNGVGVQLPPGNKGIPLEVGKGRILIEGERVALLGYGTAVQSCLAAASLVESRDLRVTVADARFCKPLDRALIRSLAKSHEYLITVEEGSIGGFGSHVAQFLALDGLLDGEVKWRPLVLPDRYIDHGSPADQLTEAGLTPYHIAATVFNIIGKTREALEIMS

SEQ ID NO: 11772 - protein, 141 aa, Cynodon dactylon
AGGDRVALLGYGSAVQNCLAAASLVEQHGLKVTVADARFCKPLDHALIRSLAKSHEVLITVEEGSIGGFGSHVAQFMALDGLLDGKLKWRPLVLPDRYIDHGSPADQLAIAGLTPSHIAATVFNILGQNREALAIMATPSV

SEQ ID NO: 11773 - protein, 167 aa, Mesembryanthemum crystallinum
GCTNSARGHRCAITTRNKGTPLEIGKGRILLEGARVALLAYGSAVHSCLAAAALVESRGLRVTVADARFCKPLDHALIRSLAKSHEILITVEEGSIGGFGSHVVQFMALDGLLDGKLKWRPIVLPDRYIEHGSPADQLAEAGLTPGHIAATVFNILGQTREALEVMS

SEQ ID NO: 11774 - protein, 201 aa, Lotus japonicus
MACLPNMVVMAPSDEAELFHMVATAATIDDRPSCLRYPRGNGVGVELPQWNKGTPLEIGKGRILIGGERVALLGYGSAVQSCVAAASLLEHHGMHVTVADARFCKPLDHSLIRSLAKSHEILITVEEGSIGGFGSHVVQFMALDGLLDGKLKWRPMVLPDCYIDHGSPADQLSQAGLTPSHIAATVLNMLGQTREALEVMS

SEQ ID NO: 11775 - protein, 483 aa, Arachis hypogaea
IERIVILNDNKQVSLPTATLDGPIPPVGALSSALSRLQSNRPLRELREVAEGVTKSIGGPMHELAAKVDEYARGMIGGSGSTLFEELGLYYIGPVDGHNIDDLISILNEVKSTKTTGPVLIHVVTEKGRGYPYAEKAADKYHGVAKFDPKTGKQFKANASTQSYTTYFAEALIAEAEADKDIVAIHAAMGGGTGMNLFLRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEAELFHMVATAAAIDDRPSCFRYPRGNGIGVELPLGNKGIPLEIGKGRILMEGERVALLGYGAAVQSCLAAASLVEHHGLRITVADARFCKPLDRSFIRSLAKSHEVLITVEEGSIGGFGSHVVQFMALDGLLDGKLKWRPMVLPDRYIDHGSPVDQLSEAGLAPTQIAATVFNILGQTREALEVMS

SEQ ID NO: 11776 - protein, 297 aa, Cajanus cajan
MLQWGWNRHEYLPSPFPNRCFDVGIAEQHAVTFAAGLACEGLKPFCTIYSSFMQRAYDQVVHDVDLQKLPVRFALDRAGLVGADGATHCGAFDVTFMACLPNMVVMAPSDEAELCHMVATAVAIDDRPSCFRYPRGNGIGVEVPPGNKGTPLEIGKGRILIEGERVALLGYGVAVQSCVAAASLLEHHGLRATVADARFCKPLDRNLIRSLAKSHEVLITVEEGSIGGFGSHVAHFMALDGLLDGKLKWRPMVLPDCYIDHGSLADQLNEAGLTPSHIAATVFNLLGQTREALEVMS

SEQ ID NO: 11777 - protein, 177 aa, Saccharum officinarum
RRPPVLFPEPERQRHWRPVAGNYKGTPLEVGKGRIVLEGDRVALLGYGSAVQYCLAAASLVERHGLKVTVADARFCKPLDHALIRSLAKSHEVLITVEEGSIGGFGSHVAQFMALDGLLDGKLKWRPLVLPDRYIDHGSPADQLGEAGLTPSHIAATVFNILGQNREALAIMAVPNA

SEQ ID NO: 11778 - protein, 331 aa, Brassica napus
MTLEVLRNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGGGGDAGGAADRVLNQLLTEMDGMNAKKTVFIIGATNRPDIIDSALLRPGRLDQLIYIPLPDEDSRLNIFKACLRKSPVAKDVDINALAKYTQGFSGADITEICQRACKYAIRENIEKDIEKEKRRSENPEAMEEDGVDEVSEIKAAHFEESMKYARRSVSDADIRKYQAFAQTLQQSRGFGSEFRFETNAAGSGATTGVADPFATSAAAAADDDDLYN

SEQ ID NO: 11779 - protein, 209 aa, Brassica napus
MSTSTLLSATATHLLFVKLLFLMFLGMTLEVLRMSRESSRRLSNTQWSTQRSLRSMSPSKGVLFYGPPGCGKTLLAKAIANECQANFISVKGPELLTMWFGESEANVREIFDKARQSAPCVLFFDELDSIATQRGGGGGGDAGGAADRVLNQLLTEMDGMNAKKTVSSSEQPTDPTLLILLFSVQEGSTSSFTFRSQTRIHVSTSSRPA

SEQ ID NO: 11780 - protein, 560 aa, Brassica napus
GSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGGGGDAGGAADRVLNQLLTEMDGMNAKKTVFIIGATNRPDIIDSALLRPGRLDQLIYIPLPDEDSRLNIFKACLRKSPVAKDVDINALAKYTQGFSGADITEICQRACKYAIRENIEKDIEKEKRRSENPEAMEEDGVDEVSEIKAAHFEESMKYARRSVSDADIRKYQAFAQTLQQSRGFGSEFRFETNAAGSGATTGVADPFATSAAAAADDDDLYN

SEQ ID NO: 11781 - protein, 234 aa, Brassica napus
VFSSLYELDSIATQRGGGSGGDGGGAADRVLNQLLTEMDGMNAKKTVFIIGATNRPDIIDSALLRPGRLDQLIYIPLPDEDSRLNIFKACLRKSPIAKDVDINALAKYTQGFSGADITEICQRACKYAIRENIEKDIEKEKRRSENPEAMEEDMDEVSEIKAAHFEESMKYARRSVSDADIRKYQAFAQTLQQSRGFGSEFRFETNAGSGATTGVADPFATSAAAAADDDDLYN

SEQ ID NO: 11782 - protein, 204 aa, Brassica juncea
NQLLTEMDGMNAKKTVFIIGATNRPDIIDSALLRPGRLDQLIYIPLPDEDSRLNIFKACLRKSPVAKDVDINALAKYTQGFSGADITEICQRACKYAIRENIEKDIEREKRRSLNPEAMEEDGVDEVSEIKAAHFEESMKYARRSVSDADIRKYQAFAQTLQQSRGFGSEFRFETNAGSGATTGVADPFATSAAAAADDDDLYN

SEQ ID NO: 11783 - protein, 194 aa, Brassica juncea
MNAKKTVFIIGATNRPDIIDSALLRPGRLDQLIYIPLPDEDSRLNIFKACLRKSPIAKDVDINALAKYTQGFSGADITEICQRACKYAIRENIEKDIEKEKRRSENPEAMEEDMDEVSEIKAAHFEESMKYARRSVSDADIRKYQAFAQTLQQSRGFGSEFRFETNAGSGATTGVADPFATSAAAAADDDDLYN

SEQ ID NO: 11784 - protein, 557 aa, Brassica rapa
  misc_feature (377)..(377): Xaa can be any naturally occurring amino acid
GKTLIARAVANETGAFFFCINGPEIMPKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEEVDLERISKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGGGGDAGGAADRVLNQLLTEMDGMNAKKTVFIIGATNXPDIIDSALLRPGRLDQLIYIPLPDEDSRLNIFKACLRKSPVAKDVDINALAKYTQGFSGADITEICQRACKYAIRENIEKDIEREKRRSLNPEAMEEDGVDEVSEIKAAHFEESMKYARRSVSDADIRKYQAFAQTLQQSRGFGSEFRFETNAGSGATTGVADPFATSAAAAADDDDLYN

SEQ ID NO: 11785 - protein, 522 aa, Brassica napus
MSNPAESSDSKPKKDFSTAILERKKSPNRLVVDEAINDDNSVVSLHPATMEKLQLFRGDTILIKGKKRKDTICIALADESCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVPNVSWDDIGGLENVKRELQETVQYPVEHPEKFEKYVSIKGSPFLRSSWMW

SEQ ID NO: 11786 - protein, 522 aa, Brassica napus
MSNPAESSDSKSKKDFSTAILERKKSPNRLVVDEAINDDNSVVSLHPDTMEKLQLFRGDTILIKGKKRKDTVCIALADESCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRLGRLDREIDIGVPDEMGRLEVLRIHTKNMKLAEDVDLERISKDTHGYVGADLAALCTEAALQCIREKMDVIDLEDDSIDAEILNSMAVTNEHFHTALGNSNPSALRETVVPNVSWDDIGGLENVKRELQETVQYPVEHPEKFEKYVSFKGSPILRSSWMW

SEQ ID NO: 11787 - protein, 522 aa, Brassica napus
MSNPAESSDSKSKKDFSTAILERKKSPNRLVVDEAINDDNSVVSLHPATMEKLQLFRGDTILIKGKKRKDTICIALADESCEEPKIRMNKVVRSNLRVRLGDVISVHQCPDVKYGQRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVPNVSWDDIGGLENVKRELQETVQYPVEHPEKFEKYVSVKGSPFLRSSWMW

SEQ ID NO: 11788 - protein, 198 aa, Raphanus sativus
MDGMNAKKTVFIIGATNRPDIIDSALLRPGRLDQLIYIPLPDEDSRLNIFKAALRKSPIAKDVDINALAKYTQGFSGADITEICQRACKYAIRENIEKDIEKEKRRSENPEAMEEDGVDEVSEIKAAHFEESMKYARRSVSDADIRKYQAFAQTLQQSRGFGSEFRFETNAGSGVTTGVADPFATSAAATADDDDLYN

SEQ ID NO: 11789 - protein, 532 aa, Brassica rapa
  misc_feature (10)..(11): Xaa can be any naturally occurring amino acid
  misc_feature (21)..(21): Xaa can be any naturally occurring amino acid
MSKLAGESEXXLRKAFEEAEXNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGSGGDGGGAADRVLNQLLTEMDGMNAKKTVFIIGATNRPDIIDSALLRPGRLDQLIYIPLPDEDSRLNIFKACLRKSPIAKDVDINALAKYTQGFSGADITEICQRACKYAIRENIEKDIEKEKRRSENPEAMEEDMDEVSEIKAAHFEESMKYARRSVSDADIRKYQAFAQTLQQSRGFGSEFRFETNAGSGATTGVADPFATSAAAAAADDDDLYN

SEQ ID NO: 11790 - protein, 282 aa, Brassica oleracea
  misc_feature (66)..(66): Xaa can be any naturally occurring amino acid
  misc_feature (70)..(70): Xaa can be any naturally occurring amino acid
TLLAKAIANECQANFISVKGPELLTMWFGESEANVREIFDKARQSAPCVLFFDELDSIATQRGGGXGGDXGGAADRVLNQLLTEMDGMNAKKTVFIIGATNRPDIIDSALLRPGRLDQLIYIPLPDEDSRLNIFKACLRKSPVAKDVDINALAKYTQGFSGADITEICQRACKYAIRENIEKDIEREKRRSLNPEAMEEDGVDEVSEIKAAHFEESMKYARRSVSDADIRKYQAFAQTLQQSRGFGSEFRFETNAGSGATTGVADPFATSAAASADDDDLYN

SEQ ID NO: 11791 - protein, 161 aa, Brassica napus
RFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVPNVSWDDIGGLENVKRELQETVQYPVEHPEKFEKYVSFKGSPILRPSWMW

SEQ ID NO: 11792 - protein, 143 aa, Brassica napus
MKLAEDVDLERISKDTHGYVGADLAALCTEAALQCIREKMDVIDLEDDSIDAEILNSMAVTNEHFHTALGNSNPSALRETVVEVPNVSWDDIGVLRMSRESSRRLFNTLWSTQRSSRNSVCLLQRESYSTVLLDVVKPFWPKL

SEQ ID NO: 11793 - protein, 434 aa, Raphanus sativus
DEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGGGGDAGGAADRVLNQLLTEMDGMNAKKTVFIIGATNRPDIIDSALLRPGRLDQLIYIPLPDEDSRLNIFKACLRKSPVAKDVDINALAKYTQGFSGADITEICQRACKYAIRENIEKDIEREKRRSLNPEAMEEDGVDEVSEIKAAHFEESMKYARRSVSDADIRKYQAFAQTLQQSRGFGSEFRFETNTGSGATTGVADPFATSAAAAADDDDLYN

SEQ ID NO: 11794 - protein, 205 aa, Thellungiella halophila
  misc_feature (59)..(59): Xaa can be any naturally occurring amino acid
LNQLLTEMDGMNAKKTVFIIGATNRPDIIDAALLRPGRLDQLIYIPLPDEDSRLNIFKXCLRKSPVAKDVDINALAKYTQGFSGADITEICQRACKYAIRENIEKDIEKEKRRSENPEAMEEDGEDEVSEIKAAHFEESMKYARRSVSDADIRKYQAFAQTLQQSRGFGSEFRFENTAGSGATTGVADPFATSAAAAADDDDLYN

SEQ ID NO: 11795 - protein, 128 aa, Brassica napus
STSDCYSERRWRRRSDAGGAARLESSTSFDRDGWNERPRRLLHHRSDQQGPTLLILARSPYQEGSTSSFTFHYRITDSRLNIFKACLRKSPVAKDVDINALAKYTQGFSGADITEICQRACKYAIRET

SEQ ID NO: 11796 - protein, 319 aa, Brassica napus
MKLVPFSSVSMVLRSCLSWLVRVRAISGKRLRRLRRTAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLSLTS

SEQ ID NO: 11797 - protein, 141 aa, Eutrema halophilum
NQLLTEMDGMNAKKTVFIIGATNRPDIIDAALLRPGRLDQLIYIPLPDEDSRLNIFKACLRKSPVAKDVDINALAKYTQGFSGADITEICQRACKYAIRENIEKVRDQLKRRRGGARTQRRWRKMERMKCQRSKLHTLRSR

SEQ ID NO: 11798 - protein, 125 aa, Brassica juncea
FSGADITEICQRACKYAIRENIEKDIEKEKRRSENPEAMEEDGVDEVSEIKAAHFEESMKYARRSVSDADIRKYQAFAQTLQQSRGFGSEFRFETNAAGSGATTGVADPFATSAAAAADDDDLYN

SEQ ID NO: 11799 - protein, 124 aa, Brassica juncea
FSGADITEICQRACKYAIRENIEKDIEKEKRRSENPEAMEEDGVDEVSEIKAAHFEESMKYARRSVSDADIRKYQAFAQTLQQSRGFGSEFRFETNAGSSATTGVADPFATSAAAAADDDDLYN

SEQ ID NO: 11800 - protein, 565 aa, Primula obconica
KPPKGILLYGPPGSGKTLIARAVANETGAFFFCINGPEIMSKMAGESESNLRKAFEEAEKNAPSIIFIDEIDSIAPKRDKTNGEVERRIVSQLLTLMDGLKSRAHVIVMGATNRPNSIDPALRRFGRFDREIDIGVPDEVGRLEVLRIHTKNMKLAEDVDLEKISKETHGYVGADLAALCTEAALQCIREKMDVIDLEDESIDAEILNSMAVSNEHFTTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGGSVGDAGGAADRVLNQLLTEMDGMSAKKTVFIIGATNRPDIIDSALLRPGRLDQLIYIPLPDEESRFQIFKSCLRKSPVSKDVDIRALAKYTQGFSGADITEICQRACKYAIRENIEKDIEKERRMSENPEAMEEDVDDEVSEIKAAHFEESMKFARRSVSDADIRKYQAFAQTLQQSRGFGSEFRFETSAATTGADPFASAAGGADEDDLYS

SEQ ID NO: 11801 - protein, 301 aa, Thalictrum flavum
VIVMGATNRPNSIDPALRRFGRFDREIDIGVPDEIGRLEVLRIHTKNMKLSDDVDLERISKDTHGYVGADLAALCTEAALQCIREKMDVIDLEDESIDAEILNSMAVTNEHFKTALGTSNPSALRETVVEVPNVNWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMSAKKLYSLLAPPTGQTLLILPYLDLVALIS

SEQ ID NO: 11802 - protein, 412 aa, Cleome gynandra
DVDLEKISKETHGYVGADLAALCTEAALQCIREKMDVIDLEDDSIDAEILNSMAVTNEHFQTALGNSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEESRLQIFKACLRKSPVAKDVDIRALAKYTQGFSGADITEICQRACKYAIRENIEKDIERERRRSENPEAMEEDVEDEVAEIKAAHFEESMKYARRSVSDADIRKYQAFAQTLQQSRGFGTEFRFAETTGTAATTGTADPFATAAGAADDDDLYS

SEQ ID NO: 11803 - protein, 255 aa, Scabiosa columbaria
MWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEESRFNIFKSCLRKSPVSKDVDLSALAKYTQGFSGADITEICQRACKYAIRENIEKDIEKERRRSENPEAMEEDDADDEVAEIKAAHFEESMKYARRSVSDADIRKYQAFAQTLQQSRGFGSEFRFAETSGAGTTAAADPFATSAAAADEDDLYS

SEQ ID NO: 11804 - protein, 416 aa, Amaranthus tuberculatus
MKLSDEVDLERISKDTHGYVGADLAALCTEAALQCIREKMDVIDLEDETIDAEILNSMAVTNEHFQTALGQSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEESRLSIFKAALRKSPIAKDVDLRALAKYTQGFSGADITEICQRACKYAIRENIEKDIEREKRRSENPEAMEEDDVEDEVAEIKAAHFEESMKYARRSVSDADIRKYQAFAQTLQQSRGFGTEFRFNNTSSGATTGADAFAASAGGADEDDLYN

SEQ ID NO: 11805 - protein, 237 aa, Amaranthus tuberculatus
RGSAPCVLFFDELDSIATQRGSSVGDAGGAADRVLNQLLTEMDGMSAKKTVFIIGATNRPDIIDPALLRPGRLDQLIYIPLPDEESRLSIFKAALRKSPIAKDVDLRALAKYTQGFSGADITEICQRACKYAIRENIEKDIEREKRRSENPEAMEEDDVEDEVAEIKAAHFEESMKYARRSVSDADIRKYQAFAQTLQQSRGFGTEFRFNNTSSGATTGADAFAASAGGADEDDLYN

SEQ ID NO: 11806 - protein, 379 aa, Cleome gynandra
MDVIDLEDDSIDAEILNSMAVTNEHFQTALGNSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEESRLQIFKACLRKSPVAKDVDIRALAKYTQGFSGADITEICQRACKYAIRENIEKDIERERRRSDNPEAMEEDMDDEVAEIKAAHFEESMKYARRSVSDADIRKYQAFAQTLQQSRGFGTEFRFGESTNTTGGTTGTADPFATSAAAADDDDLYS

SEQ ID NO: 11807 - protein, 244 aa, Euphorbia peplus
REIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRRRDNPEAMEEDVEDEVAEIKAAHFEESMKYARRSVSDADIRKYQAFAQTLQQSRGFGSEFRFSEASGGATTGGADPFTSTAAAADDDDLYS

SEQ ID NO: 11808 - protein, 399 aa, Euphorbia esula
  misc_feature (223)..(223): Xaa can be any naturally occurring amino acid
  misc_feature (330)..(330): Xaa can be any naturally occurring amino acid
VAVGADLAALCTEAALQCIREKMDVIDLEDESIDAEILNSMAVTNEHFHTALSNSNPSALRETVVEVPNCSWEDIGGLEYVKRELQETVQYPVEHPEKFEKFGMSPSKGVLFYGPPGCGKTLLAKAIANECQANFISVKGPELLTMWFGESDANVREIFDKARQSAPCVLFFDELDSIATQRGSSVGDAGGAADRVLNQLLTEMDGMSAKKTVFIIGATNRPXIIDPALLRPGRLDQLIYIPLPDEDSRHQIFKACLRKSPVSKDVDLRALAKYTQGFSGADITEICQRACKYAIRENIEKDIERERRRRDNPEAMEEDVEDEVAEIKAXHFEESMKYARRSVSDADIRKYQAFAQTLQQSRGFGSEFRFSEASGGATTGGADPFTSTAAAADDDDLYS

SEQ ID NO: 11809 - protein, 300 aa, Thellungiella halophila
MSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEDSRLNIFKACLRKSPVAKDVDVTALAKYTQGFSGADITEICQRACKYAIRENIEKDIERERRRSENPEAMEEDLVDDEVAEIRAAHFEESMKYARRSVSDADIRKYQAFAQTLQQSRGFGTEFRFDPTAAAGRTTGGAAADPFATSAAAADDDDLYS

SEQ ID NO: 11810 - protein, 346 aa, Cleome spinosa
RFDREIDIGVPDEIGRLEVLRIHTKNMKLAEDVDLERISKDTHGYVGADLAALCTEAALQCIREKMDVIDLEDDSIDAEILNSMAVTNEHFQTALGNSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEESRLQIFKACLRKSPVAKDVDIMALAKYTQGFSGADITEICQRACKYAIRRKHREGH

SEQ ID NO: 11811 - protein, 450 aa, Actinidia deliciosa
IDPALRRFGRFDREIDIGVPDEVGRLEVLRIHTKNMKLAEDVDLERIAKDTHGYVGADLAALCTEAALQCIREKMDVIDLEDESIDAEILNSMAVTNEHFQTALGTSNPSALRETVVEVPNCSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPISKDVDLRALAKYTQGFSGADITEICQRACKYAIRENIEKDIERERRRSENPEAMEEDVEDEVAEIKAAHFEESMKYARRSVSDADIRKYQAFAQTLQQSRGFGSEFRFSETSAGATTGSDPFAASAGGPDEDDLYS

SEQ ID NO: 11812 - protein, 519 aa, Quercus alba
SNLRKAFEEAEKNAPSIIFIDEIDSIAPKREKTHGEVERRIVSQLLTLMDGLKSRAHVIVMGATNRPNSIDPALRRFGRFDREIDIGVPDEIGRLEVLRIHTKNMKLSEDVDLERIAKDTHGYVGADLAALCTEAALQCIREKMDVIDLEDETIDAEILNSMAVSNEHFQTALGTSNPSALRETVVEVPNCSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPISKDVDLRALAKYTQGFSGADITEICQRACKYAIRENIEKDIERERRRRDNPEAMEEDVEDEVAEIKAAHFEESMKYARRSVSDADIRKYQAFAQTLQQSRGFGSEFRFADNTSSGATASDPFATAAAGADEDDLYN

SEQ ID NO: 11813 - protein, 631 aa, Malus domestica
EYCVVAPDTEIFCEGEPVRREDEERTLNEVGYDDVGGVRKQMAQIRELVELPLRHPQLFKSIGVKPPKGILLYGPPGTGKTLIARAVANETGAFFFCINGPEIMSKMAGESESNLRKAFEEAEKNAPSIIFIDEIDSIAPNREKTHGEVERRIVSQLLTLMDGLKSHAHVIVMGATNRPNSSDPALRRFGRFDREIDIGVPDEVGRLEVLRIHTKNMKLAEDVDLEKIAKDTHGYVGADLAALCTEGALQCIREKMDVIDLEDEEIDAEIINSMAVTNQHLKTALSTSNPSALRETVVEVPNVSWEDIGGLESVKRELQETVQYPVEHPEKFEKFGMSPSKGVLFYGPSGCGKTLLAKAIANECQANFISIKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEESRFQIFKSCLRKSPVSKDVDIRALAKYTQGFSGADITEICQRACKYAIRENIEKDIEKERRRNENPEAMEEDVEDEIAEIKAAHFEESMKYARRSVSDADIRKYQAFAQTLQQSRGFGTEFRFADNPSGTTAAADPFATAAAGADEDDLYN

SEQ ID NO: 11814 - protein, 285 aa, Brassica napus
GKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEESRLSIFKACLRKSPVAKDVDVRALAKYTQGFSGADITEICQRACKYAIRENIEKDIERERRRGENPEAMEEDLVDDEVAEIRAAHFEESMKYARRSVSDADIRKYQAFAQTLQQSRGIGSEFRFDPTASAGRTTGGASADPFATSAAAADDDDLYS

SEQ ID NO: 11815 - protein, 533 aa, Brassica napus
MSKMAGESESNLRKAFEEAEKNAPSIIFIDEIDSIAPKRDKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDESIDAEILNSMAVSNEHFHTALGNSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEESRLSIFKACLRKSPVAKDVDVRALAKYTQGFSGADITEICQRACKYAIRENIEKDIERERRRGENPEAMEEDLVDDEVAEIRAAHFEESMKYARRSVSDADIRKYQAFAQTLQQSRGIGSEFRFDPTASAGRTTGGASADPFATSAAAADDDDLYS

SEQ ID NO: 11816 - protein, 221 aa, Fagopyrum esculentum
IFIDEIDSIAPKREKTNGEVERRIVSQLLTLMDGLKSRAHVIVMGATNRPNSIDPALRRFGRFDREIDIGVPDEVGRLEILRIHTKNMKLAEDVDLEKICKETHGYVGADLAALCTEAALQCIREKMDVIDLETTPSMQRFELHGSSNEHFSTALGQGNPSALRETVVEVPKFHGMTSVVLRTSRESFKRLYNIPWNILRSLKSSECLPQRVFVLRPSWMW

SEQ ID NO: 11817 - protein, 320 aa, Primula obconica
VKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEESRFQIFKSCLRKSPISKEVDLRALAKYTQGFSGADITEICQRSCKYAIRENIEKDIEKEKRRSENPEAMEEDVDDEVAEIKAAHFEESMKYARRSVSDADIRKYQSFAQTLQQSRGFGSEFRFSEASGGGGATTGSDPFAAPAGGADEDDLYS

SEQ ID NO: 11818 - protein, 179 aa, Sarracenia psittacina
WDIIDPALLRPGRLDQLVYIPLPDEDSRHQIFKACLRKSPVSKDVDLRALAKYTQGFSGADITEICQRACKYAIRENIEQDIEKEKRRKENPEAMEEDVEDELSEIKAAHFEESMKYARRSVSDADIRKYQAFAQTLQQSRGFGTEFRFSETSAGTAAATGSDPFAASAGGADEDDLYS

SEQ ID NO: 11819 - protein, 666 aa, Medicago truncatula
YFLEAYRPVRKGDFFLVRGGMRSVEFKVIETDPHEYCVVAPDTEIFCEGEPIKREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLEKISKETHGYVGADLAALCTEAALQCIREKMDVIDLEDETIDAEILNSMAVTNEHFATALGSSNPSALRETVVEVPNCSWDDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPISKDVDIRALAKYTQGFSGADITEICQRACKYAIRENIEKDIEKERKRSENPEAMEEDIEDEVAEIKAAHFEESMKYARRSVSDADIRKYQAFAQTLQQSRGFGTEFRFADSGTSGAAAAGASDPFSSAAGADDDDLYN

SEQ ID NO: 11820 - protein, 124 aa, Momordica charantia
LNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERRGGEEIILRLWKRMM

SEQ ID NO: 11821 - protein, 86 aa, Avena sativa
MEEDEVDEVAEIRAAHFEESMKYARRSVSDADIRKYQAFAQTLQQSRGFGSEFRFPDQPAAGAATTAAADPFASAAATADDDDLYS

SEQ ID NO: 11822 - protein, 84 aa, Petunia hybrida
MEEDVDDEIAEIKAAHFEESMKYARRSVSDADIRKYQAFAQTLQQSRGFGSEFRFADTNTSATGAADPFATAVGGAADDDDLYS

SEQ ID NO: 11823 - protein, 360 aa, Ambrosia trifida
MAVTNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVFFFYELDSIATQRGSSQGDAGGAADRVLNQLLTEMDGMSAKKTVFIIGATNRPDIIDPALLRPGRLDQLIYIPLPDEESRYSIFKSALRKSPVAKDVDLHALAKYTQGFSGADITEICQRACKYAIRENIEKDIEREKRRSENPEAMEEDVEDDVPEIKAAHFEESMKFARRSVSDADIRKYQAFAQTLQQSRGFGSEFRFSETSGAAASAGGSDPFAASAGAADDDDLYN

SEQ ID NO: 11824 - protein, 252 aa, Cucurbita pepo
MWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPISKDVDLRALAKYTQGFSGADITEICQRACKYAIRENIEKDIERERRRRDNPEAMEEDVEDEVAEIKAAHFEESMKFARRSVSDADIRKYQAFAQTLQQSRGFGSEFRFSENTSGTAAADPFATSAGGADDDDLYN

SEQ ID NO: 11825 - protein, 544 aa, Malus domestica
MKLAAILFLHQVDPEIMLKLAGESESNLTKAFEEADKNAPSIIFIDEIDSIAPKREKTHGEVERRIVSQLLTLMDGLKSRAHVIVMGATNRPNSIDPALRRFGRFDREIDIGVPDEIGRLEVVRIHTKNMKLAEDVDLEKIAKDTHGYVGADLAALCTEAALQCIREKMDVIDLEDEEIDAEILNSMAVTNEHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMTAKKTVFIIGATNRPDIIDPALLRPGRLDQLIYIPLPDEESRFQIFKSCLRKSPVSKDVDIRALAKYTQGFSGADITEICQRACKYAIRENIEKDIEKERRRNENPEAMEEDVEDEIAEIKAAHFEESMKYARRSVSDADIRKYQAFAQTLQQSRGFGTEFRFADNPSGTTAAADPFATAAAGADEDDLYS

SEQ ID NO: 11826 - protein, 530 aa, Solanum tuberosum
MSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEEVDLERICKDTHGYVGADLAALCTEAALQCIREKMDVIDLEDETIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSSSGDAGGAADRVLNQLLTEMDGMNAKKTVFIIGATNRPDIIDPALLRPGRLDQLIYIPLPDEDSRHQIFKACLRKSPLSKDIDLRALAKYTQGFSGADITEICQRACKYAIRENIEKDIEREKRRSENPEAMEEDVEDEVPEIKAAHFEESMKYARRSVSDADIRKYQAFAQTLQQSRGFGSEFRFSETSTAGTTGTAADPFATSAGGADEDDLYS

SEQ ID NO: 11827 - protein, 480 aa, Solanum tuberosum
IVSQLLTLMDGLKSRAHVIVMGATNRPNSIDPALRRFGRFDREIDIGVPDEVGRLEVLRIHTKNMKLAEDVDLERIGKETHGYVGADLAALCTEAALQCIREKMDVIDLEDESIDAEILNSMAVTNEHFSTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGGSSGDAGGAADRVLNQLLTEMDGMNAKKTVFIIGATNRPDIIDPALLRPGRLDQLIYIPLPDEDSRHQIFKACLRKSPLSKDIDLRALAKYTQGFSGADITEICQRACKYAIRENIEKDIERERRRRDNPEAMEEDVDDEVSEIKPAHFEESMKYARRSVSDADIRKYQAFAQTLQQSRGFGSEFRFAEATTGPTTGTADPFATSAGGADEDDLYS

SEQ ID NO: 11828 - protein, 339 aa, Helianthus annuus
ETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSQGDAGGAADRVLNQLLTEMDGMSAKKTVFIIGATNRPDIIDPALLRPGRLDQLIYIPLPDEESRYSIFKSALRKSPVAKEVDLHALAKYTQGFSGADITEICQRAVKYAIRENIEKDIEREKRRSENPEAMEEDVEDEVPEIKAAHFEESMKFARRSVSDADIRKYQAFAQTLQQSRGFGSEFRFSETSGAAAGAGGSDPFAASAGAADDDDLYN

SEQ ID NO: 11829 - protein, 82 aa, Zinnia violacea
MWKMRCQRLRLHTSKNQRSLREEVLVMLTYASTQAFAQTLQQSRGFGSEFRFSETSGAAAGGGGADPFAASAGAADDDDLYN

SEQ ID NO: 11830 - protein, 114 aa, Brassica rapa
CQRACKYAIRENIEKDIEKEKRRSENPEAMEEDMDEVSEIKAAHFEESMKYARRSVSDADIRKYQAFAQTLQQSRGFGSEFRFETNAGSGATTGVADPFATSAAAAADDDDLYN

SEQ ID NO: 11831 - protein, 438 aa, Brassica oleracea
GVPDEVGRLEVLRIHTKNMKLAEDVDLERISKDTHGYVGSDLAALCTEAALQCIREKMDVIDLEDESIDAEILNSMAVSNEHFHTALGNSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEDSRLSIFKACLRKSPVAKDVDVRALAKYTQGFSGADITEICQRACKYAIRENIEKDIERERRRGENPEAMEEDMVDDEVAEIRAAHFEESMKYARRSVSDADIRKYQAFAQTLQQSRGIGSEFRFDPTAAAGRTTGGAAADPFATSGAAADDDDLYS

SEQ ID NO: 11832 - protein, 170 aa, Brassica napus
RLDQLIYIPLPDEDSRLSIFKACLRKSPVAKDVDVRALAKYTQGFSGADITEICQRACKYAIRENIEKDIERERRRGENPEAMEEDMVDDEVAEIRAAHFEESMKYARRSVSDADIRKYQAFAQTLQQSRGIGSEFRFDPTAAAGRTTGGAAADPFATSGAAADDDDLYS

SEQ ID NO: 11833 - protein, 183 aa, Cichorium intybus
ATNRPDIIDPALLRPGRLDQLIYIPLPDEESRYQIFKSALRKSPVAKDVDLHALAKYTQGFSGADITEICQRACKYAIRENIEKDIEREKRRSENPEAMEEDVDDEVAEIKAAHFEESMKFARRSVSDADIRKYQAFAQTLQQSRGIGSEFRFAEASGGATAAGGGADPFAATGAADEDDLYN

SEQ ID NO: 11834 - protein, 168 aa, Ipomoea nil
GRLDQLIYIPLPDEDSRHQIFKACLRKSPVSKDVDLRALAKYTQGFSGADITEICQRSCKYAIRENIEKDIEREKKRRENPEAMEEDVEDEVAEIKAAHFEESMKYARRSVSDADIRKYQAFAQTLQQSRGFGSEFRFSEASTGGGAATGSDPFATSAGGADEDDLYS

SEQ ID NO: 11835 - protein, 633 aa, Leymus cinereus x Leymus triticoides
EYCIVAPDTEIFCDGEPVTREDEERLDDVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVELEHISRDTHGYVGSDLAALCTEAALQCIREKMDIIDLEDETIDAEILNSMAVTNDHFKTALTTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGGSSGDAGGAADRVLNQLLTEMDGMNAKKTVFIIGATNRPDIIDPALLRPGRLDQLIYIPLPDVESRHQIFKACLRKSPLAKDIDLSALAKYTQGFSGADITEICQRACKYAIRENIEKDIERERRRKDNPEAMEEDEVDEVAEIRAAHFEESMKYARRSVSDADIRKYQAFAQTLQQSRGFGSEFRFADQPAAGAASAAAADPFASAAAAADDDDLYS

SEQ ID NO: 11836 - protein, 399 aa, Pseudoroegneria spicata
VGADLAALCTEAALQCIREKMDIIDLEDETIDAEILNSMAVTNDHFKTALTTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMNAKKTVFIIGATNRPDIIDPALLRPGRLDQLIYIPLPDVESRHQIFKACLRKSPLAKDIDLSALAKYTQGFSGADITEICQRACKYAIRENIEKDIERERRRKDNPEAMEEDEVDEVAEIRAAHFEESMKYARRSVSDADIRKYQAFAQTLQQSRGFGSEFRFPDQPAAGGASAAAADPFASAAAAAEDDDLYS

SEQ ID NO: 11837 - protein, 628 aa, Triticum aestivum
APDTEIFCDGEPVKREDEERLDDVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVELEHISRDTHGYVGADLAALCTEAALQCIREKMDIIDLEDETIDAEILNSMAVTNDHFKTALTTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMNAKKTVFIIGATNRPDIIDPALLRPGRLDQLIYIPLPDVESRHQIFKACLRKSPLAKDIDLSALAKYTQGFSGADITEICQRACKYAIRENIEKDIERERRRKDNPEAMEEDEVDEVAEIRAAHFEESMKYARRSVSDADIRKYQAFAQTLQQSRGFGSEFRFPDQPAAGASSAAAADPFASAAAAADDDDLYS

SEQ ID NO: 11838 - protein, 429 aa, Cucurbita pepo
DEVGRLEVLRIHTKNMKLAEEVDLERIAKDTHGYVGADLAALCTEAALQCIREKMDVIDLEDDSIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEESRLQIFKACLRKSPISKDVELRALAKYTQGFSGADITEICQRACKYAIRENIEKDIEKERRKSENPEAMEEDADDEVAEIKAAHFEESMKYARRSVSDADIRKYQAFAQTLQQSRGFGAEFRFSEQSSGPTASDPFATSAGGADEDDLYN

SEQ ID NO: 11839 - protein, 69 aa, Cucurbita pepo
ELRALAKYTQGFSGADIQKSVSVPANMLSERTSRRTLKRRGGKVRTLRPWRRMPMTKSPRSRLLTLRNP

SEQ ID NO: 11840 - protein, 191 aa, Cucurbita pepo
MSAKKTVFIIGATNRPDIIDPALLRPGRLDQLIYIPLPDEDSRHQIFKACLRKSPISKDVDLRALAKYTQGFSGADITEICQRACKYAIRENIEKDIERERRRRDNPEAMEEDVEDEVAEIKAAHFEESMKFARRSVSDADIRKYQAFAQTLQQSRGFGSEFRFSENTSGTAAADPFAASAGGADDDDLYN

SEQ ID NO: 11841 - protein, 246 aa, Malus domestica
ANVREIFDKARGSAPCVLFFDELDSIATQRGSSVGDAGGAADRVLNQLLTEMDGMTAKKTVFIIGATNRPDIIDPALLRPGRLDQLIYIPLPDEESRFQIFKSCLRKSPVSKDVDIIALAKYTQGFSGADITEICQRACKYAIRENIEKDIEKERRRNENPEAMEEDVEDEIAEIKAAHFEESMKYARRSVSDADIRKYQAFAQTLQQSRGFGTEFRFADNPTGTTAASDPFATAAAGADEDDLYS

SEQ ID NO: 11842 - protein, 228 aa, Avena sativa
SLMSLTRLLPRESSSGDAGGAADRVLNQLLTEMDGMNAKKTVFIIGATNRPDIIDPALLRPGRLDQLIYIPLPDVDSRHQIFKACLRKSPLAKDIDLSALAKYTQGFSGADITEICQRACKYAIRENIEKDIERERRKKDNPEAMEEDEVDEVAEIRAAHFEESMKYARRSVSDADIRKYQAFAQTLQQSRGFGSEFRFADQPAAGAAPAADPFASAAAAADDDDLYS

SEQ ID NO: 11843 - protein, 295 aa, Juglans hindsii x Juglans regia
MSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEESRFQIFKSCLRKSPVSKDVDLRALAKYTQGFSGADITEICQRACKYAIRENIEKDIERERRGKENPEAMEEDIEDEVAEIKAAHFEESMKYARRSVSDADIRKYQAFAQTLQQSRGFGSEFRFADNPSTGAAASDPFATSAAGADDDDLYS

SEQ ID NO: 11844 - protein, 354 aa, Citrus sinensis
  misc_feature (26)..(26): Xaa can be any naturally occurring amino acid
  misc_feature (32)..(32): Xaa can be any naturally occurring amino acid
  misc_feature (34)..(34): Xaa can be any naturally occurring amino acid
  misc_feature (42)..(42): Xaa can be any naturally occurring amino acid
  misc_feature (48)..(48): Xaa can be any naturally occurring amino acid
  misc_feature (50)..(50): Xaa can be any naturally occurring amino acid
  misc_feature (76)..(76): Xaa can be any naturally occurring amino acid
  misc_feature (87)..(87): Xaa can be any naturally occurring amino acid
  misc_feature (89)..(89): Xaa can be any naturally occurring amino acid
  misc_feature (91)..(92): Xaa can be any naturally occurring amino acid
  misc_feature (94)..(94): Xaa can be any naturally occurring amino acid
  misc_feature (112)..(113): Xaa can be any naturally occurring amino acid
  misc_feature (136)..(136): Xaa can be any naturally occurring amino acid
  misc_feature (150)..(151): Xaa can be any naturally occurring amino acid
NHFRTPLGTSNPSALRETVVEVPNVXWEDIGXLXNVKRELQXTVQYPXEXPEKFEKFGMSPSKGVLFYGPPGCGKXLLAKAIANECXAXFXXVXGPELLTMWFGESEANVRXXFDKARQSAPCVLFFDELDSIATXRGSSVGDAGGAADXXLNQLLTEMDGMSAKKTVFIIGATNRPDIIDPALLRPGRLDQLIYIPLPDEDSRHQIFKACLRKSPISKDVDLRALAKYTQGFSGADITEICQRACKYAIRENIEKDIERERRRRDNPEAMDEDAAEDEVAEIKAAHFEESMKFARRSVSDADIRKYQAFAQTLQQSRGIGSEFRFAEAGTGATTGADPFSTSAGGADDDDLYS

SEQ ID NO: 11845 - protein, 154 aa, Eucalyptus grandis
  misc_feature (70)..(70): Xaa can be any naturally occurring amino acid
  misc_feature (133)..(133): Xaa can be any naturally occurring amino acid
RRHQIFKACLRKSPVSKDVDLRALAKYTQGFSGADITEICQRSCKYAIRENIEKDIERERRRSENPEAMXEDVEDEVAEIKAAHFEESMKYARRSVSDADIRKYQAFAQTLQQSRGFGSEFRFADAGAGAGAXTAGSDPFAASAGGADDDDLYS

SEQ ID NO: 11846 - protein, 475 aa, Allium cepa
  misc_feature (44)..(44): Xaa can be any naturally occurring amino acid
  misc_feature (46)..(46): Xaa can be any naturally occurring amino acid
  misc_feature (125)..(125): Xaa can be any naturally occurring amino acid
MDGLKSRAHVIVMGATNRPNSIDPALRRFGRFDREIDIGVPDEXGXLEVLRIHTKNMKLSEDVDLERIAKDTHGYVGADLAALCTEAALQCIREKMDVIDLEDDSIDAEILNSMAVTDEHFKTAXGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAGDRVLNQLLTEMDGMSAKKTVFIIGATNRPDIIDPALLRPGRLDQLIYIPLPDEASRLQIFKACLRKSPIAKEVDLVALAKYTQGFSGADITEICQRACKYAIRENIEKDLEREKRREANPEAMEEDEEDEVAEIKAVHFEESMKYARRSVSDADIRKYQAFAQTLQQSRGFGSEFRFSERSEPTAAATAASDPFSTSAAAAADDDDLYS

SEQ ID NO: 11847 - protein, 322 aa, Tragopogon dubius
RGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSQGDAGGAADRVLNQLLTEMDGMSAKKTVFIIGATNRPDIIDPALLRPGRLDQLIYIPLPDEESRYQIFKSALRKSPVAKDVDLKALAKYTQGFSGADITEICQRACKYAIRENIEKDIEREKRRSENPEAMEEDVDDEVAEIKAAHFEESMKFARRSVSDADIRKYQAFAQTLQQSRGFGSEFRFSETSAATTAATSDPFAAPAGAADEDDL

SEQ ID NO: 11848 - protein, 628 aa, Triticum aestivum
APDTEIFCDGEPVKREDEERLDDVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVELEHISRDTHGYVGADLAALCTEAALQCIREKMDIIDLEDETIDAEILNSMAVTNDHFKTALTTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMNAKKTVFIIGATNRPDIIDPALLRPGRLDQLIYIPLPDVESRHQIFKACLRKSPLAKDIDLSALAKYTQGFSGADITEICQRACKYAIRENIEKDIERERRRKDNPEAMEEDEVDEVAEIRAAHFEESMKYARRSVSDADIRKYQAFAQTLQQSRGFGSEFRFPDQPAAGAASSAAADPFASAAAAAEDDDLYS

SEQ ID NO: 11849 - protein, 628 aa, Triticum aestivum
APDTEIFCDGEPVKREDEERLDDVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVELEHISRDTHGYVGADLAALCTEAALQCIREKMDIIDLEDETIDAEILNSMAVTNDHFKTALTTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMNAKKTVFIIGATNRPDIIDPALLRPGRLDQLIYIPLPDVESRHQIFKACLRKSPLAKDIDLSALAKYTQGFSGADITEICQRACKYAIRENIEKDIERERRRKDNPEAMEEDEVDEVAEIRAAHFEESMKYARRSVSDADIRKYQAFAQTLQQSRGFGSEFRFPDQPAAGAASAAAADPFASAAAAAEDDDLYS

SEQ ID NO: 11850 - protein, 197 aa, Fagopyrum esculentum
MDGMSAKKTVFIIGATNRPDIIDPALLRPGRLDQLIYIPLPDEESRLQIFKANLRKSPIAKDVDLRALAKYTQGFSGADITEICQRACKYAIRENIEKDIEKEKRRSENPEAMEEDMEDEVSEIRAAHFEESMKYARRSVSDADIRKYQAFAQTLQQSRGFGSEFRFSEASGAAGGAAGSQPFAASAGGADEDDLYN

SEQ ID NO: 11851 - protein, 170 aa, Platanus occidentalis
ALLRPGRLDQLIYIPLPDESSRHQNLQGLPEKITCSKDVDIRVLAKHTQGFSGADITEICQRACKYAIRENIEKDIERERRRKENPEAMEEDIEDEVAEIKPAHFEESMKYARRSVSDADIRKYQAFAQTLQQSRGFGSEFRFSEAGAGTTGSDPFAASAGGADEDDLYS

SEQ ID NO: 11852 - protein, 300 aa, Musa acuminata
KFEKFGMSPSKGVLFYGPPGCGKTLLAKAIANECQANFISVKGPELLTMWFGESEANVREIFDKARQSAPCVLFFDELDSIATQRGSHVGDAGGAADRVLNQLLTEMDGMTAKKTVFIIGATNRPDIIDPALLRPGRLDQLIYIPLPDEDSRFQIFKACLRKSPIAKDVDLRALAKFTQGFSGADITEICQRACKYAIRENIEKDIERERRRSENPEAMEEDDADEVAEIKAVHFEESMKFARRSVSDADIRKYQAFAQTLQQSRGFGTEFRFAERAATTGFDPFATPAAGADDDDDLYS

SEQ ID NO: 11853 - protein, 230 aa, Mesembryanthemum crystallinum
RLDFFDELDSIATQRGGSSGDAGGAADRVLNQLLTEMDGMSAKKTVFIIGATNRPDIIDAALLRPGRLDQLIYIPLPDEDSRHQIFKAALRKSPIAKDVDLRVLAKYTQGFSGADITEICQRACKYAIRENIEKDIEKEKRRAENPEAMEEDIDEVAEITAAHFEESMKYARRSVSDADIRKYQSFAQTLQQSRGFGSEFRFANSTSGTTTGSDAFAGPGAGADEDDLYN

SEQ ID NO: 11854 - protein, 538 aa, Cucumis melo
GAFFFCINGPEIMSKLAGESESNLRKAFEEAEKNAPSIIFIDEIDSIAPKREKTNGEVERRIVSQLLTLMDGLKSRAHVIVIGATNRPNSIDPALRRFGRFDREIDIGVPDEVGRLEVLRIHTKNMKLAEEVDLERIAKDTHGYVGADLAALCTEAALQCIREKMDVIDLEDDSIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDQESRLQIFKACLRKSPISKDVELRALAKYTQGFSGADITEICQRACKYAIRENIEKDIEKERRKSENPEAMEEDADDEVAEIRAAHFEESMKYARRSVSDADIRKYQAFAQTLQQSRGFGAEFRFEQNSAPAASDPFATSAGGADEDDLYN

SEQ ID NO: 11855 - protein, 286 aa, Solanum tuberosum
FLWSPRMWENLLGKAIANECQANFISVKGPELLTMWFGESEANVREIFDKARQSAPCVLFFDELDSIATQRGSSSGDAGGAADRVLNQLLTEMDGMNAKKTVFIIGATNRPDIIDPALLRPGRLDQLIYIPLPDEDSRHQIFKACLRKSPLSKDIDLRALAKHTQGFSGADITEICQRACKYAIRENIEKDIEREKRRQENPDSMDEDVDEVPEIKPAHFEESMKYARRSVSDADIRKYQAFAQTLQQSRGFGTEFRFAEASSGGTAAADPFATSNAAADDDDLYS

SEQ ID NO: 11856 - protein, 141 aa, Salvia sclarea
TRPWLSLNVDLRVLAKYTQGFSGADITEICQRACKYAIRENIEKDIEKERRRSDNPEAMEEDVDDEVAEIRAAHFEESMKYARRSVSDADIRKYQSFAQTLQQSRGFGSEFRFADNTSGGTTAADPFAAPAAAADDDDLYS

SEQ ID NO: 11857 - protein, 92 aa, Phalaenopsis aphrodite
MWFGESEANVREIFDKARQSAPCVLFFDELDSIATQRGSSVGDAGGAADRVLNQLLTEMDGMSARKLSSLSALQTGLTSLTLHCSGQAAWTS

SEQ ID NO: 11858 - protein, 421 aa, Pteridium aquilinum
SHKNMKLSDDVDLERIAKDTHGFVGADLAALCTEAALQCIREKMDVIDLEDETIDAEVLNSMAVTNEHFQTALGISNPSALRETVVEVPNVSWEDIGGLDNIKRELQETVQYPVEHPEKFEKFGMSPSKGVLFYGPPGCGKTLLAKAIANECQANFISIKGPELLTMWFGESEANVRDVFDKARQSAPCVLFFDELDSIATQRGSSVGDAGGAADRVLNQLLTEMDGMTAKKTVFIIGATNRPDIIDPALLRPGRLDQLIYIPLPDEGSRLKIFQACLRKSPVAKDVDLSALARYTQGFSGADITEICQRACKYAIRENIEKDIEREKRRSENPEAMEEDEVDEIAEIKAAHFEESMKFARRSVSDADIRKYQAFAQTLQQSRGFGSEFRFPDRPAAAGGNAAGTDAFAPAAAADDDDLYN

SEQ ID NO: 11859 - protein, 324 aa, Trifolium pratense
  misc_feature (306)..(306): Xaa can be any naturally occurring amino acid
GLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPIAKDVDIRALAKYTQGFSGADITEICQRACKYAIRENIEKDIEKERKRSENPEAMEEDVEDEVAEIKAAHFEESMKYARRSVSDADIRKYQAFAQTLQQSRGFGTEFRFADSGTSGAAATXASDPFTSAGGADDDDLYS

SEQ ID NO: 11860 - protein, 656 aa, Coffea canephora
PVRKGDLFLVRGGMRSVEFKVIETDPAEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERIPKDTHGYVGADLAALCTEAALQCIREKMDVIDLEDDSIDAEILHSMAVTNEHFQTALGTSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEDSRHQIFKACLRKSPVSKDVDLRALAKYTQGFSGADITEICQRACKYAIRENIEKDIERERRRRDNPEAMEEDVDDEVAEIKAAHFEESMKFARRSVSDADIRKYQAFAQTLQQSRGFGTEFRFSETSAGVTGADPFAASAGGADEDDLYS

SEQ ID NO: 11861 - protein, 251 aa, Carica papaya
MWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEESRLQIFKACLRKSPVSKDVDLRALAKYTQGFSGADITEICQRACKYAIRENIEKDIEKEKRRSEDPEAMDEDTDEEVAEISAAHFEESMKYARRSVSDADIRKYQAFAQTLQQSRGFGTEFRFSETGAGTTGSDPFSTSAGGAEDEDLY

SEQ ID NO: 11862 - protein, 179 aa, Arachis hypogaea
CIREKMDVIDLEDETIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGMLVVLLTEF

SEQ ID NO: 11863 - protein, 165 aa, Linum usitatissimum
RLDQLIYIPLPDEDSRHQIFKAALRKSPLAKEVDLRALAKYTQGFSGADITEICQRACKYAIRENIEKDIEKERKKEANPEAMEEDEEDEVAEIKAAHFEESMKYARRSVSDADIRKYQAFAQTLQQSRGFGSEFRFSETGPAATAGADPFSTPAGGADEDDLYN

SEQ ID NO: 11864 - protein, 676 aa, Lippia dulcis
GNLFDAYLKPYFLEAYRPIRKGDLFLVRGGMRSVEFKVIETDPAEYCVVAPDTEIFCEGEPIKREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKARAHVIVIGATNRPNSIDPALRRFGRFDREIDIGVPDEVGRLEVLRIHTKNMKLSDEVDLERIAKDTHGYVGADLAALCTEAALQCIREKMDVIDLEDDTIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGSSGDAGGAADRVLNQLLTEMDGMNAKKTVFIIGATNRPDIIDSALLRPGRLDQLIYIPLPDEDSRHQIFKACLRKSPLAKEVDLRALAKYTQGFSGADITEICQRACKYAIRENIEKDIERERRRSENPEAMEEDVEDEVAEIKAAHFEESMKYARRSVSDADIRKYQAFAQTLQQSRGFGSEFRFTENSSATTTAAGTDPFAATTGAADDDDLYS

SEQ ID NO: 11865 - protein, 228 aa, Elaeis guineensis
DELDSIATQRGSSVGDAGGAADRVLNQLLTEMDGMSAKKTVFIIGATNRPDIIDPALLRPGRLDQLIYIPLPDEASRYQIFKACLRKSPVSKDVDLGALAKYTHGFSGADITEICQRACKYAIRENIEKDIERERRRSENPEAMEEDEADEVAEIKPAHFEESMKYARRSVSDADIRKYQAFAQTLQQSRGFGSEFRFSERSETGAGAAGSDPFASTVAGADDDDLYN

SEQ ID NO: 11866 - protein, 202 aa, Cajanus cajan
GAEMDGMPAKKTVFIIGATDRPDIIDPALLRPGRLDQLIYIPLPDEDSRHQIFKACLRKSPVSKDVDLRALAKYTQGFSGADITEICQRACKYAIRENIEKDIERERRRRDNPEAMEEDDVEDDVAEIKAAHFEESMKYARRSVSDADIRKYQAFAQTLQQSRGFGSEFRFADSNSGGGGGTATASDPFASAGGADDDDLYN

SEQ ID NO: 11867 - protein, 131 aa, Capsicum annuum
ALAKYTQGFSGADITEICQRTCKYAIRENIEKDIERERRRRDNPEAMEEDIDDEVSEIKPSHFEESMKYARRSVSDADIRKYQAFAQTLQQSRGFGFEFRFADASTGATTGTAADPFATFAGDADEDDLYS

SEQ ID NO: 11868 - protein, 238 aa, Linum usitatissimum
QSAPCVLFFDELDSIATQRGGSSGDAGGAADRVLNQLLTEMDGMSAKKTVFIIGATNRPDIIDSALLRPGRLDQLIYIPLPDEDSRHQIFKAALRKSPLAKEVDLRALAKYTQGFSGADITEICQRACKYAIRENIEKDIEKERKKEANPEAMEEDEEDEVAEIKAAHFEESMKYARRSVSDADIRKYQAFAQTLQQSRGFGSEFRFSGTGSAGGAAATAADPFSTSAGGADEDDLYN

SEQ ID NO: 11869 - protein, 633 aa, Olea europaea
DPPEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVDLERIAKDTHGYVGADLAALCTEAALQCIREKMDVIDLEDDTIDAEILNSMAVTNEHFQTALGTSNPSALRETVVEVPNVSWEDIGGLENIKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEESRLQIFKVLLEKIPLFPKDVDLTALAKYTQGFSGADITEICQRAVKYAIRENIEKDIEREKRRSENPEAMEEDVEEEVAEIKPAHFEESMKFARRSVSDADIRKYQAFAQTLQQSRGFGTEFRFAENNAGATGSDPFAAPAGAADEDDLYS

SEQ ID NO: 11870 - protein, 157 aa, Arachis hypogaea
PLPDEDSRHQIFKACLRKSPVSKDVDLRALARYTQGFSGADITEICQRACKYAIRENIEKDIERERRKSENPEAMDEDVVDDEVAEIKAAHFEESMKFARRSVSDADIRKYQAFAQTLQQSRGFGSEFRFPETAERTTGSDPFATAGGAADEDDLYS

SEQ ID NO: 11871 - protein, 543 aa, Cirsium arvense
MKRVRSFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVIRIHTKNMKLSDDVDLERIAKETHGYVGADLAALCTEAALQCIREKMDVIDLEDESIDAEILNSMAVSNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEDSRHQIFKAAMRKSPVSKDVDLRALAKYTQGFSGADITEICQRACKYAIRENIEKDIEKERKRSENPDSMDEDEDEVAEIKAAHFEESMKYARRSVSDADIRKYQAFAQTLQQSRGFGSEFRFPEAASGGAAAASDPFAASAGGADDDDLYS

SEQ ID NO: 11872 - protein, 512 aa, Humulus lupulus
FEEAEKNAPSIIFIDEIDSIAPKREKTHGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDESIDAEILNSMAVTNEHFATALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEESRFQIFKSCLRKSPVAKDVDLSALAKYTQGFSGADITEICQRACKYAIRENIEKDIERERRRKDNPEAMEEDVDDEVAEIKAAHFEESMKYARRSVSDADIRKYQAFAQTLQQSRGFGTEFRFPESGSAAAGSDPFATTAGAADEDDLYN

SEQ ID NO: 11873 - protein, 197 aa, Platanus occidentalis
MDGMTAKKTVFIIGATNRPDIIDPALLRPGRLDQLIYIPLPDEASRLQIFKACLRKSPVSRDVDLSALARYTHGFSGADITEICQRACKYAIRENIEKDIEREKKRSENPEAMEEDDVDEVPEIKAAHFEESMKFARRSVSDADIRKYQLFAQTLQQSRGFGSEFRFPDRPDNATGTGASDPFSSAAAAGDDDDLYS

SEQ ID NO: 11874 - protein, 83 aa, Sarracenia psittacina
MEEDMEDEVAEIKAAHFEESMKYARRSVSDADIRKYQAFAQTLQQSRGFGTEFRFSETTSAGATGSDPFAASAGGADEDDLYS

SEQ ID NO: 11875 - protein, 528 aa, Centaurea maculosa
MSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVIRIHTKNMKLSDDVDLERIAKETHGYVGADLAALCTEAALQCIREKMDVIDLEDESIDAEILNSMAVSNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEDSRHQIFKAAMRKSPVSKDVDLRALAKYTQGFSGADITEICQRACKYAIRENIEKDIEKERKRSENPDSMDEDEDEVAEIKAAHFEESMKYARRSVSDADIRKYQAFAQTLQQSRGFGSEFRFPEAASGGAAAASDPFAASAGGADDDDLYS

SEQ ID NO: 11876 - protein, 539 aa, Cichorium intybus
FFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVIRIHTKNMKLSDDVDLEKIAKETHGYVGADLAALCTEAALQCIREKMDVIDLEDDSIDAEILNSMAVSNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEDSRHQIFKAAMRKSPVSKDVDLRALAKYTQGFSGADITEICQRACKYAIRENIEKDIEKERKRSENPDSMDEDEDEVAEIKAAHFEESMKYARRSVSDADIRKYQAFAQTLQQSRGFGSEFRFPEAAGAAASGGASDPFAAAAGGGDDDDLYS

SEQ ID NO: 11877 - protein, 90 aa, Cynara scolymus
EFMAVSNEHFQTALGTSNPSALRETVVEVPNVSWEDIGGLENVKRELQETVQYPVEHPEKFEKFGMSPSKGVLFYGPPGCGKTLLAKAIQ

SEQ ID NO: 11878 - protein, 211 aa, Solanum melongena
GDAGGAADRVLNQLLTEMDGMNAKKTVFIIGATNRPDIIDPALLRPGRLDQLIYIPLPDEDSRYQIFKACLRKSPLSKDIDLRALAKHTQGFSGADITEICQRACKYAIRENIEKDIEREKRRQENPDSMDEDVDEVPEIKPAHFEESMKYARRSVSDADIRKYQAFAQTLQQSRGFGTEFRFAEASGGGTAAADPFTTSTAAADDDDLYS

SEQ ID NO: 11879 - protein, 234 aa, Ipomoea nil
SAPCVLFFDELDSIATQRGSSVGDAGGAADRVLNQLLTEMDGMTAKKTVFIIGATNRPDIIDPALLRPGRLDQLIYIPLPDEDSRHQIFKACLRKSPLSKDIDLRALAKYTHGFSGADITEICQRACKYAIRENIEKDIEREKRRSENPDSMDEDVEDEISEIKPAHFEESMKYARRSVSDADIRKYQAFAQTLQQSRGFGTEFRFAESGSGGASGADPFATSTAGADEDDLYS

SEQ ID NO: 11880 - protein, 496 aa, Pennisetum glaucum
EIDSIAPKREKTHGEVERRIVSQLLTLMDGLKSRAHVIVMGATNRPNSIDPALRRFGRFDREIDIGVPDEVGRLEVLRIHTKNMKLSEDVELEHIAKDTHGYVGADLAALCTEAALQCIREKMDIIDLEDETIDAEILNSMAVSNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDDQSRLQIFKACLRKSPVAKDVDLNALAKYTQGFSGADITEICQRACKYAIRENIEKDIEMERRRRDNPEAMEEDEVDEIAEIRAVHFEESMKYARRSVSDADIRKYQAFAQTLQQSRGFGSEFRFPHQPAAAAADPFAAPAAAADDDDLYS

SEQ ID NO: 11881 - protein, 203 aa, Fagopyrum esculentum
QLLTEMDGMSAKKTVFIIGATNRPDIIDPALLRPGRLDQLIYIPLPDEESRFQIFKANLRKSPIAKDVDIRALAKYTQGFSGADITEICQRACKYAIRENIEKDIEKERKKRDNPDLMEEDDDDEVAEIKAAHFEESMKYARRSVSDADIRKYQAFAQTLQQSRGFGSEFRFADASGGAAASGGVSQPFSSAAGAADEDDLYN

SEQ ID NO: 11882 - protein, 186 aa, Olea europaea
MWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEESRLQIFKACLRKSPLSKDVDLTALAKYTQGFSGADITEICQRAVKYAIRENIEKDIEREKRRSENPEAMEEDVEDEVAEITPFI

SEQ ID NO: 11883 - protein, 142 aa, Capsicum annuum
SPLSKDIDLRALAKFTPGFSGADITEICQRACKYAIRENIEKDIERERRRSENPEAMEEDIEDEVPEITPSHFEESMKYARRSVSDADIRKYQAFAQTLQQSRGFGSEFRFSETSTAGTTGTAAADPFATSTGAADDDDLYS

SEQ ID NO: 11884 - protein, 162 aa, Solanum tuberosum
DQLIYIPLPDEDSRHQIFKACLRKSPLSKDIDLRALAKYTQGFSGADITEICQRACKYAIRENIEKDIEKEKRRAENPDSMDEDADDEISEIKPAHFEESMKYARRSVSDADIRKYQAFAQTLQQSRGFGTEFRFSETSGGAAASDPFTTSNAGADDDDLYS

SEQ ID NO: 11885 - protein, 126 aa, Fagopyrum esculentum
TQGFSGADITEICQRACKYAIRENIEKDIEKEKRRSENPEAMEEDVEDEVSEIRAAHFEESMKYARRSVSDADIRKYQAFAQTLQQSRGFGSEFRFSEASGAAAGATGSQPFAASAGGADEDDLYN

SEQ ID NO: 11886 - protein, 174 aa, Ambrosia trifida
MAVTNEHFSTALGTSNPSALRETVVEVPNVSWDDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVS

SEQ ID NO: 11887 - protein, 562 aa, Cirsium arvense
ILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLSDDVDLERIAKETHGYVGADLAALCTEAALQCIREKMDVIDLEDESIDAEILNSMAVSNEHFQTALGTSNPSALRETVVEVPNCSWDDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEDSRHQIFKAAMRKSPVSKDVDLRALAKYTQGFSGADITEICQRACKYAIRENIEKDIERERKRSENPDSMDEDEDEVAEIKAAHFEESMKYARRSVSDADIRKYQAFAQTLQQSRGFGSEFRFSEATSGGGAAASDPFAASAGGADDDDLYS

SEQ ID NO: 11888 - protein, 462 aa, Euonymus alatus
VIVMGATNRPNSIDPALRRFGRFDREIDIGVPDEVGRLEVLRIHTKNMKLAEDVDLERISKDTHGYVGADLAALCTEAALQCIREKMDVIDLEDETIDAEILNSMAVSNEHFQTALGTSNPSALRGTVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSSGDAGGAADRVLNQLLTEMDGMSAKKTVFIIGATNRPDIIDPALLRPGRLDQLIYIPLPDEESRLQIFKSCLRKSPVSKDVDLRALAKYTSGFSGADITEICQRACKYAIRENIEKDIERERRRSDNPEAMEEDVEDEVSEIKAAHFEESMKYARRSVSDADIRKYQAFAQTLQQSRGFGTEFRFADSSTGGAAASDPFAASAGGADEDDLYS

SEQ ID NO: 11889 - protein, 468 aa, Flaveria ramosissima
MDGLKSRAHVIVIGATNRPNSIDPALRRFGRFDREIDIGVPDEVGRLEVLRIHTKNMKLSEDVDLEKISKETHGYVGADLAALCTEAALQCIREKMDVIDLEDESIDAEILNSMAVTNEHFATALGTSNPSALRETVVEVPNVSWDDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEESRYSIFKAAMRKSPVSKDVDLRALAKYTQGFSGADITEICQRACKYAIRENIEKDIERERKRSENPDSMDEDEDDVAEIKAAHFEESMKYARRSVSDADIRKYQAFAQTLQQSRGFGSEFRFPEATSGGAADPFAASAGGANDDDLYS

SEQ ID NO: 11890 - protein, 411 aa, Flaveria ramosissima
MKLSEDVDLEKISKETHGYVGADLAALCTEAALQCIREKMDVIDLEDESIDAEILNSMAVTNEHFATALGTSNPSALRETVVEVPNVSWDDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEESRYSIFKAAMRKSPVSKDVDLRALAKYTQGFSGADITEICQRACKYAIRENIEKDIERERKRSENPDSMDEDEDDVAEIKAAHFEESMKYARRSVSDADIRKYQAFAQTLQQSRGFGSEFRFPEATSGGAADPFAASAGGANDDDLY

SEQ ID NO: 11891 - protein, 201 aa, Linum usitatissimum
QLLTEMDGMSAKKTVFIIGATNRPDIIDSALLRPGRLDQLIYIPLPDEDSRYQIFKAALRKSPLAKEVDLRALAKYTQGFSGADITEICQRACKYAIRENIEKDIEKERKRDANPEAMEEDEEEIAEIKAAHFEESMKYARRSVSDADIRKYQAFAQTLQQSRGFGSEFRFSETAATGGATAAADPFSTSAGGADEDDLYS

SEQ ID NO: 11892 - protein, 373 aa, Castanea mollissima
DLEDETIDAEVLNSMAVTNEHFQSALGTSNPSALRETVVEVPNVSWEDVGGLDNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGSVGDAGGAADRVLNQLLTEMDGMTAKKTVFIIGATNRPDIIDSALLRPGRLDQLIYIPLPDEASRHQIFKACLRKSPISKEVDLAALARYTQGFSGADITEICQRACKYAIRENIEKDIERERRKRENPEAMEEDDIDEVPEIKAAHFEESMKYARRSVSDADIRKYQLFAQTLQQSRGFGSEFRFPDRTESAAAGASDQFSSATAAGDDDDLYN

SEQ ID NO: 11893 - protein, 140 aa, Actinidia deliciosa
KSPISKDVDLRALAKYTQGFSGADITEICQRACKYAIRENIEKDIERERRRSENPEAMEEDVEDEVAEIKAAHFEESMKYARRSVSDADIRKYQAFAQTLQQSRGFGSEFRFSETSAGATTGSDPFAASAGGADEDDLYS

SEQ ID NO: 11894 - protein, 470 aa, Lolium multiflorum
ARGSRAHVIVMGATNRPNSIDPALRRFGRFDREIDIGVPDEVGRLEVLRIHTKNMKLAEDVELEHISRDTHGYVGADLAALCTEAALQCIREKMDIIDLDDETIDAEILNSMAVTNDHFKTALTTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMNAKKTVFIIGATNRPDIIDPALLRPGRLDQLIYIPLPDVESRLQIFKACLRKSPVAKDVDLDALAKYTQGFSGADITEICQRSCKYAIRENIEKDIERERRKKDNPEAMEEDETDEIAEIRAAHFEESMKYARRSVSDADIRKYQAFAQTLQQSRGFGSEFRFPDAPASGAAAAADPFASSAAAAEDDDLYS

SEQ ID NO: 11895 - protein, 577 aa, Quercus alba
PQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLADDVDLERVSKDTHGYVGADLAALCTEAALQCIREKMDVIDLEDETIDAEVLNSMAVTNEHFQSALGTSNPSALRETVVEVPNVSWEDVGGLDNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGSVGDAGGAADRVLNQLLTEMDGMTAKKTVFIIGATNRPDIIDSALLRPGRLDQLIYIPLPDEASRHQIFKACLRKSPISKEVDLAALARYTQGFSGADITEICQRACKYAIRENIEKDIERERRKRENPEAMEEDDIDEVPEIKAAHFEESMKYARRSVSDADIRKYQLFAQTLQQSRGFGSEFRFPDRTESAAAGASDPFSSATAAGDDDDLYS

SEQ ID NO: 11896 - protein, 77 aa, Carthamus tinctorius
  misc_feature (63)..(63): Xaa can be any naturally occurring amino acid
MDGMSAKKTVFIIGATNRPDIIDPALLRPGRLDQLIYIPLPDEESRYQIFKSALRKRLFLRRXPTSSCQVHPGLQWC

SEQ ID NO: 11897 - protein, 210 aa, Salvia sclarea
GAADRVLNQLLTEMDGMNAKKTVFIIGATNRPDIIDPALLRPGRLDQLIYIPLPDEESRHQIFKSCLRKSPVSKDVDLQALAKYTQGFSGADITEICQRAVKYAIRENIEKDIERERRRGENPEAMEEDVEDEVPEIKPAHFEESMKFARRSVSDADIRKYQAFAQTLQQSRGFGAEFRFAENSAGGASAAAADPFAAGSAAADDDDLYS

SEQ ID NO: 11898 - protein, 102 aa, Cynodon dactylon
GGAADRVLNQLLTEMDGMNAKKTVFIIGATNRPDIIDPALLRPGRLDQLIYIPLPDDQSRLQIFKACLRKSPVAKDVDLNALAKYTQGFSGADITEICQRAC

SEQ ID NO: 11899 - protein, 500 aa, Trigonella foenum-graecum
EIDSIAPKREKTNGEVERRIVSQLLTLMDGLKSRAHVIVMGATNRPNSIDPALRRFGRFDREIDIGVPDEIGRLEVLRIHTKNMKLSDDVDLERISKDTHGYVGADLAALCTEAALQCIREKMDLIDLEDETIDAEILNSMAVTNEHFHTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEGSRHSIFKSCLRKSPIAKDVDLGALARYTQGFSGADITEICQRACKYAIRENIEKDIEQERKRKENPEAMDEDMVDEEVAEIKAAHFEESMKYARRSVSDADIRKYQAFAQTLQQSRGFGSEFRFADTANRTTGSDPFATTTAGGAAEEDDLYS

SEQ ID NO: 11900 - protein, 161 aa, Gerbera hybrid cultivar
DQLIYIPLPDEDSRHQIFKAAMRKSPVSKDVDLRALAKYTQGFSGADITEICQRACKYAIRENIEKDIERERKRSENPDSMDEDEDEVAEIKAAHFEESMKYARRSVSDADIRKYQAFAQTLQQSRGFGSEFRFSEATSGAAASDPFAATAGGADDDDLYS

SEQ ID NO: 11901 - protein, 245 aa, Lactuca sativa
HVREIFDRARGSAPCVLFFDELDSIATQRGSSSGDAGGAADRVLNQLLTEMDGMSAKKTVFIIGATNRPDIIDPALLRPGRLDQLIYIPLPDEDSRHQIFKAAMRKSPVSKDVDLRALAKYTQGFSGADITEICQRACKYAIRENIEKDIERERKRSENPDSMDEDEDELAEIKAAHFEESMKYARRSVSDADIRKYQAFAQTLQQSRGFGSEFRFSEATSGGGAADPFGASAGGAAAEDDDLYS

SEQ ID NO: 11902 - protein, 486 aa, Chelidonium majus
EVERRIVSQLLTLMDGLKSRAHVIVMGATNRPNSIDPALRRFGRFDREIDIGVPDEVGRLEVLRIHTKNMKLAEDVDLEKVSKDTHGYVGADLAALCTEAALQCIREKMDVIDLEDETIDAEILNSMAVTNEHFITALGTSNPSALRETVVEVPNVSWEDIGGLENIKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMTAKKTVFIIGATNRPDIIDPALLRPGRLDQLIYIPLPDEASRLQIFKACLRKSPVARDVDISALARYTQGFSGADITEICQRACKYAIRENIEKDIEKERKKSENPEAMEEDDVDEVPEIKAAHFEESMKFARRSVSDADIRKYQLFAQTLQQSRGFGSEFRFSDRTENTSGTTGVSDPFTAPTDAGDDDLYS

SEQ ID NO: 11903 - protein, 258 aa, Ocimum basilicum
GPELLTMWFGESEANVREIFDKARGSAPCVLFFDELDSIATQRGSSVGDAGGAADRVLNQLLTEMDGMNAKKTVFIIGATNRPDIIDPALLRPGRLDQLIYIPLPDEESRHQIFKACLRKSPLSKDVDLRALAKYTQGFSGADITEICQRACKYAIRENIEKDIERERRSSENPDSMDEDVDDEVSEIKPAHFEESMKFARRSVSDADIRKYQAFAQTLQQSRGFGTEFRFSEQTPGASAADPFASAAGGADDDDLYS

SEQ ID NO: 11904 - protein, 136 aa, Cicer arietinum
DVDLRALAKYTQGFSGADITEICQRSCKYAIRENIEKDIERERRRSENPEAMEEDNEDDDVAEIKAAHFEESMKYARRSVSDADIRKYQAFAQTLQQSRGFGSEFRFADASTGGTATAAADPFASAGGADEDDLYS

SEQ ID NO: 11905 - protein, 195 aa, Zingiber officinale
MDGMNAKKTVFIIGATNRPDIIDPALLRPGRLDQLIYIPLPDEASRYQIFKACLRKSPVAKDVELRALAKYTQGFSGADITEICQRACKYAIRENIEKDIEREKRKSENPEAMEEDDEADDIAEIKAVHFEESMKFARRSVSDADIRKYQAFAQTLQQSRGLGSEFRFADRSEATPGADPFATPTVDADDDDLYS

SEQ ID NO: 11906 - protein, 130 aa, Tropaeolum majus
AKYTQGFSGADITEICQRSCKYAIRENIEKDIEKERRRSENPEAMEEDTEDEVPEIKAGHFEESMKYARKSVSDADIRKYQAFAQTLQQSRGFGSEFRFADAGTGGGGAAAGADPFAASAGGADEDDLYN

SEQ ID NO: 11907 - protein, 673 aa, Capsicum annuum
DLFDAFLKPYFLEAYRPLRKGDNFLVRGGMRSVEFKVIETDPGEYCVVAPDTEIFCEGEPVKREDEERLDYVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEEVDLERISKDTHGYVAADLAALCTEAALQCIREKMDVIDLEDDSIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEDSRHQIFKACLRKSPLSKDIDLRALARHTQGFSGADITEICQRACKYAIRENIEKDIEKEKRRAENPDSMDEDADDEIAEIKPAHFEESMKYARRSVSDADIRKYQAFAQTLQQSRGFGTEFRFSETSGGAAATTDPFATSNTGADDDDLYS

SEQ ID NO: 11908 - protein, 274 aa, Brassica oleracea
QGRNIYDGCCQLDIQFSNLEELQVNYNNDRSRDYTNPNLPSEQKGRLPHPGYGDAGVAYPQMANTSAIAAAFGCGLPPGITGTNDRCTILVSNLNTDSVDEDKLFNLFSLYGNIVRIKLLRNKPDHALVQMGDGFQAELAVHFLKGAMLFGKRLEVNYSKHPNITPGTDSHDYVNSNLNRFNRNAAKNYRYCCSPTKMIHLSTLPQDVTEEEVVNHVQEHGAILNTKVFEMNGKKQALVQFENEEEAAEALVCKHATSLGGSIIRISFSQLQTI

SEQ ID NO: 11909 - protein, 307 aa, Tripterygium wilfordii
IVTFQKSAGFQALIQYQVCQSAVSARTSLQGRNIYDGCCQLDIQFSNLDELQVNYNNDRSRDFTNPNLPSEQKGRSSHPGYSDAGAAFSQMVNAAAIAAAFGGGLPPGITGTNDRCTVLVSNLNSDRIDEDKLFNLFSLYGNIVRIKLLRNKPDHALVQLGDGFQAELAVHFLKGAMLFGKHLEVNFSKHPNITQGADTHEYMNSNLNRFNRNAAKNYRYCCSPTRMIHLSTLPQDITEEEIVSHLEEHGTIANTKLFEMNGKKQALVQFETEEQATEALVCKHATSLGGSIIRISFSQLQEIRENS

SEQ ID NO: 11910 - protein, 331 aa, Flaveria ramosissima
MTEPSKVIHVRNVGHEISEPDLLQLFQPFGVINKLVMLRAKNQALLQMQDVPSAVTAMQFYANVQPSIRGRNVYVQFSSHQELTTMEQNTQGRVDEPNRILLVTIHHMLYPITVEVLHQVFSPHGYVEKIVTFQKSAGFQALIQFQLRQSAVAARNSLQGRNIYDGCCQLDIQFSNLEELQVNYNNERSRDFTNPSLPSEQKGRSSQPGYGDAGVGYPQMNNAAAIAAAFGGGLPPGISGTNDRCTVLASNLNPDRIDEDKLFNLFSLYGNIVRIKLLRNKPDHALVQMGDGFQAELAVHFLKGATLFGKRLEVNFSKHPNITMGAETHEY

SEQ ID NO: 11911 - protein, 385 aa, Tabernaemontana elegans
MQDIPSAVNALQFYTNVQPSIRGRNVYIQFSSHQELTTMDQSTQGRADEPNRILLVTIHHMLYPITVEVLHQVFSPHGFVEKIVTFQKSAGFQALIQYQLQQSAVSARNSLQGRNIYDGCCQLDIQFSNLDELQVNYNNERSRDFTNPSLPSEQKGRSSHPGYGDMGVGYPQMANAAAIAAAFGGGLPPGISGTNDRCTVLVSNLNSDRIDEDKLFNLFSIYGNIVRIKLLRNKPDHALVQMGDGFQAELAVHFLKGAKLFGKRLEVNFSKHPNITTGADTHEYSNSNLNRFNRNAAKNYRYCCSPTKMIHISTLPQDVTEEEIIAHLEEHGTIVNSKLFEMNGKKQALVLFENEEQATEALVCKHATSLGGSTIRISFSQLQTI

SEQ ID NO: 11912 - protein, 213 aa, Parthenium argentatum
NTQGRVDEEPNRILLVTIHHMLYPITVEVLHQVFSPHGYVEKIVTFQKSAGFQALIQFQLRQSAVAARNSLQGRNIYDGCCQLDIQFSNLEELQVNYNNERSRDFTNPSLPSEQKGRPSQPGYGDAGVGYPQMNNAAAIAAAFGGGLPPGISGTNDRCTVLASNLNPDRIDEDKLFNLFSLYGNIVRIKLLRNKPDHALVQMGDGFQAELAVH

SEQ ID NO: 11913 - protein, 329 aa, Ambrosia trifida
MTEPSKVIHVRNVGHEISEPDLLQLFQPFGVINKLVMLRAKNQALLQLQDVPSAVSAMQFYANVQPSIRGRNVYVQFSSHQELTTMEQSTQGRVDEEPNRILLVTIHHMLYPITVEVLHQVFSPHGYVEKIVTFQKSAGFQALIQFQLRQSAVAARNSLQGRNIYDGCCQLDIQFSNLEELQVNYNNERSRDFTNPSLPSEQKGRPSQPGYGDAGAGYPQMNNAAAIAAAFGGGLPPGISGTNDRCTLLASNLNPDRIDEDKLFNLFSLYGNIVRIKLLRNKPDHALVQMGDGFQAELAVHFLKGATLFGKRLEVNFSKHPNITMGAET

SEQ ID NO: 11914 - protein, 364 aa, Cynara scolymus
MTEPSKVIHVRNVGHEISEPDLLQLFQPFGVINKLVMLRAKNQALLQMQDVPSAVNAMQFYANVQPSIRGRNVYVQFSSHQELTTMEQNTQGRGDEPNRILLVTIHHMLYPITVEVLHQVFSPHGYVEKVVTFQKSAGFQALIQFQSRQSAVSARNALQGRNIYDGCCQLDIQFSNLEELQVNYNNERSRDFTNPSLPSEQKGRPLTPGYGDAGVGFPQMNNAAAIAAAFGGGLPPGISGTNDRCTLLASNLNPDRIDEDKLFNLFSLYGNIVRIKLLRNKPDHALVQMGDGFQAELAVHFLKGATLFEKRLEVNFSKHPNITMGAETHEYLNSNLNRFNRNAAKNTRYCAHHPDDPLVDLPQT

SEQ ID NO: 11915 - protein, 377 aa, Cichorium intybus
MQFYANVQPSIRGRNVYVQFSSHQELTTMEQNTQGRGDEEPNRILLVTIHHMLYPITVEVLHQVFSPHGYVEKIVTFQKSAGFQALIQFQSRQSAVSARNSLQGRNIYDGCCQLDIQFSNLEELQVNYNNERSRDFTNPSLPSEQKGRPSSQPGYGDAGVGFPQMNNAAAIAAAFGGGLPPGISGTNDRCTVLASNLNPDRIDEDKLFNLFSLYGNIVRIKLLRNKPDHALVQMGDGFQAELAVHFLKGATLFGKRLEVNFSKHPNITMGAETHEYLNSNLNRFNRNAAKNYRYCCSPTKMIHLSTLPQDITEEEIVSHLEEHGSIVNSKLFEMNAKKQALVMFENEEQATEALVCKHASSLGDSMIRISFSQLQTI

SEQ ID NO: 11916 - protein, 276 aa, Heritiera littoralis
IYDGCCQLDIQYSNLDELQVHYNNDRSRDFTNPNLPTEQKGRSTQHPGYGDVGVGFPQMANAAAIAAAFGGGLPPGISGTNDRCTLLVSNLNSDRIDEDKLFNLFSLYGNIVRIKLLRNKPDHALVQMGDGFQAELAVHFLKGAVLFGKRLEVNFSKHPNITQGADTHEYVNSNLNRFNRNAAKNYRYCCSPTKMIHLSTLPQDVNEEEIVNHLAEHGTIVNTKLFEMNGKKQALVMFESEEQATEALVSKHASSLGGSIIRISFSQLQTIRENAQ

SEQ ID NO: 11917 - protein, 360 aa, Amsonia hubrichtii
VYIQFSSHQELTTMDQNTQGRGDEPNRILLVTIHHMLYPITVEVLHQVFSPHGFVEKIVTFQKSAGFQALIQYQLQQSAVSARNSLQGRNIYDGCCQLDIQFSNLDELQVNYNNERSRDFTNPSLPSEQKGRSSHSGYGEMGVGYPQMANAAAIAAAFGGGLPPGISGTNDRCTVLVSNLNPDRIDEDKLFNLFSIYGNIVRIKLLRNKPDHALVQMGDGFQAELAVHFLKGAKLFGKRLEVNFSKHPNITTGADTHEYSNSNLNRFNRNAAKNYRYCCSPTKMIHISTLPQDVTEEEIIAHLEEHGTIVNSKLFEMNGKKQALVLFENEEQATEALVCKHATSLGGSTIRISFSQLQTI

SEQ ID NO: 11918 - protein, 213 aa, Senecio madagascariensis
MNNAAAIAAAFGGGLPPGISGTNDRCTILASNLNPDRIDEDKLFNLFSLYGNIVRIKLLRNKPDHALVQMGDGFQAELAVHFLKGATLFGKRLEVNFSKHPNITMGAETHEYLNSNLNRFNRNAAKNYRYCCSPTKMIHLSSLPQDATEEEIVSHLEEHGNIVNSKVFEMNGKKQALVLFENEEQATETIVCKHATTLDDSMIRISFSQLQTI

SEQ ID NO: 11919 - protein, 174 aa, Cleome gynandra
SAGFQALVQYQLQQCAVSARTSLQGRNIYDGCCQLDIQFSNLEELQVNYNNERSRDYTNPNLSSEQKGRSSHQPAYGDVGVAYPQMSNAAAIASVFGGSLPPGVTGTNDRCTVLVSNLNPERIDEDKLFNLFSLYGNIIRIKLLRNKPDHALVQMGDGFQAELAVHFLKGAWLF

SEQ ID NO: 11920 - protein, 315 aa, Brassica juncea
ELAERGFVPGMSKEEQDNLAKSETLAIRISNIANMVLFAAKVYASVTSGSLAIVASTLDSLLDLLSGFILWFTAFSMQTPNPYQYPIGKKRMQPLGILVFASVMATLGLQIILESLRTMVSSHKEFSLTKEQESWVVGIMLSVTLVKLLLVLYCRSFSNEIVKAYAQDHFFDVITNIIGLIAVILANYIDNWMDPVGAIILALYTIRTWSMTVLENVNSLVGKSATPEYLQKLTYLCWNHHREIRHIDTVRAYTFGSHYFVEVDIVLPADMPLQVAHDIGEALQEKLEQLQEIERAFVHLDYEYTHKPEHARSHC

SEQ ID NO: 11921 - protein, 315 aa, Brassica juncea
ELAERGFVPGMSKEEQDNLAKSETLAIRISNIANMVLFAAKVYASVTSGSLAIVASTLDSLLDLLSGFILWFTAFSMQTPNPYQYPIGKKRMQPLGILVFASVMATLGLQIILESLRTMVSSQKEFSLTKEQESWVVGIMLSVTLVKLLLVLYCRSFSNEIVKAYAQDHFFDVITNIIGLIAVILANYFDNWMDPVGAIILALYTIRTWSMTVLENVNSLVGKSATPEYLQKLTYLCWNHHREIRHIDTVRAYTFGSHYFVEVDIVLPADMPLQVAHDIGEALQEKLEQLQEIERAFVHLDYEYTHKPEHASSHC

SEQ ID NO: 11922 - protein, 398 aa, Ipomoea nil
MVETVSLDVDRGGSEEHLLLAAEASKTDCSWRLNFDGFELSAEHKEKPPRGLHDCLGVLREEDIVAEYYQQQVEMLEGFNEMDALADRGFVPGMSKEEREKLAKSETAAIRISNVANMVLFAAKVYASIQSGSLAIIASTLDSLLDLLSGFILWFTAFSMQTPNPYQYPIGKKRMQPLGILVFASVMATLGLQIILESVRTLISEEADFNLTNEQERWVVGIMIFVTLVKLVLVFYCRSFTNEIVKAYAQDHFFDVVTNIIGLVAALLANYITGWIDPVGAIILALYTIRTWSMTVLENVNSLVGKSATPEFLQKLTYLCWNHHKSIRHIDTVRAYTFGSHYFVEVDIVLPADMPLQEAHDIGESLQEKLELLQEIERAFVHLDYEYSHKPEHAQAHQ

SEQ ID NO: 11923 - protein, 398 aa, Nicotiana benthamiana
MLEVVPLGGDHGGGGEEELLLLETNNADRSWRLNFDELRLSSESKEKPPRGLHDCLGVLSQEDNIAEYYQQQVEMLEGFNEMDALTDRGFVPGMSKEEREKTAKNETFAIRISNVANMVLFAAKVYASVKSGSLAIIASTLDSLLDLLSGFILWFTAFSMQTPNPYQYPIGKKRMQPLGILVFASVMATLGLQIILESMRTLISDESDFNLTKEQERWVVGIMVFVTLVKLVLMLYCRSFTNEIVKAYAQDHFFDVITNIIGLIAALLANYITDWIDPVGAMILALYTIRTWSMTVLENVNSLVGKSAAPEYLQKLTYLCWNHHKAIRHIDTVRAYTFGSHYFVEVDIVLPADMPLQEAHDIGESLQEKLELLPEIERAFVHLDYEYSHKPEHAQAYQ

SEQ ID NO: 11924 - protein, 260 aa, Nicotiana tabacum
STLDSLLDLLSGFILWFTAFSMQTPNPYQYPIGKKRMQPLGILVFASVMATLGLQIILESMRTLISDESDFNLTKEQERWVVGIMVFVTLVKLVLMLYCRSFTNEIVKAYAQDHFFDVITNIIGLIAALLANYITDWIDPVGAMILALYTIRTWSMTVLENVNSLVGKSAAPEYLQKLTYLCWNHHKAIRHIDTVRAYTFGSHYFVEVDIVLPADMPLQEAHDIGESLQEKLELLPEIERAFVHLDYEYSHKPEHAQAYQ

SEQ ID NO: 11925 - protein, 68 aa, Ambrosia trifida
MVEKGSFLLTEMSTRGGGGGGGADVSWRLNFDGFQFTSEHKEKPPRGLHDCLGVLARKIMWQNITSSR

SEQ ID NO: 11926 - protein, 282 aa, Ambrosia trifida
MVLFAAKVYASVRSGSLAIIASTLDSLLDLLSGFILWFTAFSMQTPNPYQYPIGKRRMQPLGILVFASVMATLGLQIILESVRTLASDEKDFNLTKEQEQWVVGIMLSVTFVKLALCIYCRSFTNEIVKAYAQDHFFDVVTNLIGLIAVLLANYISDWMDPVGAIILALYTIRTWSLTVLENVNSLVGKSAAPEYLQKLTYLCWNHHKAIRHIDTVRAYTFGSHYFVEVDIVLPSDMPLQTAHDIGESLQEKLELLPEIERAFVHLDYEYSHKPEHAQTHHH

SEQ ID NO: 11927 - protein, 240 aa, Ambrosia trifida
MQTPNPYQYPIGKRRMQPLGILVFASVMATLGLQIILESVRTLASNEKDFNLTKEQEQWVVGIMLSVTFVKLALCIYCRSFTNEIVKAYAQDHFFDVVTNLIGLIAVLLANYISDWMDPVGAIILALYTIRTWSLTVLENVNSLVGKSAAPEYLQKLTYLCWNHHKAIRHIDTVRAYTFGSHYFVEVDIVLPSDMPLQTAHDIGESLQEKLELLPEIERAFVHLDYEYSHKPEHAQTHHH

SEQ ID NO: 11928 - protein, 130 aa, Linum usitatissimum
LLANYVDDWMDPVGAIILALYTIRTWSMTVLENVHSLVGKSATPDYLQKLTYLSWNHHKAIRHIDTVRAYTFGSHYFVEVDIVLPADMPLQEAHDIGESLQEKLELLPEIERAFVHLDYEYSHKPEHAQS

SEQ ID NO: 11929 - protein, 145 aa, Linum usitatissimum
HFFDVVTNFIGLFAALLANYVDDWMDPVGAIILALYTIRTWSMTVLENVHSLVGKSATPDYLQKLTYLSWNHHKAIRHIDTVRAYTFGSHYFVEVDIVLPADMPLQEAHDIGESLQEKLELLPEIERAFVHLDYEYSHKPEHAQS

SEQ ID NO: 11930 - protein, 301 aa, Helianthus annuus
EKASLARKETLAIRISNVANMVLFVAKVYASVRSGSLAIIASTLDSLLDLLSGFILWFTACSMQTPNPYQYPIGKRRMQPLGILVFASVMATLGLQIILESVRTLASDEKDFSLTKEQEQWVVGIMLSVTFVKLALCIYCRSFTNEIVKAYAQDHFFDVVTNLIGLIAVLLANYISDWMDPVGAIILALYTIRTWSLTVLENVNSLVGKSAAPEYLQKLTYLCWNHHKAIRHIDTVRAYTFGSHYFVEVDIVLPSDMPLQTAHDIGESLQEKLELLPEIERAFVHLDYEYSHKPEHAQTHH

SEQ ID NO: 11931 - protein, 405 aa, Tragopogon dubius
MVEPMSGDGDHGGSEEEFLLTDVNLGGGGGGGCDVSWRLNFDGFEFSPEHTEKPPRGLHDCLGVLGSEDNVAEYYQQQVETLEGFTEMDALAERGFVPRLSEEEKACLARRETLAIRISNIANMVLFVAKVYASIRSGSLAIIASTLDSLLDLLSGFILWFTAFSMQTPNPYQYPIGKRRMQPLGILVFASVMATLGLQIILESVRTLASDEKDFSLSTEQEGWVVGIMLSVTLVKLVLCIYCRSFTNEIVKAYAQDHFFDVVTNLIGLIAVLLANYISDWMDPVGAIILALYTIRTWSLTVLENVNSLVGKSATPEYLQKLTYLCWNHHKSIRHIDTVRAYTFGSHYFVEVDIVLPSDMPLQIAHDIGESLQEKLELLPEIERAFVHLDYEYSHKPEHAHTHHH

SEQ ID NO: 11932 - protein, 406 aa, Arnica chamissonis
MVEPMSGDGDHGGSEDEFLLTEMNIGGGGGSTGGCDVSWRLNFDGFQLSSEHKEKPPRGLHDCLGVLVPEDNVADYYQQQVETLEGFTQMDALAERGFVPRLSAEEKASLARKETLAIRISNVANMVLFVAKVYASVRSGSLAIIASTLDSLLDLLSGFILWFTAFSMQTPNPYQYPIGKRRMQPLGILVFASVMATLGLQIILESVRTLASDEKDFSLTKEQEQWVVGIMLSVTFVKLALCIYCRSFTNEIVKAYAQDHFFDVVTNLIGLIAVLLANYISDWMDPVGAIILALYTIRTWSLTVLENVNSLVGKSAAPEYLQKLTYLCWNHHKAIKHIDTVRAYTFGSHYFVEVDIVLPSDMPLQTAHDIGESLQEKLELLPEIERAFVHLDYEYSHKPEHAQTHH

SEQ ID NO: 11933 - protein, 418 aa, Flaveria ramosissima
MVETMSGGGDHGGSEEEFLLTEINIGGGGGGGGRGGGPGGCDVSWRLNFDGFQLSSEHIEKPPRGLHDCLGVLVTEDNVAEYYQQQVETLEGFTQMDTLAERGFLPRLSAEEKACLARKETLAIRVSNVANMVLFVAKVYASVRSGSLAIIASTLDSLLDLLSGFILWFTAFSMQTPNPYQYPIGKGRMQPLGILVFASVMATLGLQIILESVRTLVSDEKDFSLTKEQEQWVVCIMLSVTCVKFALCIYCRSFTNEIVKAYAQDHLFDVVTNLIGLIAVLLANYISYWMDPVGAIILALYTIRTWSLTVLENVNSLVGKSAAPEYLQKLTYLCWNHHKAIRHIDTVRAYTFGSHYFVEVDIVLPSDMPLQTAHDIGESLQEKLELLPEIERAFVTLIMSTHTNLSTHKHIIKTNNNL

SEQ ID NO: 11934 - protein, 235 aa, Trigonella foenum-graecum
NPYQYPIGKKRMQPLGILVFASVMATLGLQIILESARTLIYTDNTFSLTREQERWVVGIMLSVTLVKFMLMIYCRSFTNEIVKAYAQDHFFDVITNVIGLIAALLANYFDDWMDPVGAIILALYTIRTWSMTVLENVNSLVGRSAAPEYLQKLTYLCWNHHKAVRHIDTVRAYTFGSHYFVEVDIVLPADMPLQEAHDIGESLQEKLELLPEIERAFVHLDYEFSHKPEHAQAHS

SEQ ID NO: 11935 - protein, 137 aa, Malus domestica
LGCCAPLLIILMIGWTPVGAIILALYTIRTWSLTVLENVNSLVGRSAAPEYLQKLTYLCWNHHKAIRHIDTVRAYTFGSHYFVEVDIVLPADMPLQEAHDIGETLQEKLELLPEIERAFVHLDYEFSHKPEHAQSHS

SEQ ID NO: 11936 - protein, 191 aa, Eucalyptus grandis
  misc_feature (102)..(102): Xaa can be any naturally occurring amino acid
  misc_feature (184)..(184): Xaa can be any naturally occurring amino acid
  misc_feature (186)..(186): Xaa can be any naturally occurring amino acid
GLGLTKELEQWLVGIMLSVTLVKFLLVLYCRTFTNEIVKAFAQDHFFDVITNVIGLIAALLANYVVTWMDPVGAIILALYTIRTWSMTVLENVNSLVGKSAXPEYLQKLTYLCWNHHKAVRHIDTVRAYTFGSHYFVEVDIVLPADMPLQLAHDIGESLQEKLELLPEIERAFVHLDYEYSHKXEXAQAHS

SEQ ID NO: 11937 - protein, 396 aa, Arachis hypogaea
MVETLEVQSDEQRSLLSPDSNNGDRSWRLNFEGFQMSSPHADKQVKPSRGIHDCYGVLGQEDNIAEYYQQQVEVLEGFNEMDALAERGFIPGMSKEEQEKLARSETFAIRLSNVANMVLFIAKVYASIRSGSLAIIASTLDSLLDLLSGFILWFTAFSMQTPNPYQYPIGKKRMQPLGILVFASVMATLGLQIILESMRTLISDENAFSLTREQEQWIVGIMLSVTLVKFLLMIYCRSFTNEIVKAYAQDHFFDVITNVIGLIAALLANYVDDWMDPVGAIILALYTIRTWSLTVLENVNSLVGRSAAPEYLQKLTYLCWNHHKAVRHIDTVRAYTFGSHYFVEVDIVLPSDMPLQEAHDIGESLQEKLELLPEIERAFVHLDYEYSHKPEHAQSH

SEQ ID NO: 11938 - protein, 401 aa, Unknown
  Sequence found in Organisms: Solanum tuberosum, Solanum phureja
MLELVPPDGDHGGECGGEEQLLLMEANNVDRSWRLNFDELRLSSENKEKPHPHGLHDCLGVLSQEDNIAVYYQQQVEMLVGFNEMDALADRGFVPGMSKEEREKLARSETTAIRISNIANMVLFAAKVYASVKSGSLAIIASTLDSLLDLLSGFILWFTAFSMQTPNPYQYPIGKKRMQPLGILVFASVMATLGLQIILESMRTLISDESDFSLTKEQERWVIGIMVFVTLVKLVLVLYCRSFTNEIVKAYAQDHFFDVVTNIIGLVAALLANYFSGWIDPVGAMILALYTIRTWSMTVLENVNSLIGKAAAPEYLQKLTYLCWNHHKAIKHIDTVRAYTFGSHYFVEVDIVLPADMPLQEAHDIGESLQEKLELLPEIERAFVHLDYEYSHKPEHAQAYL

SEQ ID NO: 11939 - protein, 86 aa, Tragopogon dubius
MVESVTGEGDHAGEEELLLLGGGGGGGGCDGSWRLNFDGFQFSSEHKEKPPRRLHDCLGVSGPEDNVAEYYQQQVEMLEGLPKWMP

SEQ ID NO: 11940 - protein, 405 aa, Cirsium arvense
MVEPLSVEGDHGGEEEELLLLKDVKITGGGHCDGSWRLNFDGFQFSSDHNNKEKPSRRLHDCLGVSGPEDIVAEYYQQQVEMLEGFTQMDALAERGFLPRMSAEEKESLARRETLAIRISNVANMFLFAAKVYASVRSGSLAIIASTLDSLLDLLSGFILWFTAFSMQIPNPYQYPIGKRRMQPLGILVFASVMATLGLQIILESIRTLASNENAFNLTKEQEMWVVGIMLSVTMVKLVLCIYCRSFTNEIVKAYAQDHFFDVVTNLIGLIAVLLANYISDWMDPVGAIILALYTIRTWSLTVLENVNSLVGKSAAPEFLQKLTYLCWNHHKAIRHIDTVRAYTFGSHYFVEVDIVLPSTMPLQIAHDIGESLQEKLELLPEIERAFVHLDYEYSHKPEHAHAHL

SEQ ID NO: 11941 - protein, 121 aa, Cirsium arvense
TREQEQWVIGIMLSVTLVKLVLCIYCRSFTNEIVKAYAQDHFFDVVTNLIGLIAVLLANYISDWMDPGFAFVGTAGALHYPDMVNDSVGERKLASWKISCTRISTEADVPMLEPPQVYKAH

SEQ ID NO: 11942 - protein, 340 aa, Cucurbita pepo
MSPEDYVAEYYQQQVEMLEGFNEMDALADRGYVPGMSKEEREKLAKSETFAIRLSNVANLVLFAAKVYASIRSGSLAIIASTLDSLLDLLSGFILWFTAFSMQTPNPYQYPIGKKRMQPLGILVFASVMATLGLQIILESIRTLLLGDSVFNLTKEQERWVMGIMLSVTLVKLLLMLYCRAFTNEIIKAYAQDHFFDVVTNAIGLVAALLANYIAGWIDPLGAIILALYTIRTWSMTVLENVNSLVGRSAAPEYLQKLTYLCWNHHKAIKHIDTVRAYTFGSHYFVEVDIVLPGDMPLEEAHDIGESLQEKLELLPEIERAFVHLDYEYKHKPEHAQAHF

SEQ ID NO: 11943 - protein, 267 aa, Flaveria ramosissima
SGGGDHGGSEEEFLLTELNIGGGGGGGRRGGPGGCDVSWRLNFDGFQLSSEHIEKPPRGLHDCLGVLVTEDNVAEYYQQQVETLEGFTQMDTLAERGFLPRLSAEEKACLARKETLAIRVSNVANMVLFVAKVYASVRSGSLAIIASTLDSLLDLLSGFILWFTAFSMQTPNPYQYPIGKGRMQPLGILVFASVMATLGLQIILESVRTLASDEKDFNLTKEQEQWVVGIMLSVTCVKFVLCIYCRSFTNEIVKAYAQDHLLMLLLI

SEQ ID NO: 11944 - protein, 85 aa, Fraxinus spp
DLRVNYSIFLKCKCKVTGNGGTCKYRRLRRATLLPETRNGDHSWRLNFDGFHLSTEHKKNLLVGSMTILGFWVQKIMLQSIISNR

SEQ ID NO: 11945 - protein, 191 aa, Valeriana officinalis
KKFSLSRDQERWVVGIMLSVTVVKLLLCLYCRSFKNEIVKAYAQDQFFDVITISSAYAVLLANYFNNWMDPVGAIILALYTIRTWSLTVLENVNSLVGRSAAPEYLQKLTYLCWNHHKAIRHIDTVRAYTFGSHYFVEVDIVLPATMPLQEAHDIGESLQEKLEQLPEIERAFVHLDYEFSHKPEHAQSHL

SEQ ID NO: 11946 - protein, 304 aa, Castanea mollissima
SKEEKDKLARSETFAIRISNIANMFLFAAKVYASVRSGSLAIIASTLDSFLDLLSGFILWFTAFSMKTPNPYQYPIGKRRMQPLGILVFASVMATLGLQIILESIRTLLSDENDFSLTKEQEEWVVGIMLSVTLVKLGLVLYCRSFTNEIVKAYAQDHFFDVITNVIGLIAALLANYITDWMDPVGAIILALYTIRTWSMTVLENVNSLVGKSAAPEYLQKLTYLCWNHDEAIKHIDTVRAYTFGSHYFVEVDIVLPAGMPLQEAHDIGESLQEKLEHLPEIERAFVHLDYEYSHKPEHAQSHH

SEQ ID NO: 11947 - protein, 401 aa, Solanum melongena
MLELVPHDGDHGAECGGEEQLLLMETNNVDRSWRLNFDELRLSSENKEKPPPHGLHDCLGVLNQEDNIAMYYQQQVEMLEGFNEMDALADRGFVPGMSKEEREKLARSETTAIRISNIANMVLFAAKVYASVKSGSLAIIASTLDSLLDLLSGFILWFTAFSMQTPNPYQYPIGKKRMQPLGILVFASVMATLGLQIILESIRTLISDESDFSLTKEQERWVVGIMVFVTLVKLVLVLYCRSFTNEIVKAYAQDHFFDVITNIIGLVAALLANYFSDWIDPVGAMILALYTIRTWSMTVLENVNSLVGKAAAPEYLQKLTYPCWNHHRAIKHIDTVRAYTFGSHYFVEVDIVLPADMPLQEAHDIGESLQEKLELLPEIERAFVHLDYEYSHKPEHAQAYL

SEQ ID NO: 11948 - protein, 234 aa, Amorphophallus konjac
LSIPDWEKTNAASGNLSFASVMATLGLQIILESVRSLISDEDEFSLTKEQELWVIDIMLSVTLVKLALVLYCRSFTNEIVKAYAQDHFFDVVTNIIGLVAALLANYVKDWIDPVGAIILALYTIRTWSMTVLENVNSLVGRTAAPEYLQKLTYLCWNHHKAVRHIDTVRAYTFGSHYFVEVDIVLPSEMPLREAHDIGEALQEKLELLPEIERAFVHLDYEFTHKPEHAQAHDA

SEQ ID NO: 11949 - protein, 404 aa, Cirsium arvense
MVEPMSGDADHGGAEEESLLTDVNIGGGGTGGCDGSWRLNFDGFQLSSEHKEKPPRSLHDCLGVLVPEDNVAEYYQQQVEMLEGFTEMDTLAQRGFVPRLSEEEKATLARRETLAIRISNVANMVLFIAKVYASVRSGSLAIIASTLDSLLDLLSGFILWFTAFSMQTQNPYQYPIGKRRMQPLGILVFASVMATLGLQIILESVRTLASAEKDFNLTKEQEQWVVGIMLSVTLVKLVLCIYCRSFTNEIVKAYAQDHFFDVVTNLIGLIAVLLANYISDWMDPVGAIILALYTIRTWSLTVLENVNSLVGKSAAPEYLQKLTYLCWNHHKSIRHIDTVRAYTFGSHYFVEVDIVLPSEMPLQIAHDIGESLQEKLELLPEIERAFVHLDYEFSHKPEHAQTHH

SEQ ID NO: 11950 - protein, 404 aa, Silene vulgaris
LDLNHDDNDAADQHLLSASSSVDDNVVLTTGDRSWQLNFDGYQRSPDHNDNIPTTTKFHTCLGLSGQEDDVAEYYQQQVEMLEGFSEMDALAERGFVPGITKEEQEKLAKSETFAIRISNVANMVLFVAKVYASIQSGSLAIIASTLDSLLDLLSGFILWFTAFSMSTPNPYQYPIGKKRMQPLGILVFASVMATLGLQIILESVRQLLSDESDFSLNGVQESWLIGIMLSVTLVKLLLVLYCRSFTNEIVKAYAQDHFFDVITNIIGLIAALLANYVSDWMDPIGAIILAVYTIRTWSMTVLENVNSLVGKSATPDFLQKLTYLCWNHHKAIKHIDTVRAYTFGSHYFVEVDIVLPSTMPLQEAHDIGESLQEKLELLPDIERAFVHLDYEYTHKPEHAQAHL

SEQ ID NO: 11951 - protein, 394 aa, Aristolochia fimbriata
MMNPERAAAGDSEDSELLLPESGNGERSWRLNFDGFQRTEHKEKPRGLHDCLGVLGAEDVVAEYYQQQGEMLEGFTEMDTLADRGFLPGMSKEELERTAKSERMAIRISNIANMVLFAAKVYASYRSGSLAIIASTLDSLLDLLSGFILWFTAFSMQTPNPYQYPIGKKRMQPLGILVFASVMATLGLQIILESVRTLFSDDNEFELSKEQEKWVIDIMLSVTLVKLALVVYCRSFTNEIVKAYAQDHFFDVVTNLIGLIAALLAKYIKDWIDPVGAIILALYTIRTWSATVLENVNSLVGRAATPEYLQKLTYLCWNHHKAIRHIDTVRAYTFGSHYFVEVDIVLPSEMPLREAHDIGEALQEKLEQLPEIERAFVHLDYEYTHKPEHAQAHL

SEQ ID NO: 11952 - protein, 399 aa, Vitis vinifera
MVEPVILDGDLDGSEELLLRPTPKNGDRSWRLNFDGFQLSEHKEKKPPRSLHDCLGVLAPGPEDDVAEYYQQQVEMLEGFNEMDALAEHGYIPRMTEEEREKLARSETTAIRISNIANMILFAAKVYASVMSGSLAIIASTLDSLLDLLSGFILWFTAFSMQTPNPYQYPIGKKRMQPLGILVFASVMATLGLQIILESVRTLSSDEAEFDLTREQEQWVIGIMLSVTLTKLILAVYCRAFTNEIVKAYAQDHFFDVITNIIGLIAVLLANYISDWMDPVGAIILALYTIRTWTLTVLENVNSLVGRTAAPEYLQKLTYLCWNHHKAIRHIDTVRAYTFGSHYFVEVDIVLPANMPLQEAHDIGESLQVKLELLPEIERAFVHLDYEYSHKPEHAQTSS

SEQ ID NO: 11953 - protein, 399 aa, Vitis vinifera
MVEPVILDGDLDGSEELLLRPTPKNGDRSWRLNFDGFQLSEHKEKKPPRSLHDCLGVLAPGPEDDVAEYYQQQVEMLEGFNEMDALADHGYIPRMTEEEREKLARSETTAIRISNIANMILFAAKVYASVTSGSLAIIASTLDSLLDLLSGFILWFTAFSMQTPNPYQYPIGKKRMQPLGILVFASVMATLGLQIILESVRTLSSDEAEFDLTREQEQWVVGIMLSVTLTKLILAVYCRSFTNEIVKAYAQDHFFDVITNIIGLIAVLLANYISDWMDPVGAIILALYTIRTWTLTVLENVNSLVGRTAAPEYLQKLTYLCWNHHKAIRHIDTVRAYTFGSHYFVEVDIVLPANMPLQEAHDIGESLQVKLELLPEIERAFVHLDYEYSHKPEHAQTSS

SEQ ID NO: 11954 - protein, 369 aa, Cirsium arvense
CLGVLVPEDNVAEYYQQQVEMLEGFTEMDALAQRGFVPRLSEEEKATLARRETLAIRISNVANMVLFVAKVYASVRSGSLAIIASTLDSLLDLLSGFILWFTAFSMKTKNPYLYPIGKRRMQPLGILVFASVMATLGLQIILESVRTLASDEKDFNLTREQEQWVIGIMLSVTLVKLVLCIYCRSFTNEIVKAYAQDHFFDVVTNLIGLIAVLLANYISDWMDPVGAIILALYTIRTWSMTVLENVNSLVGKSAAPEYLQKLTYLCWNHHKSIRHIDTVRAYTFGSHYFVEVDIVLPSEMPLQIAHDIGESLQEKLELLPEIERVFCSSGLRVLATNPSMHRHIIKSFFEPKPPVSSLSLSHTSIRSSD

SEQ ID NO: 11955 - protein, 324 aa, Eucalyptus grandis
MLEGFNEMDTLAERGFVPGMSKEEREKLANSETFAIRISNVANMFLFAAKVYASIQSGSLAIIASTLDSLLDLLSGFILWFTAFSMQTPNPYHYPIGKRRMQPLGILVFASVMATLGLQIILESVRQLLSDEAEFHLTKEQEKWVVGIMLSVTLVKLLLVVYCRSFTNEIVKAYAQDHFFDVITNIIGLIAALLANYFDDWMDPVGAIILALYTIRTWSMTVLENVNSLVGRAAAPEFLQKLTYLCWNHHKAIKKIDTVRAYTFGSHYFVEVDIVLPSNMPLQEAHDIGESLQEKLELLSEIERAFVHLDYEYSHKPEHAQAHS

SEQ ID NO: 11956 - protein, 127 aa, Sarracenia psittacina
PVGAIILALYTIRTWSLTVLDNVNSLAGKSAAPEYLQKLTYLCWNHHKAIKHIDTVRAYTFGSHYFVEVDIVLPADMPLREAHDIGEALQEKLELLPEIERAFVHLDYEYSHKPEHAQTHSLTLRLQ

SEQ ID NO: 11957 - protein, 366 aa, Amaranthus tuberculatus
VNFDGYQLSTEYKEKPSRKLHDCLGVLGSEDDVAEYYQQQVEMLEGFSEMDALAERGFVPGMSKEEREKLANSETFAIRISNICNMVLFIAKVYASVRSGSLAIIASTLDSLLDLLSGFILWFTAFSMSTPNPYQYPIGKKRMQPLGILVFASVMATLGLQIILESSRQLLSDESDFSLNSDQERWLVGIMLSVTLVKLLLVMYCRSFTNEIVKAYAQDHFFDVITNIIGLIAALLANYVSDWMDPVGAIILALYTIRTWSMTVLENVNSLVGKSATPDFLQKLTYLCWNHHKSIRHIDTVRAYTFGSHYFVEVDIVLPANMPLQEAHDIGETLQEKIEQLPDIERAFVHLDYEYTHKPEHAQAHL

SEQ ID NO: 11958 - protein, 405 aa, Artemisia annua
MVEPLNIESSNYHSEEEEKFLLTEVNIGGGGGGCDGSWRLNFDGYQVSSEHKEKAPRGLHDCLGVLVPEDNVAEYYQQQVEMLEGFTEMDALAERGFVPRLSKEEKESLQRRETLAIRISNVANMVLFVAKVYASIRSGSLAIIASTLDSLLDLLSGFILWFTAFSMQTKNPYQYPIGKRRMQPLGILVFASVMATLGLQIILESVRTLASTEKDFNLTKNQEQWVVGIMLSVTLVKLVLCIYCRSFTNEIVKAYAQDHFFDVVTNLIGLIAVLLANYISDWMDPVGAIILALYTIRTWSLTVLENVNSLVGKSAAPEYLQKLTYLCWNHHKSIKHIDTVRAYTFGSHYFVEVDIVLPSDMHLQIAHDIGESLQEKLEQLPEIERAFVHLDYEYSHKPEHAQTHH

SEQ ID NO: 11959 - protein, 377 aa, Pseudotsuga menziesii
MGGGGRMNLPGNKDVMERAPSAKPPFTFGEVKKAIPPHCFNRSLVRSFSYLAFDLVIVALLLYSTTYYFTMSGVLGWVLWLGYWAAQGSVLTGVWVIAHECGHHAFSDYSWVDDTVGLILHSCLLVPYFSWKYSHRRHHSNTGSLERDEVFVPKPKTDIKWTSKLSSNPPGRLLTIAITLTLGWPLYLAFNVSGRKYPRFANHFDPYGPIYNNRERLQILVSDIALLAVAYALYLCGSAYGFSSLIKVYAIPLLIVNGFLVLITYLQHTHPSLAHYDSSEWEWLRGALLTMDRDFGILNHVFHHITDTHVAHHLVSTMPHYHAMEATKAIKPILGNYYCYDSTPVYKAVWREFRECVYVEADSPKKGGVFWYKNKFT

SEQ ID NO: 11960 - protein, 397 aa, Cedrus atlantica
LTSALSEDGTEILLSSTEKAEPSEENAWRLSFNRIPRLQRDEKPQEPGLHDCFSVLGPSSGDGVAEYYQQQEEMLEGFTEMDTVADRGYLPGLSKEERDKVARSETIAIRLSNIANIVLFIAKVYASIKSGSLAIIASTLDSLLDLLSGFILWFTAFKMQSPNPYLYPIGKKRMQPLGILVFASVMATLGLQILIESIRQLMSKEDGLSLEGDTWHWVVGIMVSVTLVKLFLVIYCRSFTNEIVKAFAQDHFFDVITNSIGLIAAVLASKLYWWIDPAGAIVLALYTIRTWSSTVLENVNSLVGRTASPDYLQKLTYLCWNHHKAIRHIDTVRAYTFGSHYFVEVDIVLPSDMPLQQAHDIGEALQEKLESLPDIERAFVHLDYEYSHRPEHAKSYS

SEQ ID NO: 11961 - protein, 79 aa, Fagopyrum esculentum
TFAIRISNVANMVLLLLKSMPQSEVVLLQLLHPRWILFLIFFLVLSCGSLHFPCRHLIHISIPLGRNVCSHWEFLYLLP

SEQ ID NO: 11962 - protein, 177 aa, Gossypium hirsutum
MLGVTLTKLLLMFYCRTFTNEIVKAYAQDHFFDVITNIIGLVAVLLAKYIDDWMDPVGAIILALYTIRTWSMTVLENVNSLVGRSAAPEYLQKLTYLCWNHHKAIKNIDTVRAYTFGSHYFVEVDIVLPANMALQEAHDIGESLQEKLELLPDIERAFVHLDYEFSHKPEHAQAHAL

SEQ ID NO: 11963 - protein, 399 aa, Gnetum gnemon
MAAEAGSSDVLLSMEEVDLHNNNNGNGWRLNFTRVPRPEKHEDACFQGPCSQVCCLRVLVPSSNGVAEYYQQQDEMLESFTEMDAIATHGFSPGLSKEEREKIARSEKMAIRLSNLANIVLFVAKVYASVKSGSLAIIASTLDSLLDLLSGFILWFTAFKMQSPNPYLYPIGKKRMQPLGILVFASVMATLGLQILLESLRRLISKDHGLSLDGEKGRWVIGIMVSVTVVKFCLVIYCRSFTNEIVKAYAQDHFFDVITNAIGLAAALLANSFDWWIDPAGAIVLALYTIRTWSVTVLENVNSLVGKTASPEFLQKLTYLCWNHHKSIRHIDTVRAYTFGSHYFVEVDIVLPSDMPLQEAHDIGEALQEKLETLPDIERAFVHLDHEYTHKPEHAKTYT

SEQ ID NO: 11964 - protein, 418 aa, Oryza sativa
MAAAAGVAAGTGRGSGEGEELLPNAVEGDGGCGGGGTCAGDRPWRLNFDGLRRPEAHQEKPPRRFHDRLGGLAEDIILKGGKRTHPETCFLKKLLYPFDAVLRNLDISVQSPGDDVAEYYQQQSELLEGFNEMDTLTDRGFLPGMSKVYILALEECEKVARSEALAIRLSNIANMVLFAAKVYASIRSGSLAIIASTLDSLLDLLSGFILWFTAFSKKTSNPYRYPIGKRRMQPLGILVFASVMATLGLQIILESTRSLFYDGDTFRLTKEQEKWVVDIMLSVTSVKLLLVVYCRSFTNEILAIYTIRTWSMTVLENVHSLVGQSASPEYLQKLTYLCWNHHKAVRHIDTVRAYTFGSHYFVEVDIVLPCDMPLQEAHDIGEAPQEKLESLPEIERAFVHLDYEFTHQPEHARSHDTL

SEQ ID NO: 11965 - protein, 214 aa, Sequoia sempervirens
SVMATLGLQIVLESARQLVSKEQGLSLEGDSWQWVVGIMVSVTLVKFVLMIYCRTFTNEIVKAYAQDHFFDVITNSIGLFAAVLASTLYWWIDPAGAIVLALYTIRTWSNTVLENVNSLVGKTASPDYLQKLTYLCWNHHKAIRHIDTVRAYTFGSHYFVEVDIVLPSDMPLQQAHDIGEALQVKLESLPDIERAFVHLDYEYTHRPEHGNGHS

SEQ ID NO: 11966 - protein, 401 aa, Picea glauca
MAEPLTSALSEDGTEILLSSAEKAEPSEENAWRLSFNRISQFERDERSQQRGFHDCFSLLGPSSGDGVAEYYQQQEEMLEGFTEMDTVAERGYFPGLSKEERDRVARSETIAIRLSNIANIVLFIAKVYASIRSGSLAIIASTLDSLLDLLSGFILWFTAFKMQSPNPYLYPIGKKRMQPLGILVFASVMATLGLQILLECIRQLVYKEDGLSLDGDKWHWVVGIMVSVTLVKLFLVLYCRSFTNEIVKAFAQDHFFDVITNSIGLIAAILASTLYWWIDPAGAIVLALYTIRTWSSTVLENVNSLVGKTASPDYLQKLTYLCWNHHKAIRHIDTVRAYTFGSHYFVEVDIVLPSDMPLQKAHDIGEALQEKLESLPDIERAFVHLDYEYSHRPEHGKSYS

SEQ ID NO: 11967 - protein, 211 aa, Triticum aestivum
TLGLQIILESTRSLLSDGGEFSLTKEQEKWVVDIMLSVTLVKLALALYCRTFTNEIVKAYAQDHIFDVITNIIGLVAALLANYFEGWIDPVGAIILAIYTIRTWSMTVLENVHSLVGQSASPEYLQKLTYLCWNHHKAVRHIDTVRAYTFGSHYFVEVDIVLPAGMPLQEAHDIGEALQEKLERLPEIERAFVHLDYEFTHRPEHALSHEK

SEQ ID NO: 11968 - protein, 303 aa, Amorphophallus konjac
EEQEKIARSERTAIRISNIANMILFAAKVYASIRSGSLAIIASTLDSLLDLLSGFILWFTACSMQTPNPYQYPIGKRRMQPLGILVFASVMATLGLQIILESFHSLISNEDEFNLTKEQERWVVDIMLSVTLVKLALVIYCRSFTNEIVKAYAQDHLFDVITNIIGLVAALLANYIGYWIDPVGAIILAVYTIRTWSRTVLENVNSLVGRTAAPEYLQKLTYLCWNHHKAIRHIDTVRAYTFGSHYFVEVDVVLPSEMPLREAHDIGEALQEKLELLPEIERAFVHLDYEFCHKPEHAQPHDS

SEQ ID NO: 11969 - protein, 398 aa, Cephalotaxus harringtonia
MVDALEEGTELLLDARNGGSDNPTSEENAWRLKFNKVPRPQRDDDRPQRRIHDCFNVVVGPCDGVAEYYQQQEEMLEGFTEMDAVSERGFLPGISKEEREKVARSERIAIQLSNLANVVLFAAKIYASIKSGSLAIIASTLDSLLDLLSGFILWFTACKMQKPNPHLYPIGKKRMQPLGILVFASVMATLGLQILLESVRQLVSKEEGLSLKGGRWHWVVGIMVSVTFVKLFLVIYCRTFTNEIVKAYAQDHFFDVITNSIGLFAAILASSFYWWIDPVGAIVLALYTIRTWSNTVLENVNSLVGRTASPDYLQKLTYLCWNHDKAIRHIDTVRAYTFGSHYFVEVDIVLPSDMPLQQAHDIGEALQEKLESLSDIERAFVHLDYEYSHRPEHGTSHS

SEQ ID NO: 11970 - protein, 123 aa, Chelidonium majus
MDPVGAIILAMYTIRTWSATVLENVNSLVGRTAAPEYLQKLTYLCWNHHKAVRHIDTVRAYTFGSHYFVEVDIVLPSDMPLREAHDVGEALQEKLECLPEIERAFVHLDYEFTHKPEHAQSQS

SEQ ID NO: 11971 - protein, 155 aa, Hordeum vulgare
RTRGAQDHIFDVITNIIGLVAALLANYFEGWIDPVGAIILAIYTIRTWSMTVLENVHSLVGQSASPEYLQKLTYLCWNHHKAVRHIDTVRAYTFGSHYFVEVDIVLPAGMPLKEAHDIGEALQEKLECLPEIERAFVHLDYEFTHRPEHALSHDK

SEQ ID NO: 11972 - protein, 409 aa, Brachypodium distachyon
MAGSGAGGAEGEELRLLSVVESGHGGGGGGAPEAEKSWRLNFDGFRPPEAHQERPPRGLHHHCLGVLAQSPEDVIAEYYQQQVEMLEGFNEMDALTDHGFLPGMSKEEREKVARSETLAIRLSNIANMVLFAAKVYASVRSGSLAIIASTLDSLLDLLSGFILWFTAFSMQTPNPYRYPIGKKRMQPLGILVFASVMATLGLQIILESTRSLVSDANEFSLTKEQERWVVDIMLSVTLVKLALALYCRSFTNEIVKAYAQDHIFDVITNVIGLVAALLANYFEGWIDPVGAIVLAIYTIRTWSMTVLENVHSLVGQSASPEYLQKLTYLCWNHHKAVRHIDTVRAYTFGSHYFVEVDIVLPSGMPLQEAHDIGEALQEKLERLPEIERAFVHLDYEFTHRPEHALSHDK

SEQ ID NO: 11973 - protein, 126 aa, Setaria italica
GWIDPVGAIILAIYTIRTWSMTVLENVHSLVGQSASPEYLQKLTYLCWNHHKAVRHIDTVRAYTFGSHYFVEVDIVLPSDMPLREAHDIGEALQEKLERLPEIERAFVHLDYEFTHRPEHALSHEN

SEQ ID NO: 11974 - protein, 411 aa, Setaria italica
MAGAAAAADGVEGEELLLLSAVEAGNGGGGAHAAAEESWRLNFEGFRPPEAHQQERPPTGALHHCLGVLAQGPEDVVAEYYQQQVEMLEGFNEMDTLTDRGFLPGMSKEEREKVARSETLAIRLSNFANMVLFAAKVYASVRSGSLAIIASTLDSLLDLLSGFILWFTAFSMQTPNPYRYPIGKKRMQPLGILVFASVMATLGLQIILESVRSLVSDGDEFSLTSQQEKWVVDIMLSVTLVKLALVIYCRSFTNEIVKAYAQDHFFDVITNVIGLVAALLANYIDGWIDPVGAIILAIYTIRTWSMTVLENVHSLVGQSASPEYLQKLTYLCWNHHKAVRHIDTVRAYTFGSHYFVEVDIVLPSDMPLREAHDIGEALQEKLERLPEIERAFVHLDYEFTHRPEHALSHEN

SEQ ID NO: 11975 - protein, 233 aa, Leymus cinereus x Leymus triticoides
RYPIGKKRMQPLGILVFASVMATLGLQIILESTRSLLYNGGEFSLTTEQEKWVVDIMLSVTLVKLALALYCRTFTNEIVKAYAQDHIFDVITNIIGLVAALLANYFEGWIDPVGAIILAIYTIRTWSMTVLENVHSLVGQSASPEYLQKLTYLCWNHHKAVRHIDTVRAYTFGSHYFVEVDIVLPAGMPLQEAHDISEALQEKLERLPEIERAFVHLDYEFTHRPEHALSHEK

SEQ ID NO: 11976 - protein, 372 aa, Pennisetum glaucum
RLNFDGFRPPEAHQQERPPAGALHHCLGVLAQGPEDVVAEYYQQQVEMLEGFNEMDTLTDRGFLPGMSKEEREKVARSETLAIRLSNIANMVLFAAKVYASVRSGSLAIIASTLDSLLDLLSGFILWFTAFSMQTPNPYRYPIGKKRMQPLGILVFASVMATLGLQIILESMRSLASDGDEFSLTSEQEKWVVDIMISVTLVKLALVIYCRSFTNEIVKAYAQDHFFDVITNVIGLVAALLANYIDGWIDPVGAIILAIYTIRTWSMTVLENVHSLVGQSASPEYLQKLTYLCWNHHKAVRHIDTVRAYTFGSHYFVEVDIVLPSDMPLREAHDIGEALQEKLERLPEIERAFVHLDYEFTHRPEHALSHEK

SEQ ID NO: 11977 - protein, 415 aa, Oryza sativa
MAAAVAGGGEEGEELLLLSAVEAGSFGGGGDGGGAGAAAEKSWRLNFDGFRPPEVQQERRPPRGLHHHCLGVLSQGPEDVVAEYYQQQVEMLEGFNEMDTLTDRGFLPGMSKEEREKVARSETLAIRLSNIANMVLFAAKVYASVRSGSLAIIASTLDSLLDLLSGFILWFTAFSMQTPNPYRYPIGKKRMQPLGILVFASVMATLGLQIILESVRSLLSDGDEFSLTKEQEKWVVDIMLAVTLVKLALVLYCRTFTNEIVKAYAQDHFFDVITNMIGLVAALLATYIEGWIDPVGAIILAIYTIRTWSMTVLENVHSLVGQSASPEYLQKLTYLCWNHHKAVRHIDTVRAYTFGSHYFVEVDIVLPSSMPLQEAHDIGEALQEKLERLPEIERAFVHLDYEFTHRPEHALSHEK

SEQ ID NO: 11978 - protein, 309 aa, Sciadopitys verticillata
MEEGTELLLNADVEDAEEPSMEDAWRLSFNKIQRPERDEKPQRGIQDCFNVVLGPGDGVAEYYQQQEEMLEGFTEMDTVSAHGFLPGMTKEEREKVARSEKMAIQLSNLANIVLFIAKVYASIKSGSLAIIASTLDSLLDLLSGFILWFTSFKMQKPNPYLYPIGKKRMQPLGILVFASVMATLGLQILLESARQLISKEEGLSLEGGRWHWVVGIMVSVTLVKLFLVIYCRTFTNEIVKAYAQDHFFDVITNSIGLFAAVLASTLYWWIDPAGAIVLALYTIRTWSNTVLENVNSLVGKQLHLIICRN

SEQ ID NO: 11979 - protein, 410 aa, Panicum virgatum
MAAAAGADGGEGEELLLLSAVEAGNGGGGAPAAVGESWRLNFEGFRPPEGHQQDRPPAGALHHCLGVLAQGPEDVVAEYYQQQVEMLEGFNEMDTLTDRGFLPEMSKEEREKVARSETLAIRLSNIANMILFAAKVYASVRSGSLAIIASTLDSLLDLLSGFILWFTAFSMQTPNPYRYPIGKKRMQPLGILVFASVMATLGLQIILESMRSLVSDQDEFSLTSEQEKWVVDIMISVTLVKLALVIYCRSFTNEIVKAYAQDHFFDVITNVIGLVAALLANYIEGWIDPVGAIILAIYTIRTWSMTVLENVHSLVGQSASPEYLQKLTYLCWNHHKAVRHIDTVRAYTFGSHYFVEVDIVLPSDMPLREAHDIGEALQEKLERLPEIERAFVHLDYEFTHRPEHALSHEK

SEQ ID NO: 11980 - protein, 270 aa, Panicum virgatum
RSGSLAIIASTLDSLLDLLSGFILWFTAFSMQTPNPYRYPIGKKRMQPLGILVFASVMATLGLQIILESMRSLVSDKDEFSLTSEQEKWVVDIMLSVTLVKLALVIYCRSFTNEIVKAYAQDHFFDVITNVIGLVAALLANYIEGWIDPVGAIILAIYTIRTWSMTVLENVHSLVGQSASPEYLQKLTYLCWNHHKAVRHIDTVRAYTFGSHYFVEVDIVLPSDMPLREAHDIGEALQEKLERLPEIERAFVHLDYEFTHRPEHALSHEK

SEQ ID NO: 11981 - protein, 237 aa, Triticum aestivum
NPYRYPIGKRRMQPLGILVFASVMATLGLQIILESTRSLLSSNGAEFRLTKEQEMWVVNIMLAVTLVKLLLVIYCRSFTNEIVKAYAQDHFFDVITNIIGLVAALLANYFEGWIDPVGAIILAIYTIRTWSMTVLENVHSLVGQSASPEFLQKLTYLCWNHHKAVRHIDTVRAYTFGSHYFVEVDIVLPCDMPLQEAHDIGEALQEKLESLPEIERAFVHLDYEFTHQPEHARSYDT

SEQ ID NO: 11982 - protein, 109 aa, Euphorbia peplus
RTWSMTVLENVNSLVGKSATPDYLKLLTYLCWNHHKAIRHIDTVRAYTFGSHYVVEVDIVLPASMPLQEAHDIGESLQEKLELLPEIERAFVHLDYEYMHKPEHAQTHP

SEQ ID NO: 11983 - protein, 126 aa, Cleome spinosa
DDWIDPVGAIILALYTIRTWSMTVLENVNSLVGKSAAPEYLQKLTYLCWNHHKAIRHIDTVRAYTFGSHYFVEVDIVLPADMPLQVAHDIGESLQEKLELLPEIERAFVHLDYEYTHKPEHAKAHC

SEQ ID NO: 11984 - protein, 130 aa, Thellungiella halophila
ANYIDNWMDPVGAIILALYTIRTWSMTVLENVNSLVGKSATPEYLQKLTYLCWNHHKAIRHIDTVRAYTFGSHYFVEVDIVLPADMPLQVAHDIGESLQEKLELLEEIERAFVHLDYEYTHKPEHARSHC

SEQ ID NO: 11985 - protein, 402 aa, Pinus pinaster
MAEPLTSALSEDGTEILLSNAEKAETSEENAWRLSFNRISRFEREERPQQRGLHDCFSVLGASSGDGVAEYYQQQEEMLEGFTEMDTVAERGYLPGLSKEERDKVARSETIAIRLSNIANIILFTAKVYASIKSGSLAIIASTLDSLLDLLSGFILWFTAFKMQSSNPYLYPIGKKRMQPLGILVFASVMATLGLQILLESIRQLVYKEDGLSLDGDKWHWVVGIMVSVTFVKLFLVLYCRSFTNEIVKAYAQDHFFDVITNTIGLIAAILASSTQYRWIDPAGAIVLALYTIRTWSSTVLENVNSLVGKTASPDYLQKLTYLCWNHHKAILHIDTVRAYTFGSHYFVEVDIVLPRDMPLHKAHDIGEALQEKLESLPDIERAFVHLDYEYSHRPEHGKSYS

SEQ ID NO: 11986 - protein, 395 aa, Platanus occidentalis
MKDTVTSGCDPEGSEERLLPESGNGERSWRLNFDGFQFSDIREKPPRGFHDCLGVLGPDDVVAEYYQQQVEMLEGFNEMDTLAERGFLPGISKEEQDKLARSEATAIRISNIANMVLFSAKVFASIRSGSLAIVASTLDSLLDLLSGFILWFTAFSMKTPNPYQYPIGKKRMQPLGILVFASVMATLGLQIILESVRTLLYDEDAFSLTKDQERWVIGIMLSVTLVKLILTIYCRSFSNEIVKAYAQDHFFDVITNIIGLIAAILANYIKGWLDPFGAIILAIYTIRTWSMTVLENVNSLVGRSATPDYLRKLTYLCWNHHKSIRHIDTVRAYTFGSHLFVEVDIVLPSEMPLREAHDIGEMLQEKLELLPEIERAFVHLDYEFTHKPEHAQAHS

SEQ ID NO: 11987 - protein, 322 aa, Hordeum vulgare
MAAGGGVEQGEELFLLRSVEEGGGLCVGERPWRLNFDGFRRQGPQQERPPSRGLQDCLGVLAQGPGDVVAEYYQQQLEMLEGFNEMDTLTDRGCLPGISKGILVFASVMATLGLQIILESTRSLVSSNGAEFRLTKEQEMWVVNIMLAVTLVKLLLVIYCRSFTNEIVKAYAQDHFFDVITNTIGLVAALLANYFEGWIDPVGAIILAVYTIRTWSMTVLENVHSLVGQSASPEFLQKLTYLCWNHHKAVRHIDTVRAYTFGSHYFVEVDIVLPCDMPLQEAHDIGEALQEKLERLPEIERAFVHLDYEFTHQPEHAQSYDR

SEQ ID NO: 11988 - protein, 106 aa, Festuca arundinacea
MTVLENVHSLVGQSASPEYLQKLTYLCWNHHKAVRHIDTVRAYTFGSHYFVEVDIVLPSAMPLREAHDIGEALQEKLEHLPEIERAFVHLDYEFTHRPEHALSHDK

SEQ ID NO: 11989 - protein, 406 aa, Zea mays
MAAAANGGDGEELLLLSAVEAGRGGGVPTEVEDSWRLNFEGFRPPEAHQERPPNGPLHHCLGVLAQGPEDVVAEYYQQQVEMLEGFSEMDTLTDRGFLPGMSKEEREKVARSETLAIRLSNFANMVLFAAKVYASVRSGSLAIIASTLDSLLDLLSGFILWFTAFSMQTPNPYRYPIGKKRMQPLGILVFASVMATLGLQIILESVRSLVSDGDEFSLTSDQEKWLVDIMLSVTLVKLALVIYCRSFTNEIVKAYAQDHFFDVITNVIGLVAALLANYIEGWIDPLGAIVLAIYTIRTWSMTVLENVHSLVGQSASPEYLQKLTYLCWNHHKAVRHIDTVRAYTFGSHYFVEVDIVLPSNMPLREAHDIGEALQEKLERLPEIERAFVHLDYEFTHRPEHALSHEK

SEQ ID NO: 11990 - protein, 217 aa, Avena sativa
MAAGAGGAEGEELRLLSAAEAGDTGGSPPAAEKSWRLNFDGFRPPEARQEKPPRGLHHHCLGVLGQGPEDVVAEYYQQQVEMLEGFNEMDALTDRGFLPGLSKEEREQVARSETLAIRLSNIANMVLFAAKVYASVRSGSLAIIASTLDSLLDLLSGFILWFTAFSMQTPNPYRYPIGKKRMQPLGILVFASVMATLGLQIILESTRSLISDGDEFS

SEQ ID NO: 11991 - protein, 406 aa, Avena sativa
MAAGAGGAEGEELRLLSAAEAGDTGGSPPAAEKSWRLNFDGFRPPEARQEKPPRGLHHHCLGVLGQGPEDVVAEYYQQQVEMLEGFNEMDALTDRGFLPGLSKEEREQVARSETLAIRLSNIANMVLFAAKVYASVRSGSLAIIASTLDSLLDLLSGFILWFTAFSMQTPNPYRYPIGKKRMQPLGILVFASVMATLGLQIILESTRSLISDGDEFSLTNEQEKWVVDIMLSVTLVKLALALYCRSFTNEIVKAYAQDHMFDVMTNIIGLVAALLANYFEGWIDPVGAIILAIYTIRTWSMTVLENVHSLVGQSASPEYLQKLTYLCWNHHKAVRHIDTVRAYTFGSHYFVEVDIVLPCAMPLREAHDIGEALQEKLERLPEIERAFVHLDYEFTHRPEHALSHDK

SEQ ID NO: 11992 - protein, 401 aa, Pinus taeda
MAEPLTSALSEDGTEILLSNVEKAETSEENAWRLSFNRISRFEREERPQQRGLHDCFSVLGASSGDGVAEYYQQQEEMLEGFTEMDTVAERGYLPGLSKEERDSVARSETIAIRLSNIANIILFTAKVYASIKSGSLAIIASTLDSLLDLLSGFILWFTAFKMQSSNPYLYPIGKKRMQPLGILVFASVMATLGLQIMLESIRQLVYKENGFSLDGDKWHWVVGIMVSVTFVKLFLVLYCRSFTNEIVKAYAQDHFFDVITNTIGLIAAILASTRHRWIDPAGAIVLALYTIRTWSSTVLENVNSLVGKTASPDYLQKLTYLCWNHHKAILHIDTVRAYTFGSHYFVEVDIVLPRDMPLHKAHDIGEALQEKLESLPDIERAFVHLDYEYSHRPEHGKSYS

SEQ ID NO: 11993 - protein, 226 aa, Podocarpus macrophillus
KKRMQPLGILVFASVMATLGLQILLESSRQLISKEQGLSLDGDRWHWVVGIMVSVTLVKLFLVIYCRTFTNEIVKAYAQDHFFDVITNAIGLCAAILASTLYWWIDPAGAIVLALYTIRTWSNTVLENVNSLVGRTASPDYLQKLTYLCWNHHKAIRHIDTVRAYTFGSHYFVEVDIVLPSDMHLQEAHDIGEALQEKLESLPDIERAFVHLDYEYSHRPEHGKHH

SEQ ID NO: 11994 - protein, 409 aa, Sorghum bicolor
MASAAAEANGGEGEELLLLSAAEAGRGGGATAEAEESWRLNFEGFRPPEAHQERPPTGPLHHCLGVLAQGPEDVVAEYYQQQVEMLEGFSEMDTLTDRGFLPGMSKEEREKVARSETLAIRLSNIANMVLFAAKVYASVRSGSLAIIASTLDSLLDLLSGFILWFTAFSMQTPNPYRYPIGKKRMQPLGILVFASVMATLGLQIILESIRSLASDGDEFSLTSDQEKWLVDIMLSVTLVKLALVIYCRSFTNEIVKAYAQDHFFDVITNIIGLVAALLANYIEGWIDPLGAIVLAIYTIRTWSMTVLENVHSLVGQSASPEYLQKLTYLCWNHHKAVRHIDTVRAYTFGSHYFVEVDIVLPSNMPLREAHDIGEALQEKLERLPEIERAFVHLDYEFTHRPEHALSHEK

SEQ ID NO: 11995 - protein, 259 aa, Saccharum officinarum
LDSLLDLLSGLILWFTAFSMQTPNPYRYPIGKKRMQPLGILVFASVMATLGLQIILESIRSLASDGDEFSLTSDQEKWLVDIMLSVTLVKLALVIYCRSFTNEIVKAYAQDHFFDVITNVIGLVAALLANYIEGWIDPLGAIILAIYTIRTWSMTVLENVHSLVGQSASPEYLQKLTYLCWNHHKAVRHIDTVRAYTFGSHYFVEVDIVLPSNMPLREAHDIGEALQEKLERLPEIERAFVHLDYEFTHRPEHALSHEK

SEQ ID NO: 11996 - protein, 190 aa, Brassica rapa
MAESPVQMNLVPTEATSESFAEYGQVIEASSDGDLFGPNDAQLDLSRGTPRFYIMRLEGRTLGFSTITHHANVTQCLGSIGGHVWYLGVAKPSLIEDVDRERVGDNVESGSDGHLYAPPTVEEVRVFRFSGPKFVKLNRGTWHAGPLFSDSSMDFYNLELSNTNEVDHTTHSFKKKNGVIFRFEDSTSSS

SEQ ID NO: 11997 - protein, 396 aa, Phalaenopsis aphrodite
MAASEGSNGDIEGSKLLLAESGERERSWRLNFDGFRRAELLEEKPPRSLHHCLGTLVKEDVVAEYYQQQVEMLDGFGEMDTLTDRGFLPQMSKEERESLARSETLAIRISNVANMVLFIAKVYASVRSGSLAIIASTLDSLLDLLSGFILWFTAFSMQTPNPYQYPIGKRRMQPLGILVFASVMATLGLQIILESVRSLVSDESEFSLTKEQEIWVVDIMLSVTVVKLCLVFYCRSFTNEIVKAYAQDHFFDVITNMIGLVAALLANYITDWIDPAGAILLAIYTIRTWLMTVLENVNSLVGKTAAPEFLQKLTYLCWNHHKAIRHIDTVRAYTFGSRYFVEVDIVLPSDMPLREAHDIGEALQEKLELLPDVERAFVHLDYEYTHRPEHSQVQDS

SEQ ID NO: 11998 - protein, 339 aa, Phalaenopsis aphrodite
KEDVVAEYYQQQVEMLDGFGEMDTLTDRGFLPQMSKEERESLARSETLAIRISNVANMVLFIAKVYASVRSGSLAIIASTLDSLLDLLSGFILWFTAFSMQTPNPYQYPIGKRRMQPLGILVFASVMATLGLQIILESVRSLVSDESEFSLTKEQEIWVVDIMLSVTVVKLCLVFYCRSFTNEIVKAYAQDHFFDVITNMIGLVAALLANYITDWIDPVGAILLAIYTIRTWLMTVLENVNSLVGKTAAPEFLQKLTYLCWNHHKAIRHIDTVRAYTFGSRYFVEVDIVLPSDMPLREAHDIGEALQEKLELLPDVERAFVHLDYEYTHRPEHSQVQDS

SEQ ID NO: 11999 - protein, 412 aa, Pteridium aquilinum
MELHHSKLHQHQGNAADDEEGAQALLAGDRPARELPSWRLSFHGFQRLSSSASEGPPSPVHSYTCALHDCLKRLGSANRVDEYYQQQEEMLEGFTEMDVLTDGIREFASKEERDQVAKAERLAIQISNLANLLLFISKVYVSVRTLSLAIIASTLDSLLDLLSGFILWFTAISMQQPNPYLYPIGKKRMQPLGILVFASVMATLGLQILIESARQLAYRDKQLALDGSDKAWLVGIMVFVTLVKLALVFYCRSYKNEIVRAYAQDHFFDVMTNSIGLLAAILANYFYWWMDPAGAIVLALYTIRTWSLTVLENVNSLVGRTASPEYLQKLTYLCWNHHKDIRQIDTVRAYTFGSHYFAEVDIVLPADMPLQMAHDIGESLQNKLESLVDIERAFVHLDYEVSHRPEHAQYDS

SEQ ID NO: 12000 - protein, 405 aa, Brachypodium distachyon
MAAAAGEGVGGEGEELLLRSVEAGDGLCVGDRPWRLNFDGFRRQEAQQENPPRGRLHDCLGVLAQGPGDVIAEYYQQQLEMLEGFNEMDTLTDRGCLPGLSKEEREKVARSETLAIRLSNIANMVLFAAKVYASIRSGSLAIIASTLDSLLDLLSGFILWFTAFSMQTPNPYRYPIGKRRMQPLGILVFASVMATLGLQIILESTRSLLSDGTEFRLTKEQEMWVVDIMLSVTLVKLLLVIYCRSFTNEIVKAYAQDHFFDVITNIIGLVAALLANYVEGWIDPVGAIILAIYTIRTWSMTVLENVHSLVGQSASPEFLQKLTYLCWNHHEAVRHIDTVRAYTFGSHYFVEVDIVLPRDMPLRDAHDIGEALQEKLESLPEIERAFVHLDYEFTHQPEHARSYDT

SEQ ID NO: 12001 - protein, 108 aa, Cryptomeria japonica
  misc_feature (61)..(61): Xaa can be any naturally occurring amino acid
VLALYTIRTWSNTVLENVNSLVGKTASPDYLQKLTYLCWNHHKAIRHIDTVRAYTFGSHYXVEVDIVLPSDMPLQQAHDIGEALQEKLESIPDIERAFVHLDYEYSQT

SEQ ID NO: 12002 - protein, 165 aa, Cycas rumphii
VIYCRTFTNEIVKAYAKDHFFDVITNSIGLVAAILASALYWWIDPAGAIVLALYTIWTWSKTVLENVNSLVGKTASPDFLQKLTYLCWNHHKDIRHIDTVRAYTFGSHYFVEVDIVLPSDMPLHRAHDIGEALQEKLERLAEIERAFVHLDYEYTHRPEHGKQDS

SEQ ID NO: 12003 - protein, 397 aa, Taxus baccata
MVDPSHEGAELLLHGGIVEGGNPTSEETAWRLKFDRVPRPERDEKRPRRIHDCFNVVLGPGDGVAEYYQQQEEMLEGFTEMDTVSERGFLPGMSKEEREKVARSERIAIRLSNLANVVLFAAKIFASIKSGSLAIIASTLDSLLDLLSGFILWFTAFKMRKPNPYLYPIGKKRMQPLGILVFASVMATLGLQIILESARQLISKEEGLSLEGDKWHWVVGIMVSVTLVKLALVIYCQTFTNEIVKAFAQDHFFDVITNTIGLFAAVLASTFYWWIDPSGAIVLALYTIRTWSNTVLENVNSLVGKTASPDYLQKLTYLCWNHHRSIRQIDTVRAYTFGGHYFVEVDIVLPSDMPLQEAHDIGEELQEKLESLPDIERAFVHLDYEYTHRPEHGKRHP

SEQ ID NO: 12004 - protein, 55 aa, Zostera marina
MHDCLGILVLDAGNDVAEYYQQQVEMLESFDEMDVLADRGYIPGMTKGGRRRKNC

SEQ ID NO: 12005 - protein, 119 aa, Cucurbita pepo
GAIILALYTIRTWSMTVLENVNSLVGRSAAPEYLQKLTYLCWNHHKAIKHIDTVRAYTFGSHYFVEVDTVLPGDMPLEEAHDIGESLQEKLELLPEIERAFVHLDYEYKHKPEHAQTHS

SEQ ID NO: 12006 - protein, 338 aa, Distylium racemosum
PGDGVAEYYQQQDEMIEGFTEMDVVSKHGFLPGMSKEEHEKVARRERTAIRISNLANIVLFLAKIYASIKSGSLAIIASTLDSLLDLLSGFILWFTSFKMQTPNPYLYPIGKKRMQPLGILVFASVMATLGLQILLESARQLISKEQGLSLDGGKWHWVVGIMVSVTLVKLFLVIYCRTFTNEIVKAYAQDHFFDVITNAIGLCAAVLASTLYWWIDPAGAIVLAVYTIRTWSNTVLENVNSLVGRTASPDYLQKLTYLCWNHHKSIRHIDTVRAYTFGTHYFVEVDIVLPSDMPLQEAHDIGEALQEKLESLPDIERAFVHLDYEYTHRPEHGKRYS

SEQ ID NO: 12007 - protein, 236 aa, Momordica charantia
MVYCIFHANTKPVPVSYWEKNVMQPLGILVFASVMATLGLQIILESIRTLLSDDSDFKLTKEQERWVVGIMLSVTLVKLLLVVYCRAFTNEIVKAYAQDHFFDVVTNAIGLVAALLANYIDDWMDPLGAIILALYTIRTWSMTVLENVNSLVGRSAAPEYLQKLTYLCWNHHKAIRHIDTVRAYTFGSHYFVEVDIVLPGDMPLEEAHDIGESLQEKLELLPEIERVLCSSRLRVQ

SEQ ID NO: 12008 - protein, 139 aa, Avena sativa
IGLVAALLANYFEGWIDPVGAIILAIYTIRTWSMTVLENVHSLVGQSASPEFLQKLTYLCWNHHEAVRHLDTVRAYTFGSHYFVEVDIVLPCDMPLQEAHDIGEALQEKLESLPEIERAFVHLDYEFTHQPEHARSYDT

SEQ ID NO: 12009 - protein, 147 aa, Avena sativa
FFDVITNIIGLVAALLANYFEGWIDPVGAIILAIYTIRTWSMTVLENVHSLVGQSASPEFLQKLTYLCWNHHEAVRHLDTVRAYTFGSHYFVEVDIVLPCDMPLQEAHDIGEALQEKLESLPEIERAFVHLDYEFTHQPEHARSYDT

SEQ ID NO: 12010 - protein, 118 aa, Olea europaea
AIILSLYTIRTWSLTVLENVNSLIGRSAAPEYLQKLTYLCWNHHKSIRHIDTVRAYTFGSHYFVEVDIVLPADMPLQEAHDIGESLQEKLEILPEIERAFVHLDYEYTHKPRNMHKRI

SEQ ID NO: 12011 - protein, 392 aa, Cephalotaxus harringtonia
QRSELLLHVRHGGSGDPTSEENAWRLKFNRVSRPRRADDMPQRGIHDCFNVVLGPRDVVAEYYQQQEEMLECFTEMDAVSGRGLLPGMSMEESEKVARSERIAIRLSNLANVVLFAVKIYASIMSGSLAIIASTLDSLLDLLSGFILWYTAFKMQKPNPYLYPIGKKRMQPLGILVFASVMATLGLLILLESVRQLVSKEAALSLKGGKWHWLVGIMVSVTVVKLFLVIYCRTFTNEIVKAYAQDHFFDVITNSIGLFAAILASYFYWWIDPAGAIVLALYTMRTWSNTVLENVSSLVGKTASPDYLQKLTYLCWNHDKAIRHIDTVKAYTFGSHYFVEVDIVLPSDMPLQQAHDIGEGLQEKLESLSDIERAFVHLDYECTHRPEHGKRRS

SEQ ID NO: 12012 - protein, 407 aa, Setaria italica
MAAAGARGGEEGEELLLRAVDAGDDVSGGLCLGERPWRLNFDRFRRPEAEQEKPARGLHDCLGVLAQGSADDVAEYYQQQLEMLEGFNEMDTLADRGFLPGMSKEEREMVAQKETWAIRLSNIANMVLFAAKVYASVRSDSLAIVASTLDSLLDLLSGFILWFTAFSMQTPNPYRYPIGKRRMQPLGILVFASVMATLGLQIIIESTHSLVSDGDEFRLTKEQEKWVVNIMLSVTLVKLLLVIYCRTFTNEIVKACAQDHFFDVITNVIGLVAALLANYVQGWIDPVGAIILAIYTIRMWSITVLDNVHSLVGQSAPPAFLQKLTYLCWNHHKAVRHIDTVRAYTFGSHYFVEVDIVLPCAMPLREAHDIGEALQEKLERLPEIERAFVHLDYEFTHQPEHARSHDT

SEQ ID NO: 12013 - protein, 407 aa, Setaria italica
MAAAGARGGEEGEELLLRAVDAGDDVSGGLCLGERPWRLNFDRFRRPEAEQEKPARGLHDCLGVLAQGSADDVAEYYQQQLEMLEGFNEMDTLADRGFLPGMSKEEREMVAQKETWAIRLSNIANMVLFAAKVYASVRSDSLAIVASTLDSLLDLLSGFILWFTAFSMQTPNPYRYPIGKRRMQPLGILVFASVMATLGLQIIIESTHSLVSDGDEFRLTKEQEKWVVDIMLSVTLVKLLLVIYCRTFTNEIVKACAQDHFFDVITNVIGLVAALLANYVQGWIDPVGAIILAIYTIRMWSITVLDNVHSLVGQSAPPAFLQKLTYLCWNHHKAVRHIDTVRAYTFGSHYFVEVDIVLPCAMPLREAHDIGEALQEKLERLPEIERAFVHLDYEFTHQPEHARSHDT

SEQ ID NO: 12014 - protein, 434 aa, Pseudotsuga menziesii
MADSLSSPLSDHGIQKAEPSEENAWHQPSPLLDHGVEKAEPSEENAWHQPSPLSEHGIKKAEPSEEENSWRVNFNQIQRPEMNEKPKRCLNVPGPCSGDGVTRYYEQQKEMLEGFTQMDFVNNSDVSLGMSKEDCDKLARSEATAIRLSNIANIVLFIAKVYASIKSGSLAIIASTLDSLLDLLSGFILWFTAVKMQSPNPYRYPIGKKRMQPLGIMVFASVMATLGLAILLESIRQLISKEHNLSLQGSGWHWVVGIMVSVTVVKFVLVIYCRSFTNEIVKAYAQDHFFDVMTNAIGLVAAILASKLYWWIDPAGAIVLAFYTMRTWSKTVLENVNSLVGKSASPDYLQKLTYLCWNHHQAIRHIDTVKAYTFGSHYFVEVDIVLPSDMPLREAHDVGEALQEKLESLPDIERAYVHLDHEYTHRPEHGRSHS

SEQ ID NO: 12015 - protein, 273 aa, Pseudotsuga menziesii
YASIRSGSLAIIASTLDSLLDLLSGFILWFTAAKMRSPNPYLYPIGKKRMQPVGILVFSSVMATLGLQILIVSIRQLVSKEHGLSLEGGKWHWVAGIMISVTAVKFVLLIYCRSFNNEILKAYAQDHFFDVVTNAIGLVAAILASKFYWWIDPAGAIVLALYTMRTWSNTVLENVNSLVGKTASPDYLQKLTYLCWNHHQAIRHIDTVKAYAFGSHYFVEVDIVLPSDMPLQQAHDIGEALQEKLESLPDVERAFVHLDYEYSHRPEHGKGDT

SEQ ID NO: 12016 - protein, 346 aa, Abies balsamea
CFTAFGPCSGDGVAKYYQQQDEMLEGFTEMDYVTDNGVLPVMSKEDCDKLARSETNAIRLSNIANIVLFIAKVYASIQSGSLAIIASTLDSLLDLLSGFILWFTAFKMQSPNPYRYPIGKKRMQPLGIMVFASVMATLGLAILLESIRQLISKSHNLSLEGSGWHWVVGIMVSVTVVKFILVLYCRSFTNEIVKAYAQDHLFDVVTNAIGLIAAILASKLYWWIDPAGAILLALYTMRTWSNTVLENVVSLVGKTAPPYYLQKLTYLCWNHDRAIRHIDTVKAYTFGSHYFVEVDIVLPSDMPLQQAHDVGEALQEKLESLPDIERAYVHLDHEYKHKPEHRKCLS

SEQ ID NO: 12017 - protein, 393 aa, Sciadopitys verticillata
EPLGTELLVRGLDIEAVEETSTENAWRLNFTKIQRPERNDSTHRRIQDCFKMVLGPADGVAEYYQQQEEMLEGFTEMDAVSENGPLLGMSKEDCNKLEKRERTAIRLSNLANIVLFIAKVYVSIKSGSLAILASTLDSLLDLLSGFILWFTAFKMRKPNPYRYPIGKKRMQPLGILVFASVMATLGLAILLESLRQLISKEKGLSLGGGKWQWVVGIMVSVTVVKFFLVIYCRTFTNEIVKAFAQDHFFDVITNSIGLIAAVLASKFYWWMDPAGAIVLALYTIRTWSKTVLENVHSLVGKTASPDYLQKLTYLCWNHHKDIQQIDTVRAYTFGAHYFVEVDIVLPSNIPLQQAHDIGEALQEKLESLPDIERAFVHLDYEYSHRPEHGKRHS

SEQ ID NO: 12018 - protein, 217 aa, Brassica napus
HSVKEDLANMIAPLIFRPITRWPFYAFLGGAMFCLLASSTCHLLSCHSERVSYIMLRLDYAGIAALISTSFYPPVYYSFMCDPFFCNLYLGFITILGISTVLVSLLPVFQSPEFRVVRASLFFGMGFSGAAPILHKLIIFWDQPEALHTTGYEVLMGLLYGLGALVYATRIPERWMPGKFDIAGHSHQLFHVLVVAGAFTHYRAGLVYLKWRDIEGC

SEQ ID NO: 12019 - protein, 131 aa, Raphanus sativus
NLYLGFITILGISTVLVSFLPVFQSPEFRVVRASFFFGMGFSGAAPILHKLIIFWDQPEALHTTGYEVLMGLLYGLGALVYATRIPERWMPGKFDIAGHSHQLFHVLVVACAFTHYRAGLVYLKWRDIEGC

SEQ ID NO: 12020 - protein, 183 aa, Raphanus sativus
LLASSTCHLLSCHSERVAYIMLRLDYAGIAALIATSFYPPVYYSFMCDPFFCNLYLGFITILGLATVLVSLVPVFQTPEFRVVRASLFFGMGFSGAAPILHKLIIFWDQPEALHTTCYEVLMGLLYGLGALVYVTRIPERWMPGKFDIAGHSHQLFHVLVVAGAFTHYRAGLVYLKWRDIEGC

SEQ ID NO: 12021 - protein, 131 aa, Thellungiella halophila
LYLGFITILGIATVLVSLLPVFQSPEFRVVRASLFFGMGFSGAAPILHKLIIFWDQPEALHTTGYEILMGLLYGLGALIYATRIPERWMPGKFDIAGHSHQLFHVLVVAGAFTHYRAGLVYLKWRDIEGCS

SEQ ID NO: 12022 - protein, 133 aa, Brassica napus
FCNLYLGFITTLGIATVLVSLIPVFQTPEFRVVRASLFFGMGFSGAAPILHKLIIFWDQPEALHTTCYEVLMGLLYGLGALVYVTRIPERWMPGKFDIAGHSHQLFHVLVVAGAFTHYRAGLVYLKWRDIEGC

SEQ ID NO: 12023 - protein, 402 aa, Gossypium hirsutum
MGSVEQVCEDSNLPTETMEQCKVNCSKEGKGKRLWKKVKYQLVEYHSLPGYLRDNEYILGHYRSEWPMKQVLLSIFTIHNETLNVWTHLIGFFIFLALTIYTAMKVPKVVDFHSLQHIPDVLRKADLHKLHSELMTCLPSLPNMPGLHKLREELLLLSGWHVRELLYNCLPERFFSGNHTDVCVLQSVKEDVANIIAPLMVRPITRWPFFAFLGGAMFCLLASSTCHLLSCHSERLSYIMLRLDYAGIAALISTSFYPPVYYSFMCDPFFCNLYLGFITILGVSTILVSLLPVFQNPEFRSIRASLFFGMGMSGIAPILHKLILFWHQPEALLTTGYEVLMGLFYGIGALVYATRIPERWMPGKFDIAGHSHQLFHILVVAGAYTHYRAGLVYLKWRDLNGC

SEQ ID NO: 12024 - protein, 163 aa, Raphanus sativus
MQSLNLGWCEKISDDGVMSLAYGCPDLRTLDLCGCVLITDESVVALADWCVHLRSLGLYYCRNITDRAMYSLAQSGVKNKQPGQWKSSAKKSKYDEEGLRSLNISQCTALTPSAVQAVCDTFPALHTCSGRHSLVMSGCLNLTSVHCACILQAHRAVVPHSAH

SEQ ID NO: 12025 - protein, 200 aa, Brassica napus
MVSQEGPATLDRCFEKMKMEGVVITEWKDIPVELLMKILNLVDDRTVIIASGVCSGWRDAISFGLTRLSLSWCKKNLNSLVLSLAPKLVKLQTLVLRQDNPQLEDNAVEAIANHCHELQDLDLSKSLKLTDHSLYSVARGCTNLTKLNLSGCTSFSDTALAYLTRFCKKLRVLNLCGCVEAVSDNALQAIGENCNEMMES

SEQ ID NO: 12026 - protein, 212 aa, Brassica juncea
NLSGCTSFSDTALAYLTRFCGKLKVLNLCGCVEAVSDNALQAIGENCSQMQSLNLGWCEKISDDGVMSLAYGCPDLRSLDLCGCVLITDESVVALANRCVHLRSLGLYYCRNITDRAMYSLAQSGVKNKHEMWRSVKKGKFDEEGLRSLNISQCTYLTPSAVQAVCDTFPALHTCSGRHSLVMSGCLNLTSVHCACTLQAHRSHTALPHPAH

SEQ ID NO: 12027 - protein, 189 aa, Raphanus sativus
KVLNLCGCVEAVSDNALQAIGENCSQMQSLNLGWCENVSDDGVMSLSYGCPDLRTLDLCGCVLITDESVVALANKCVHLRSLGLYYCRNITDRAMYSLAQSGVKNKHDMRRSVKKGKFDEEGLRSLNISQCTYLTPSAVQAVCDTFPALHTCSGRHSLVMSGCLNLTSVHCACILQTHRTHTAYPHPAH

SEQ ID NO: 12028 - protein, 165 aa, Raphanus sativus
MQSLNLGWCEKISDDGVMSLADGCPDLRSLDLCGCVLITDESVVALANRCVHLRSLGLYYCRNITDRAVYSLAQSGVKNKHELWRSVKKGKFDEEGLRSLNISQCTYLTPSAVQAVCDTFPALHTCSGRHSLVMSGCLNLTSVHCACILQAHRAHTHSALPHPAH

SEQ ID NO: 12029 - protein, 162 aa, Brassica napus
MQSLNLGWCEKISDDGVMSLAYGCPDLRTLDLCGCVLITDESVVALADWCVHLRSLGLYYCRNITDRAMYSLAQSGVKNKPGGQWKSSAKKSKFDEEGLRSLNISQCTALTPSAVQAVCDTFPALHTCSGRHSLVMSGCLNLTSVHCACILQAHRSVPHSAH

SEQ ID NO: 12030 - protein, 234 aa, Cleome spinosa
YSPGIMLLIFKRATSHVPLKILSIEDGTVLKSFNHLLHRNKKVDFIEQFNEKLLVKQENENLQILDVRNAELMEVSRTEFMTPSAFIFLYENQLFLTFRNRTVSVWNFRGELVTSFEDHLLWHPDCNTNNIYITSDQDLIISYCKADTEDQWIEGNAGSINISNILTGKCLAKITASSGCPKEEEECSSSLGSSKQRRGAVAEALEDITALFYDEERNEIYTGSRHGLIHVWSN

SEQ ID NO: 12031 - protein, 228 aa, Carica papaya
MLLIFKRASSHVPLKILSIEDGTVLKAFNHLLHRNKKVDFIEQFNEKLLVKQENENLQILDVRNAELMEVSRTEFMTPSAFIFLYENQLFLTFRNRTVAVWNFRGELVTSFEDHLLWHPDCNTNNIYITSDQDLIISYCKAESEDQWTEGNAGSINISNILTGKCLAKINSASGTPKVNGCSSGSGSSTQMRSTVAEALEDITALFYDEERNEIYTGNRHGLIHVWSN

SEQ ID NO: 12032 - protein, 348 aa, Cucurbita pepo
CFLNVSPDEVIRSCFTIRTMITYHSSVYASDNFSSLKCRSTRIEYIRRGKPDAGFALFESESLKWPGFVEFDDVNGKVLTYSAQDSIYKVFDLKNYTMLYSISDKHVQEIKISPGIMLLIFNRASSHVPLKILSIEDGTVLKAFNHLLHRNKKVDFIEQFNEKLLVKQENENLQILDVRNAELMEVSRSEFMTPSAFIFLYENQLFLTFRNRTVAVWNFRGELVTSFEDHLLWHPDCNTNNIYITSDQDLIISYCKADGDDHWMEGNAGSINISNILTGKCLAKINASNGNPKVEDCSCADISKKQCSSSQMRNTVAEALEDITALFYDEERNEIYTGNKNGLVHVWS

SEQ ID NO: 12033 - protein, 486 aa, Aquilegia formosa
MEGQGQGQGQQGKRISVSPRPCSGRRILASSAAAGGGTTGGSRSGKRSRVLDGSGGAGFLNNSVRKIQRREICSKRDRSFSISNAQERFRNILLQEEYDTHDPKEHSSPILPFLKKRSKIIEIVAARDIVFALAQSGICAAFSRETNRRICFLNVSPDEVIRSLFYNKNNDSLITVSVYASDNFSSLKCRTTRIEYIRRGKPDAGFSLFETESLKWPGFVEFDDVNGKVLTYSAQDSVYKVFDLKNYTMLYSISDKHVQEIKISPGIMLLIFTRASSHVPLKILSIEDGTVLKSFNHLLHRNKKVDFIEQFNEKLLVKQENENLQILDVRNAELTEVSRTEFMTPSAFIFLYENQLFLTFRNRTVAVWNFRGELVTSFEDHLLWHPDCNTNNIYITSDQDLIISYCKADSDDPLEGNAGSINVSNILTGKCLAKIRANSGDPQSYCTSTRNTVSEALEDITALFYDEERNEIYTGNRQGLVHVWSN

SEQ ID NO: 12034 - protein, 1000 aa, Ricinus communis
MESANQLLERLFANIQRVCNFEYQLNQQQIIQMLIDTKPCKPMAYCNLESEKSASWVSFDIYMENIMDGKQLHIRSSIAILRETIKTLQVLNRASWQETFLALWLSALRLVQRERDPVEGPIPHLESRLCILLTIVPLAIANILEDETKFCSSALQGAGTSGHMETSGLGGGNHIDASVNAGGNMRHLIVEACIARNLIDASAYFWPGYVPAAAISMSDLPPLQKSPWLTFMEGSALNNSLVNSLLTTPATSLAEIEKLYHIALNGSAEQSAAAKILCGASLTRGWNIQEHVVHYLVKLLSPPVPSTHSGLRSHLVDYAPMLSAILFGASSIDNVHILSLHGVIPEFAASLMPICETFGSLMPTSTNVSSTCDEPSFYMVFSAAFLFLLRLWKFYRPSVEQWLTGGGTLGSEITLEYLLMLRNRRIASKNSAALGEINSVNSDSVQIESISDKPVYVDFYPKLRAWYCQNKSCVASTLSGLSTGNPVHQVANKILNMIYSKMTRIGTSPGNSSTLSSNSLCGSSSSSGEDPYQRPMLPAWEVLEAVPFVLEAILTACAHGRLSSRDLTTGLRDLIDFLPASLGGIISYFAAEVTRGTWKPVPMNGTDWPSPAAVLSSVESEMREILSAAGVDFPTFSSRHLPVMLPLPMAALVSLTITFKLNKGLDYLHVVVGPALENCASGCPWPSVPIIGSLWAQKVRRWHDYIVVSCARSVFRQNKEAVSKLLRSCFSSFLGSVNVSSPLLTNQCSIGGLLGNTIPSACGSLAPGFLYLRSCRTIQDIQYVNGVIIGLVGEHARESAARWANTSSSRLKSSQASLNLAAAKAREAATLGASLLCISGGMNLVQELYLETIPTWLLSSKAMKHGEMSVVSRIVEGYAMAYMLVLSGSLVWGAGSKSPSWALSRRAHIVGSHMDFLAGVLEGHISLGCHPATWKAYFSCLVRLLASFAPAWIQEVRLETMKKLANGLRGWHETELAISLLERGGVAAIGLVAELVNVLD

SEQ ID NO: 12035 - protein, 360 aa, Cucumis melo
ETNERICFLNVSPDEVIRSLFYNKNNDSLITVSVYASDNFSSLKCRSTRIEYIRRGKPDAGFALFESESLKWPGFVEFDDVNGKVLTYSAQDSIYKVFDLKNYTMLYSISDKHVQEIKISPGIMLLIFNRASSHVPLKILSIEDGTVLKAFNHLLHRNKKVDFIEQFNEKLLVKQENENLQILDVRNAELMEVSRTEFMTPSAFIFLYENQLFLTFRDRTVAVWNFRGELVTSFEDHLLWHPDCNTNNIYITSDQDLIISYCKADSDDHWMVGNAGSINISNILTGKCLAKINASNGKPKVNDSSSSSSGAGSSRKVCNSSQMRNTVAEALEDITALFYDEERNEIYTGNKNGLVHVWSN

SEQ ID NO: 12036 - protein, 438 aa, Cirsium arvense
MEGFVSSRRRITMASSGGSSGSGSGSSSSRPPPQCGGRRRVVATKKRDRTNLLSVNNSFNKIQRREISSKRHRSFSVTNSVHRFRNIRLTEQYDTHDPKGHSSFVLPFLMKRAKVIEIVAARGIVFALASSGVCAAFSRDKNKRICFLNIFPDEVIRSLFYNKNNDSLITVSVYASDNFSSLKCRSTRIEYIQRGKPDAGFPLFESESLKWPGFVEFDDVNGKVLTYSAQDSIYKVFDLKNYTLLYSIADKNVEEIKISPGIMLLIFSRAQSHVPLKILSIEDGTVLKDFNHLLHRNKKVDFIEQFNEKLLVKQENENLQILDVRNAEVKEVGRTEFMTPSAFIFLYENQLFLTFRNRTVSVWNFRGELVTSFEDHMLWHSDCNTNNIYITSEQDLIISFCKDDSDDQWTDGKAGSINISNIWTGKRIGKINLSNATS

SEQ ID NO: 12037 - protein, 353 aa, Aristolochia fimbriata
RETNQRICFLNVSPDEVIRSLFYNKNNDSLITVSVYASDNFSSLKCRTTRIEYIRRGKPDAGFALFESESLKWPGFVEFDDVNGKVLTYSAQDSIYKVFDLKNYTMLYSISDKHVQEIKISPGIMLLIFTRASSHVPLKILSIEDGTVLKAFNHMLHRNKKVDFIEQFNEKLLVKQENENLQILDVRNAELTEVSRTEFMTPSAFIFLYENQLFLTFRNRTVAVWNFRGELVTSFEDHLLWHPDCNTNNIYITSDQDLIISYCKADSDDSGMEGNAGSINISNILTGKCLAKIRSGNSILKDEECRSAKRPRNQRVRTAVAEALEDITALFYDEERNEIYTGNRQGLVHVWSN

SEQ ID NO: 12038 - protein, 421 aa, Persea americana
DRAFSTSNAQERFRNIRLQEEFDTHDPKGHDYLELPFLKKRSKIIEIVAARDIVFALTQSGVCAAFSRETNQRICFLNVSPDEVIRSLFYNKNNDSLITVSVYASDNFSSLKCRTTRIEYIRRGKPDAGFALFESESLKWPGFVEFDDVNGKVLTFSAQDSVYKVFDLKNYTMLYSISDRNVQEIKISPGIMLLIFGRASSHVPLKILSIEDGTVLKSFNHLLHRNKKVDFIEQFNEKLLVKQENENLQILDVRNHDLTEVSRTEFMTPSAFIFLYENQLFLTFRNRTVAVWNFRGELVTSFEDHLLWHPDCNTNNIYITSDQDLIISYCKADSDDSSLEGNAGSINISNILTGKCLAKIRASNCSPKDDCCCCSKKRTYASRIRNTVAEALEDITALFYDEDRNEIYTGNRQGLVHVWSN

SEQ ID NO: 12039 - protein, 451 aa, Ricinus communis
MDGSRKISVSPRPCSGRRVLAKKRGIGGIDNKFVNSVNKLHRREICSKRHRAFTVTDAQDRFRNIRLQEEYDTHDPKGHCSMVLPFLRKRSKIIEIVAARDIVFALAQSGVCAAFNRETNQRICFLNVTPDEVIRSLFYNKNNDSLITVSAYASDNFSSLKCRSTRIEYIRRGKPDAGFALFESESLKWPGFVEFDDVNGKVLTYSAQDSPGIMLLIFTKASSHVPLKILSIEDGTVLKSFNHLLHRNKKVDFIEQFNEKLLVKQENENLQILDVRNFELTEVSRTEFMTPSAFIFLYENQLFLTFRNRTVAVWNFRGELVTSFEDHLLWHPDCNTNNIYITSDQDLIISYCKADSDDHLSEGIAGSINISNILTGKCLAKIKASNSFSSECSCSGNFSGCCNKSNKHMHNSRIRSTAAEALEDITALFYDEERNEIYTGNRHGLVHVWSN

SEQ ID NO: 12040 - protein, 253 aa, Centaurea maculosa
SMQITRIEYIQRGKPDAGFPLFESESLKWPGFVEFDDVNGKVLTYSAQDSIYKVFDLKNYTLLYSIADKNVEEIKISPGIMLLIFSRAQSHVPLKILSIEDGTVLKDFNHLLHRNKKVDFIEQFNEKLLVKQENENLQILDVRNAEVKEVGRTEFMTPSAFIFLYENQLFLTFRNRTVSVWNFRGELVTSFEDHMLWHSDCNTNNIYITSEQDLIISFCKDDSDDQWTDGKAGSINISNIWTGKRIGKINSSN

SEQ ID NO: 12041 - protein, 209 aa, Citrus sinensis
  misc_feature (167)..(167): Xaa can be any naturally occurring amino acid
  misc_feature (175)..(175): Xaa can be any naturally occurring amino acid
MFIVLSFVYFTCNSPGIMLLIFNRSSSHVPLKILSIEDGTVLKVFYHLLHRNKKVDFIEQFNEKLLVKQENENLQILDVRNAELMEVSRTEFMTPSAFIFLYENQLFLTFRNRTVAVWNFRGELVTSFEDHLLWHPDCNTNNIYITSDQDLIISYCKAEPEDQWMEXSAGSINVXSILTGKCLAKINATNCSPQVDDELRSSSTGKPRK

SEQ ID NO: 12042 - protein, 212 aa, Vitis vinifera
KPEEGFALFESESLKWPGFVEFDDVNGKVLTYSAQDSIYKVFDLKNYVMLYSISDENVQEIKISPGIMLLIFNRATSHVPLKILSIEDGTVLKDFNHLLHRNKKVDFIEQFNEKLLVKQENENLQILDVRNTELKEVNRTEFMTPSAFIFLYENQLFLTFRNRTVAVWNFRGELVTSFEDHLLWHPDCNTNNIYITSDQDLIISYCKADSSD

SEQ ID NO: 12043 - protein, 232 aa, Liriodendron tulipifera
RGKPDAGFALFESESLKWPGFVEFDDVNGKVLTYSAQDSIYKVFDLKNYTMLYSISDKHVQEIKISPGIMLLIFNRASSHVPLKILSIEDGTVLKDFNHLLHRNKKVDFIEQFNEKLLVKQENENLQILDVRNSELTEVSRTEFMTPSAFIFLYENQLFLTFRNRTVAVWNFRGELVTSFEDHLLWHPDCNTNNIYITSDQDLIISYCKADSDDSSPEGNAGSINISNILDG

SEQ ID NO: 12044 - protein, 462 aa, Pseudotsuga menziesii
MDVKKISASPRPSFGRRVVAGKRRRVDECHNCVKKLQRREIGSIGNRAFNSTNAQEKFRNFQLQEEFDTYDPKAHWFLKLQFLKKRSKIIEIVAARDIIFALAQSGVCAAFSRETNRKVCFLNISPDEVIRSLFYNKNNESLITVSVYASDNFSSLKCRTTPIEYIRRGKPDAGFALFESESLKWPGFVEFDDVNGKVLTYSAQDGIYKVFDLKNYTMLYSISDEQVQEIKISPGIMLLIFERTASHVPLKILSIEDGTVLKSFNHLLHRNKKVDFIEQFNEKLLVKQENENLQILDVRNAQLTEVSRTEFMTPSAFIFLYENQLFLTFRNRTVAVWNFRGELVTSFEDHLLWHPDCNTNNIYITSDQDLIISYCKAHPDGSDEEENVGSINMSNILTGKCLAKIRANDPNVRISPRNRPNASTIRSTVQEALEDITALFYDEERNEIYTGNRHGLIHVWSN

SEQ ID NO: 12045 - protein, 462 aa, Abies balsamea
MEGKRVAARPRPCGGRRVVAAKRQRVDASANCVRKLQRREIGTSGNRAFNITNSQEKFRNFQLQEEFDTYDPKAHWFLKLQFLKTRSKIIEIVAARDIVFALAQSGVCAAFSREANKKICYLNISPDEVIRSLFYNKNNDSLITVSVYASDNFSSLKCRTTPIEYIRRGQPDAGFALFESESLKWPGFVEFDDVNGKVLTYSAQDGIYKVFDLKNYTLLYSISDDHVQEIKISPGIMLLIFDRASGHVPLKILSIEDGTVLKAFNHLLHRNKKVDFIEQFNEKLLVKQENENLQILDVRNAQLTEVSRAEFLTPSAFIFLYENQLFLTFRNRTVAVWNFRGELVTSFEDHLLWHPDCNTNNIYITSDQDLIISYCKALPLSSGAEENVGSINISNILTGKCLAKIRANDPNVQISPRNRPNASTIRSTVEEALEDITALFYDEERNEIYTGNWHGLVHVWSN

SEQ ID NO: 12046 - protein, 276 aa, Chelidonium majus
MSNAQERFRNIGLQEEYDTHDPKGHCPMVLPFLKKRSKIIEIVAARDIVFALAQSGVCAAFSRETNQRICFLNVSPDEVIRSLFYNKNNDSLITVSVYASDNFSSLKCRTTRIEYIRRGKPDAGFALFESESLKWPGFVEFDDVNGKVLTYSAQDSVYKVFDLKNYTMLYSISDKHVQEIKISPGIMLLIFTRAGSHVPLKILSIEDGTVLKAFNHLLHRNKKVDFIEQFNEKLLVKQEDENLQILDVRNAELTEVSRMEFMTPSAFISCMRISCS

SEQ ID NO: 12047 - protein, 233 aa, Linum usitatissimum
IMLLIFNRSSSHVPLKILSIEDGTALKSFNHLLHRNKKVDFIEQFNEKLLVKQENENLQILDVRNAELIEVSKTEFMTPSAFIFLYENQLFLTFRNRTVAVWNFRGELVTSFEDHLLWHPDCNTNNIYITSDQDLIISYCKVESEDQWMEANAGSINVSNILTGKCLAKINASNGRPKIDDKSSSSSGSTERLTSMRSTAGEALEDITALFYDEERNEIYTGNRHGLVHVWSN

SEQ ID NO: 12048 - protein, 240 aa, Fraxinus spp
MSVLMKSFVAYFTIKYDSLITVSVYASDNFSSLKCRTTRIEYIRRGKPDAGFPLFESESLKWPGFVEFDDVNGKVLTYSAQDSIYKVFDLKNYTMLYSISDKNVQEIKISPGIMLLIFTKASGHVPLKILSIEDGTVLKSFNHLLHRNKKVDFIEQFNEKLLVKQENENLQILDVRNSELTEVSRTEFMTPSAFIFLYENQLFLTFRNRTVAVWNFRGELVTSFEDHLLWHPDCNTTTFT

SEQ ID NO: 12049 - protein, 202 aa, Castanea mollissima
MLYSISDKHVQEIKISPGIMLLIFTKAISHVPLKILSIEDGTVLKSFNHLLHRNKKVDFIEQFNEKLLVKQENENLQILDVRNFELTEVSRTEFMTPSAFIFLYENQLFLTFRDRTVAVWNFRGELVTSFEDHLLWHPDCNTNNIYITSDQDLIISYCKADSDDPLSEGNGSINISNILTGKCLAKIRASNSFPMENECSCS

SEQ ID NO: 12050 - protein, 299 aa, Citrus sinensis
PRVRSLKWPRFVEFDDVNGKVLTYSAQDSIYKVFDLKNYTMLYSISDKNVQEIKISPGIMLLIFTKASGHVPLKILSIEDGTVLKSFNHLLHRNKKVDFIEQFNEKLLVKQENENLQILDVRNFELTEVSRTEFMTPSAFIFLYENQLFLTFRNRTVAVWNFRGELVTSFEDHLLWHPDCNTNNIYITSDQDLIISYCKADSDDPLAEGNAGSINISNILTGKCLAKIRASNGLPAENECSCSGDYSSGSCNVKKHSHASRIRSTVAEALEDITALFYDEDRNEIYTGNRHGLVHVWSN

SEQ ID NO: 12051 - protein, 436 aa, Tropaeolum majus
VDGFVNSVKKLLRREISSKRDRAFTMTDAQERFRNIHLQEEYDTLDPSDECTVVLPFLRKRSKIIEIVAAHDIVFALAQSGVCAAFSRDINQRICFLNVTPDEVIRSLFYNKNNDSLITVSVYASDNFSSLKCRSTRIEYIRRGKPDAGFALFESESLKWPGFVEFDDVNGKVLTYSAQDSIYKVFDLKNYTMLYSISDKNVQEIKISPGIMLLIFAKASSHVPLKILSIEDGTVLKSFNHLLHRNKKVDFIEQFNEKLLVKQENENLQILDVRNFEQTEVSRTEFMTPSAFIFLYENQLFLTFRNRTVAVWNFRGELVTSFEDHLLWHPDCNTNNIYITSDQDLIISYCKADSDDQLSEGNAGSINISNILTGKCLAKVKASNSAPVQDACNRASKRVRSSVAEALEDITALFYDEERNEIYTGNRLGLLHVWSN

SEQ ID NO: 12052 - protein, 424 aa, Tropaeolum majus
MTDAQERFRNIRLQEEYDTHDPSDECTMILPFLRKRSKIIEIVAARDIVFALAQSGVCAAFSRDANQRICFLNVTPDEVIRSLFYNKNNDSLITVSVYASDNFSSLKCRSTRIEYIRRGKPDAGFALFESESLKWPGFVEFDDVNGKVLTYSAQDSIYKVFDLKNYTMLYSISDKNVQEIKISPGIMLLIFAKASSHVPLKILSIEDGTVLKSFNHLLHRNKKVDFIEQFNEKLLVKQENENLQILDVRNSELTEVSRTEFMTPSAFIFLYENQLFLTFRNRTVAVWNFRGKLVTSFEDHLLWHPDCNTNNIYITSDQDLIISYCKADSDDPLSEGTAGSINISNILTGKCLAKVRATNNGATEEECRCNEQCRCSSKKQSRTSKRVRSSVAEALEDITALFYDEERNEIYTGNRLGLLHVWSN

SEQ ID NO: 12053 - protein, 263 aa, Nuphar advena
TYSAQNSIYKVFDLKNYKLLYSISDEHVQEIKISPGIMLLIFTRASGHVPLKILSIEDGTVLKSFNHLLHRNKKVDFIEQFNEKLLVKQENENLQILDVRNAQLTEVSSTEFMTPSAFIFLYENQLFLTFRNRTVAVWNFRGELVTSFDDHLLWHPNCNTNNIYITSDQDLIISYCKVDPDDSSVEGNAGSINISNILTGKCLAKIRACDPNVTISHKEQANASKIWSTVAEALEDITALFYDEDRNEIYTGNGHGLVHVWSN

SEQ ID NO: 12054 - protein, 259 aa, Quercus alba
MLYSISDKHVQEIKISPGIMLLIFTKAISHVPLKILSIEDGTVLKSFNHLLHRNKKVDFIEQFNEKLLVKQENENLQILDVRNFELTEVSRTEFMTPSAFIFLYENQLFLTFRDRTVAVWNFRGELVTSFEDHLLWHPDCNTNNIYITSDQDLIISYCKADSDDPLSEGNAGSINISNILTGKCLAKIRASNSFPMENECSCSGNCCGSSCALKKQSPASRIRSTVAEALEDITALFYDEERNEIYTGNRHGLVHVWSN

SEQ ID NO: 12055 - protein, 121 aa, Sequoia sempervirens
MEAKKIGASPRPCSGRRVVAGKRQRIGDTTNCVRKLQRREIGTSGNRAFNISNAQEKFRNFQLQEEFDTYDPKAHWFLKLQFLKKRSKIIEIVAARDIVFALAQSGVCAAFSREATKNNAS

SEQ ID NO: 12056 - protein, 277 aa, Solanum phureja
LTELFSSIYKVFDLKNYTMLYSISDKNVQEIKISPGIMLLIFTKASGHVPLKILSIEDGTVLKSFNHLLHRNKKVDFIEQFNEKLLVKQENENLQILDVRNSELTEVSRTEFMTPSAFIFLYENQLFLTFRNRTVAVWNFRGELVTSFEDHLLWHPDCNTNNIYITSDQDLIISYCKADSDDPLSEGNAGSINISNILTGKCLAKIKATSGKATDDCNASGGVPGKKSYNSNKRVQDSRIRSTVAEALEDITALFYDEERNEIYTGNRLGLVHVWSN

SEQ ID NO: 12057 - protein, 239 aa, Picea glauca
DEQVQEIKISPGIMLLIFERTAGHVPLKILSIEDGTVLKSFNHLLHRNKKVDFIEQFNEKLLVKQENENLQILDVRNAQLTEVSRTEFMTPSAFIFLYENQLFLTFRNRTVAVWNFRGELVTSFEDHLLWHPDCNTNNIYITSDQDLIISYCKAHPDGSDEEENVGSINMSNILTGKCLAKIRANDPNVRISPRNRPNASTIRSTVQEALEDITALFYDEERNEIYTGNRHGLIHVWSN

SEQ ID NO: 12058 - protein, 311 aa, Picea glauca
NFSSLKCRTTPIEYIRRGQPDAGFALFESESLRWPGFVEFDDVNGKVLTYSAQDGIYKVFDLKNYTLLYSISDEHVQEIKISPGIMLLIFDRASGHVPLKILSIEDGTVLKAFNHLLHRNKKVDFIEQFNEKLLVKQENENLQILDVRNAQLTEVSRAEFLTPSAFIFLYENQLFLTFRNRTVAVWNFRGELVTSFEDHLLWHPDCNTNNIYITSDQDLIISYCKALPLSSGAEENVGSINISNILTGKCLAKIRANDPNVQISPRNRPNASTIRSTVEEALEDITALFYDEERNEIYTGNWHGLVHVWSN

SEQ ID NO: 12059 - protein, 254 aa, Juglans hindsii x Juglans regia
GQDSIYKVFDLKNYTMLYSISDKHVQEIKISPGIMLLIFTKSSSHVPLKILSIEDGTVLKSFNHLLHRNKKVDFIEQFNEKLLVKQENENLQILDVRNFELTEVSRTEFMTPSAFIFLYENQLFLTFRNRTVAVWNFRGELVTSFEDHLLWHPDCNTNNIYITSDQDLIISYCKADSDDPLSEGNAGSINISNILTGKCLAKVRASNSFPVENECSCSDHYCGSSCALKNQTHASRIRSTVAEALEDITALFYD

SEQ ID NO: 12060 - protein, 270 aa, Zostera marina
FDDVNGKVLTYSAQDSIYKVFDLRNYSLLYSISDKNVQEIKISPGIMLLIFTRATSHVPLKILSIEDGTLLKSFNHLLHRNKKVDFIEQFNEKLLVKQENENLQIVDVRNSQLTEVSRTEFMTPSAFIFLYENQLFLTFRNRTVSVWNFKGELVTSFEDHLLWHPDCNTNNIYITSDQDLIISYCKADSDVPSVVDGAIAGSINISNILTGKCLAKILASNSKRRKNKAHAEFQCTVVQALEDITALYYDEERNEIYTGNMQGLVHVWSN

SEQ ID NO: 12061 - protein, 484 aa, Ambrosia trifida
MDGRRITASPRPCNGRRVVAKKRRRGGAAAAADADSMNSVKKLQRREICSKRDRGFRMSDAHDRFRNIRLQEEYDTHDPKGHCSMVLPFLKKRSKIIEIVAAHDIVFALAQSGVCAAFSRDTNQRICFLNVSPDEVIRSLFYNKNNDSLITVSVYASDSFSSLKCRTTRIEYIRRGQPDAGFALFESESLKWPGFVEFDDVNGKVLTFSAQDSIYKVFDLKNYTMLYSIADKNVQEIKISPGIMLLIYNKASSHVPLKILSIEDGTVLKSFNHLLHRNKKVDFIEQFNEKLLVKQENENLQILDVRNCDLTEVSRTEFMTPSAFIFLYENQLFLTFRNRTVAVWNFRGELVTSFEDHLLWHPDCNTNNIYITSDQDLIISYCKTKSDDSPTEGNEGSINISNILTGKCLAKIKAKRGVPLDECTCSDANTSRSCKCTSRKRVRASRITSSVTEALEDITALFYDEERNEIYTGNRLGLVHVWSN

SEQ ID NO: 12062 - protein, 403 aa, Cannabis sativa
MVLPFLRKRSKIIEIVAARDIVFALAQSGVCAAFSRESNQRICFLNVSPDEVIRSLFYNKNNDSLITVSVYASDNFSSLKCRSTRIEYIRRGKPDAGFALFESESLKWPGFVEFDDVNGKVLTYSAQDSIYKVFDLKNYTMLYSISDKNVQEIKISPGIMLLILTKASGHVPLKILSIEDGTVLKSFNHLLHRNKKVDFIEQFNEKLLVKQENENLQILDVRNFELTEVSRTEFMTPSAFIFLYENQLFLTFRNRLVAVWNFRGELVTSFEDHLLWHPDCNTNNIYITSDQDLIISYCKADSDDPLSEGSAGSINISNILTGKCLAKIRASNSTPLESEGCCSDKCCVSGSGGNCKSKKRTQAARTRSTVAEALEDITALFYDEERNEIYTGNRHGLVHVWSN

SEQ ID NO: 12063 - protein, 327 aa, Cirsium arvense
MCDAQERFRNIHLQEEYDTHDPKGHCSMVLPFLKKRSKIVEIVAARDIVFALAQSGICAAFSRETNQRICFLNVSPDEVIRSLFYNKNNDSLITVSVYASDSFSSLKCRTTGIEYIRRGKPDAGFALFESESLKWPGFVEFDDVNGKVLTFSAQDSIYKVFDLKNYMMLYSISDKNVQEIKISPGIMLLIFNKASGHVPLKILSIEDGTVLKTFNHLLHRNKKVDFIEQFNEKLLVKQENENLQILDVRNSELTEVSRTEFMTPSAFIFLYENQLFLTFRNRTVAVWNFRGELVTSFEDHLLWHPDCNTNNIYITSDQDLYHLLLQS

SEQ ID NO: 12064 - protein, 293 aa, Cirsium arvense
MATSSGSGNSRPLPQCGGRRRVVATKKRDLTNLLSVNNSVNKIQRREISSKRHRSFTNTNSIHRFRNIRLTEQYDTHDPKGHSSFVLPFLMKRAKVIEIVAARGIVFALASSGVCAAFSRDTNKRICFLNIFPDEVIRSLFYNKNNESLITVSVYASDNFSSLKCRSTRIEYIQRGKPDAGFPLFESESLKWPGFVEFDDVNGKVLTYSAQDSIYKVFDLKNYTLLYSIADKNVEEIKISPGIMLLIFSRAISHVPLKILSIEDGTVLKDFNHLLHRNKKVDFIEQFNEKASC

SEQ ID NO: 12065 - protein, 436 aa, Cirsium arvense
MDGRRITASPRPCNGRRVVAKKRPRGGVDGFVNSVKKLQRREICSKRDRSFSMCDAQERFRNIRLQEEYDTHDPKGHCSMVLPFLKKRSKIVEIVAARDIVFALAQSGICAAFSRETNQRICFLNVSPDEVIRSLFYNKNNDSLITVSVYASDSFSSLKCRTTGIEYIRRGKPDAGFALFESESLKWPGFVEFDDVNGKVLTFSAQDSIYKVFDLKNYMMLYSISDKNVQEIKISPGIMLLIFNKASGHVPLKILSIEDGTVLKTFNHLLHRNKKVDFIEQFNEKLLVKTRERESPEFLMFVNSELTEVSRTEFMTPSAFIFLYENQLFLTFRNRTVAVWNFRGELVTSFEDHLLWHPDCNTNNIYITSDQDLIISYCKADSDDPLTEGNAGSINISNILTGKCLAKVKAMEGTKLDDCICSGQRRCKCKKRVGSR

SEQ ID NO: 12066 - protein, 466 aa, Flaveria ramosissima
MASSGVSGSSRPSPHCGGRRRVVATKKRDWGNWLSVNNSVRKIHRREISSKRHRSLSINNSVHRFRNIRLTGQYDTHDPKGQSSFVLPFLMKRAKVIEIVAAHGIVFALASSGVCAAFSRDTNKRICLLNIFPDEVIRSLFYNKNNNSLITVSVYASDNFSSLKCRSTRIEYIQRGQPDAGFPLFESESLKWPGFVEFDDVNGKVLTYSAQDSIYKVFDLKNYTLLYSITDKDVEEIKISPGIMLLIFTRAQSHVPLKILSIEDGTVLKDFNHLLHRNKKVDFIEQFNEKLLVKQENENLQILDVRNAEVKEVGRTEFMTPSAFIFLYENQLFLTFRNQTVSVWNFRGELLTSFEDHELWHSDCNTNNIYITSDQGLIISFCKGDSNDQRISGKAGSINISNIWTGKCVAKINASNATLSEDKKQRMIENHMVADALEEITALYFDEERNEIYTGNNRGLVHVWSN

SEQ ID NO: 12067 - protein, 466 aa, Flaveria ramosissima
MASSGVSGSSRPPPHCGGRRRVVATKKRDWGNWLSVNNSVRKIHRREISSKRHRSLSINNSVHRFRNIRLTEQYDTHDPKGQSSFVLPFLMKRAKVIEIVAAHGIVFALASSGVCAAFSRDTNKRICFLNIFPDEVIRSLFYNKNNNSLITVSVYASDNFSSLKCRSTRIEYIQRGQPDAGFPLFESESLKWPGFVEFDDVNGKVLTYSAQDSIYKVFDLKNYTLLYSITDKDVEEIKISPGIMLLIFTRAQSHVPLKILSIEDGTVLKDFNHLLHRNKKVDFIEQFNEKLLVKQENENLQILDVRNAEVKEVGRTEFMTPSAFIFLYENQLFLTFRNQTVSVWNFRGELLTSFEDHELWHSDCNTNNIYITSDQGLIISFCKGDSNDQRISGKAGSINISNIWTGKCVAKINASNATLSEDKKQRMIENHMVADALEEITALYFDEERNKIYTGNNRGLVHVWSN

SEQ ID NO: 12068 - protein, 265 aa, Flaveria ramosissima
MLYSISDKNVQEIKISPGIMLLIYNKASSHVPLKILSIEDGTVLKSFNHLLHRNKKVDFIEQFNEKLLVKQENENLQILDVRNSDLTEVSRTEFMTPSAFIFLYENQLFLTFRNRTVAVWNFRGELVTSFEDHLLWHPDCNTNNIYITSDQDLIISYCKTKSDDSPTEGNEGSINISNILTGKCLAKIKGKNDVPLDECSCSGNGINMKSSSRSCKCTSRKRIQASRITSSVTEALEDITALFYDEERNEIYTGNRLGLVHVWSN

SEQ ID NO: 12069 - protein, 376 aa, Flaveria ramosissima
MKRAKVIEIVAAHGIVFALASSGVCAAFSRDTNKRICFLNIFPDEVIRSLFYNKNNNSLITVSVYASDNFSSLKCRSTRIEYIQRGQPDAGFPLFESESLKWPGFVEFDDVNGKVLTYSAQDSIYKVFDLKNYTLLYSITDKDVEEIKISPGIMLLIFTRAQSHVPLKILSIEDGTVLKDFNHLLHRNKKVDFIEQFNEKLLVKQENENLQILDVRNAEVKEVGRTEFMTPSAFIFLYENQLFLTFRNQTVSVWNFRGELLTSFEDHELWHSDCNTNNIYITSDQGLIISFCKGDANDQRISGKAGSINISNIWTGKCVAKINASNATLSEDKKQRMIENHMVADALEEITALYFDEERNEIYTGNNRGLVHVWSN

SEQ ID NO: 12070 - protein, 462 aa, Pinus pinaster
MEGKRIAASPRPCSGRRIVAAKRQRVDASANCVRKLQRREIGTSGNRAFNITNSQEKFRNFQLQEEFDTYDPKAHWFLKLQFLKKRSKIIEIVAARDIVFALAQSGVCAAFSREANKKICYLNISPDEVIRSLFYNKNNDSLITVSVYASDNFSSLKCRTTPIEYIRRGQPDAGFALFESESLKWPGFVEFDDVNGKVLTYSAQDGIYKVFDLKNYTLLYSISDEHVQEIKISPGIMLLIFDRASGHVPLKILSIEDGTVLKAFNHLLHRNKKVDFIEQFNEKLLVKQENENLQILDVRNTQLTEVSRAEFLTPSAFIFLYENQLFLTFRNRTVAVWNFRGELVTSFEDHLLWHPDCNTNNIYITSDQDLIISYCKALPLSSGAEENVGSINISNILTGKCLAKIRANDPNVQISPRNRPNASTIRSTVEEALEDITALFYDEERNEIYTGNWHGLVHVWSN

SEQ ID NO: 12071 - protein, 164 aa, Olea europaea
MTPSAFIFLYENQLFLTFRNRTVAVWNFRGELVTSFEDHLLWHPDCNTNNIYITSDQDLIISCCKADSDDPLSEGNAGSINISNILTGKCLAKIKATNGSLMDDCSRSASCGGKICNSRKHVQASRIRSTVTDALEDITALFYDEDRNEIYTGNRFGLVHVWAN

SEQ ID NO: 12072 - protein, 188 aa, Trigonella foenum-graecum
MEGSSGRRITVSPRPCCGRRVRVDAKKKTGRGGRTVDGFVNSVKKLQRREISSKRDRAFSMTDAQERFRNIRLQEEYDTHDPKGPSSVVLPFLRKRSKIIEIVAAQDIVFALAQSGVCAAFSRETNQRICFLNVSPDEVIRSLFYNKNNDSLITVSVYASDSYSSLKCRSTRIEYIRRGKPDAGFALF

SEQ ID NO: 12073 - protein, 323 aa, Trigonella foenum-graecum
SVYASENFSSLKCRSTRIEYIRRAKPDAGFPLFQSESLKWPGFVEFDDVNAKVLTYSAQDSIYKVFDLKNYTMLYSISDRNVQEIKISPGIMLLIFNRASGHIPLKIISIEDGTVLKAFNHLLHRNKKVDFIEQFNEKLLVKQENENLQILDVRSSELMEVSRTEFMTPSAFIFLYENQLFLTFRNRTVSVWNFRGELVTSFEDHLLWHPECNTNNIYITSDQDLIISYCKADSEDQWMEANAGSINVSNILTGKCVAKINAANCIAKVDDCSNTCSCKRIDSSQIKSSVAEALEDITALFYDEDRNEIYTGNRHGFVHVWSN

SEQ ID NO: 12074 - protein, 187 aa, Tripterygium wilfordii
QRREISSKRDRAFTVSNAQERFRNMRLTVEYDTHDPKGQCSVVLPFLGKRTKVIEIVAARDIIFALAHSGVCAAFSRETNERICFLNVSPDEVIRSLFYNKNNDSLITVSVYASDNFSSLKCRSTRIEYIRRGKSDAGFALFESESLKWPGFVEFDDVNGKVLTYSAQDSIYKVFDLEKLHHALLYI

SEQ ID NO: 12075 - protein, 157 aa, Vinca minor
MDGRRITASPRPCSERRVAAKKRPRGGMDGFVNSVKKLQRREISSKRDRAFSMSDAQERFRNIRLQEEYDTHDPKGKITMVLPFLRKRSKIIEIVAARDIVFALVQSGICAAFSRETNERICFLNTCPDEVIEACFTIRTTIHSSLFQFMLLIISAR

SEQ ID NO: 12076 - protein, 1478 aa, Malus domestica
MSDAQERFRNIRLQEEYDTHDPKGHCAMVLPFLRKRSKIIEIVAARDIVFALAQSGVCAAFSRETNQRICFLNVSPDEVIRSLFYNKNNDSLITVSVYASDNFSSLKCRSTRIEYIRRGKPDAGFALFESESLKWPGFVEFDDVNGKVLTYSAQDSIYKVFDLKNYTMLYSISDKNVQEIKISPGIMLLIFTKASSHVPLKILSIEDGTVLKSFNHLLHRNKKVDFIEQFNEKLLVKQENENLQILDVRNFEMTEVSRTQFMTPSAFIFLYENQLFLTFRNRTVAVWNFRGELVTSFEDHLLWHPDCNTNNIYITSDQDLIISYCKADSDDPLSEGNAGSINISNILTGKCLAKIRATNNAEKECTCSGESCGSSCNSKKRALSSRIRSTVAEALEDITALFYDEERNEIYTGNRLGLVHVWLLCFGSVVSALRMDAKIDANASLDYAEFQIFPSQNRYEALVSSDGEVEKLAGGTLEPLLPHLPEVNELHRKGTNASLTLRLPKSLHGAAWFTKSTFTRFLQITGSPEIMHTITATEEEISQLEEARKFHVSLYGQPDAIGICAVRNELLRALDLRLTALKRELTTAIEKASHSSFNSKEISNLANFSQHFGTTDFRNTLFKILEQYQQSKSGDPQNDDKCGNFGIANVDKTDGSAQISKPMNFDTPVKYSVSPAKAAQVERQSSTESRESSESSDEEQTSAERSRSLMRSATPRRSASPMRRIQIGRTGSRRAAALTIKSLNYFPSREKPFSEEGEPEQSNKKSESNALRMSVQDAISLFESKQRDQAAADAQKRSSLTNISTSTNKAVLRRWNSSLGEASTQCQSEIVSGDRVPMTPNDIPNDEMPTSSEEVKPESDLLPTDQSTIEAPKPAVNEGNFEKKLSSPIDNEADSNVTPGEKSNQKSTASMEWTREREAELNRMLMKMMESKPIKPVKPVKPVKPVKSTKPQATRNQSLPSEQRGGFYDHYKEKRDEKLRGENSRKRAEKEAQFKAMQRILDERKAEMSSTKANDIDKKSAMQKPQKSLGKVSQPANPRKENAKPSVTKKASPRTSPLPATRKSWPSTPTPRATGASPARTPVGVSSTSTTPTRQKPKPTPPSTKVERPLQRQRNVKESVSTNDRSSKGVNEKQQQAVKKSGKTTKPKVVTTSGDYSDIIPAKHSKVTKKSSVVPVESKPFLRKGSRTSPGVGPVVNKIRTSPHSEESLGNSTNMIETQEDEVLGSASDPVSQHQEPDVVSVGLSNDAVEPEALVNDSLTCSETQHVDPVSPDRNDHLKNVAESSLQVQAEEESTISPSAWVEIEEHQAMSPGNNGSSQVTTSANVAPAGLSSPRVRHSLSQMLQEEINGPDNIEWGNAENPPAIVFQKDAPKGLKRLLKFARKSKGDGNLTDWSSPPVFSEGEDDVDSVLRKASLHTRNYEPYSTQSNISRFDDQSSSHKSQENRDAAAGPATKAATRSFFSLSAFRGSKPNEMKFR

SEQ ID NO: 12077 - protein, 255 aa, Malus domestica
KISPGIMLLIFTKASSHVPLKILSIEDGTVLKSFNHLLHRNKKVDFIEQFNEKLLVKQENENLQILDVRNFEMTEVSRTQFMTPSAFIFLYENQLFLTFRNRTVAVWNFRGELVTSFEDHLLWHPDCNTNNIYITSDQDLIISYCKADSDDPLSEGNAGSINISNILTGKCLAKIRATNNAEKECICSGEACGSSCNSKKRSLSSRIRSTVAEALEDITALFYDEERNEIYTGNRLGLVTYGLTNSFSKFILHVH

SEQ ID NO: 12078 - protein, 480 aa, Artemisia annua
TASPRPCNGRRVVAKKRRRGGCGEGFLNSVKKLQRREICSRRDRSFSMCDAQERFRNIRLQEEYDTHDPKGHCSMVLPFLKKRSKIVEIVAARDIVFALAQSGICAAFSRETNQRICFLNVSPDEVIRSLFYNKNNDSLITVSVYASDSFSSLKCRTTGIEYIRRGKPDAGFALFESESLKWPGFVEFDDVNGKVLTFSAQDSIYKVFDLKNYMMLYSISDKNVQEIKISPGIMLLIFNKASGHVPLKILSIEDGTVLKTFNHLLHRNKKVDFIEQFNEKLLVKQENENLQILDVRNSELTEVSRTEFMTPSAFIFLYENQLFLTFRNRTVAVWNFRGELVTSFEDHLLWHPDCNTNNIYITSDQDLIISYCKADSDESETEGNAAGSINISNILTGKCLAKVKAMNGAIIDDCLCSSINKASGSSSKRCTCNSKQRIQGRRITSSVSEALEDITALFYDEERNEIYTGNRLGLVHVWSN

SEQ ID NO: 12079 - protein, 460 aa, Ceratodon purpureus
MEKARMQSSPRPTCGRRIVAGKRPRPDDSKNCVRKLLKREISRAGNWAFNRTNSQEKFRNFHLQEEFDTHDPKAHHFLKLPFLKKRSRIVEIVAARDTVFALTHSGICAAFSRDTNKRICFLNISADEVIRSLFYNKNNDSLITVSVYASDNFSSLKCRTTPIEYIRRGQPDAGFPLFESESLRWPGFVEFDDVNGKVLTYSAQDRIYKVFDLKNYTMLYSISDEHVQEIKISPGIMLLIFDRAQSHVPLKILSIEDGSVLKAFNHLLHRNKKVDFIEQFNEKLLVKQENENLQILDVRNSQLTEVSRTEFMTPSAFIFLYENQLFLTFRNRTVAVWNFRGELVTSFEDHLLWYPDCNTNNIYITSEQDLIISYCKAHPDNSAEEVGSINISNILTGKCLAKIRADDPSVGISPRTRANSSNIRSSVQEALEDVTALFYDEERNEIYTGNRHGLVHVWSN

SEQ ID NO: 12080 - protein, 192 aa, Cryptomeria japonica
DAGFALFESESLKWPGFVEFDDVNGKVLTYSAQDGIYKVFDLKNYTMLYSISDEHVQEIKISPGIMLLIFDRASGHVPLKILSIEDGTVLKAFNHLLHRNKKVDFIEQFNEKLLVKQENENLQILDVRNAQLTEVSRTEFMTPSAFIFLYENQLFLTFRNRTVAVWNFEESWLHHLKTICCGIQIVTQITYI

SEQ ID NO: 12081 - protein, 358 aa, Cycas rumphii
  misc_feature (59)..(59): Xaa can be any naturally occurring amino acid
  misc_feature (190)..(190): Xaa can be any naturally occurring amino acid
MDGRRVSVSPRPCSGRRVVAGKRQRVDDFSNCVRKLQRREIGTSGNRAFNITNAQEKFXNFQLQEEFDTHDPKAHWFLKLQFLKKRSKIIEIVAARDIVFALAQSGVCAAFSREANKKICFLNISPDEVIRSLFYNKNNDSLITVSVYASDNFSSLKCRTTPIEYIRRGQPDAGFALFESESLKWPGFVXFDDVNGKVLTYSAQDGIYKVFDLKNYTMLYSISDEHVQEIKISPGIMLLIFDRASGHVPLKILSIEDGTVLKAFNHLLHRNKKVDFIEQFNEKLLVKQENENLQILDVRNTQLTEVSRTEFMTPSAFIFLYENQLFLTFRNRTVAVWNFRGELVTSFEDHLLWHPDCN

SEQ ID NO: 12082 - protein, 462 aa, Gnetum gnemon
MEPRKVSSSPRPSSGRRVVAGKRRRLDCSQNCVRKLQRREIGTVGNRAFNSTNAQEKFRNFQLQEEFDTYDPKASWFLKLQFLKKRSKIIEIVAARDIIFGLAQSGVCAAFSREANKKVCFLNISPDEVIRSLFYNKNNESLITVSVYASDNFSSLKCRTTPIEYIRRGKPDAGFALFESESLKWPGFVEFDDVNGKVLTYSAEHKIYKVFDLKNYNMLYSISDEQVQEIKISPGIMLLIFERTASHVPLKILSIEDGTVLKSFNHLLHRNKKIDFIEQFNEKLLVKQENENLQILDVRNAQLTEVSRTEFMTPSAFIFLYENQLFLTFKNRTVAVWNFRGELVTSFEDHLLWHPDCNTNNIYITSDQDLIISYCKAHPQGSDEEENVGSINISNILTGKCLAKIRANDPNVRVSPRNRPNASFIRSTVQDALEDITALFYDEERNEIYTGNRHGLIHVWSN

SEQ ID NO: 12083 - protein, 138 aa, Ipomoea nil
EIKISPGIMLLIFTKASAYVPLKILSIEDGTVLKSFNHLLHRNKKVDFIEQFNEKLLVKQENENLQILDVRNSELTEVSRTEFMTPSAFIFLYENQLFLTFRNRTVAVWNFRGELVTSFEDHLLWHPDCNTNNIYITS

SEQ ID NO: 12084 - protein, 350 aa, Actinidia deliciosa
  misc_feature (290)..(290): Xaa can be any naturally occurring amino acid
  misc_feature (307)..(307): Xaa can be any naturally occurring amino acid
EFARGFELFYNKNNDSLITVSVYASDNFSSLKCRTTRIEYIRRGKPDAGFALFESESLKWPGFVEFDDVNGKVLTYSAQDSIYKVFDLKNYTMLYSISDKNVQEIKISPGIMLLIFNKASGHVPLKILSIEDGTVLKTFNHLLHRNKKVDFIEQFNEKLLVKQENENLQILDVRNYELREVSKAEFMTPSAFIFLYENQLFLTFRNRTVAVWNFRGELVTSFEDHLLWHPDCNTNNIYITSDQDLIISYCRADSDDLSTEGNAGSINVSNILTGKCLAKIRATTSSPTEXCSCSGRCGGRSCNSKKXIQASGIRSTVAEALEDITALFYDEERNEIYTGNRHGLVHVWSN

SEQ ID NO: 12085 - protein, 477 aa, Medicago truncatula
MTMDERRRGVWSCRRIVATKGESSNNGSKPNIKINNKNIIKKLQTREISPKPHRSFVAATSPHRFQNMRLTHQFDTHDPKHHSSPSPFLPFLMKRTKVVEIVAAKNIVFALAHSGLCAAFSRETNERICFLNICPDEVIRSLFYNKNNDSLITVSVYASENFSSLKCRSTRIEYIKRAKPDAGFPLFQSESLKWPGFVEFDDVNAKVLTYSAQDSIYKVFDLKNYTLLYSISDRNVQEIKISPGIMLLIFNRASGHIPLKIISIEDGTVLKAFNHLLHRNKKVDFIEQFNEKLLVKQENENLQILDVRSSELMEVSRTEFMTPSAFIFLYENQLFLTFRNRTVSVWNFRGELVTSFEDHLLWHPDCNTNNIYITSDQDLIISYCKAESEDQWMEANAGSINVSNILTGKCVAKINAANCISKVDDCSSTCSCKHTDSSQLRSSVAEALEDITALFYDEDRNEIYTGNRHGFVHVWSN

SEQ ID NO: 12086 - protein, 484 aa, Arachis hypogaea
MEGRRISARYSSRRIVASKGGRRRRASSNGSVNHNSIVKTLQSREICPKPHRAFATTTAHQRFSTMRLVQEYDTHDRKPSSTNSSSSSSPSSILPFFMKRSKLVEIVAAKNLVFALCHSGLCAAFSRDTNERVCFLNVSPDEVIRSLFYNKNNDSLITVSVYASENFSSLKCRSTGIEYIRRGRPDDGFPLFESESLKWPGFVEFDDVNGKVLTYSAQDSVYKVFDLKNYTLLYSISDRHVQEIKISPGIMLLIFNRSSGHIPLQILSIEDGTVLKSFNHLLHRNKKVDFIEQFNEKLLVKQENENLQILDVRNAELTEISRTEFMTPSAFIFLYENQLFLTFRNRTVSVWNFRGELVTSFEDHLLWHPDCNTNNIYITSDQDLIISYCRADSDVQWLEGNAAGSINVSNILTGKCLAKINASNSSTKSDECSGTGCSCRRNHSSQIRSTVAEALEDITALFFDEDRNEIYTGNRHGLIHVWSN

SEQ ID NO: 12087 - protein, 254 aa, Capsicum annuum
KNVQEIKISPGIMLLIFTKASGYVPLKILSIEDGTVLKSFNHLLHRNKKVDFIEQFNEKLLVKQESENLQILDVRNSELTEVSRAEFMTPSAFIFLYENQLFLTFRNRTVAVWNFRGELVTSFEDHLLWHPDCNTNNIYITSDQDLIISYCKADPDDPLSEATAGSINISNILTGKCLAKIKATDSRPTDDCSCSTSCKEHGGRSCNAKKRIQASRIRSTVAEALEDITALFYDEEHNEIYTGNSLGLIHVWSN

SEQ ID NO: 12088 - protein, 463 aa, Physcomitrella patens
MESVSKVRMQSSPRPTYGRRIVARKRTRPDDTKNCVRKLLKREISRAGNWAFNRTNSQEKFRNFHLQEEFDTHDPKAHHFLKLPFLKKRSRIVEIVAARDTVFALTHSGICAAFSRDTNKRICFLNIRDDEVIRSLFYNKNNDSLITVSVYASDNFSSLKCRTTPIEYIRRGQPDAGFPLFESESLRWPGFVEFDDVNGKVLTYSAQDRIYKVFDLKNYTMLYSISDEHVQEIKISPGIMLLIFDRAQSHVPLKILSIEDGSVLKAFNHLLHRNKKVDFIEQFNEKLLVKQENENLQILDVRNSQLTEVSRTEFMTPSAFIFLYENQLFLTFRNRTVAVWNFRGELVTSFEDHLLWYPDCNTNNIYITSEQDLIISYCKAHPDNSVEEVGSINISNILTGKCLAKIRADDPSVRISPRARANSSNIRSSVQEALEDVTALFYDEERNEIYTGNRHGLVHVWSN

SEQ ID NO: 12089 - protein, 302 aa, Cajanus cajan
SRESNKRICFLNVSPGEVIRSLFYNKNNDSLITVSVYASDGYSSLKCRSTRIEYIRRGKPDAGFALFESESLKWPGFVEFDDVNGKVLTYSAQDSIYKVFDLKNYTMLYSISDKNVQEIKISPGIMLLIFSKASSHVPLKILSIEDGTVLKSFNHLLYRNKKVDFIEQFNEKLLVKQENENLQILDVRTFELTEVSRSEFMTPSAFIFLYENQLFLTFRNRTVAVWNFRGELVTSFEDHLLWHPDCNTNNIYITSDQDLIISYCKADSDDSLAEGNAGSINVSNILTGKCLAKIRASNSFPV

SEQ ID NO: 12090 - protein, 463 aa, Pseudotsuga menziesii
MEGRRVAVSPRPCSGRRVVAAKRQRVDASANNCVRKLQRREIGTSGNRAFNITNSQEKFRNFQLQEEFDTYDPKAHWFLKLQFLKKRSKIIEIVAARDIVFALSQSGVCAAFSREANKKICYLNISPDEVIRSLFYNKNNDSLITVSVYASDNFSSLKCRTTPIEYIRRGQPDAGFALFESESLKWPGFVEFDDVNGKVLTYSAQDGIYKVFDLKNYTLLYSISDEHVQEIKISPGIMLLIFERASGHVPLKILSIEDGTVLKAFNHLLHRNKKVDFIEQFNEKLLVKQENENLQILDVRNAQSTEVSRAEFLTPSAFIFLYENQLFLTFRNRTVAVWNFRGELVTSFEDHLLWHPDCNTNNIYITSDQDLIISYCKALPLSSGSEENVGSINISNILTGKCLAKIRANDPNVQISPRNRPNASTIRSTVEEALEDITALFYDEERNEIYTGNWHGLVHVWSN

SEQ ID NO: 12091 - protein, 273 aa, Rhizophora mangle
GKVLTYSAQDSIYKVFDLKNYTMLYSISDKHVQEIKISPGIMLLIFNRASSHVHLKILSIEDGTVLKAFNHLLHRNKKVDFIEQFNEKLLVKQENENLQILDVRNALLMEVSKTEFVTPSAFIFLYENQLFLTFRNRTVAVWNFRGELVTSFEDHLLWHPDCNTNNIYITSDQDLIISYCKAESDDQWMEASAGSINVSNILTGKCLAKINASNDSHKGGECSSSSGNSKESHSTIRSTVAEALEDITALFYDEERNEIYTGNRHGLVHVWSN

SEQ ID NO: 12092 - protein, 459 aa, Selaginella moellendorffii
MDSKKLQVSPRPSSGRRIQAGKRPRPDDYCGNSVRKLMRREISRAGNWAFNRTSSQEKFRNFQLQEEFDTHDPKAHRCLKLPFLKKRSKIVEIVAARDIVFALAHSGICAAFSRETNKKICFLNISSDEVIRSLFYNKNNDSLITVSVYASDNFSSLKCRTTPIEYIRRGQPDAGFPLFETESLRWPGFVEFDDVNGKVLTYSAQDRIYKVFDLKNYTMLYSISDEHVQEIKISPGIMLLIFDRAASHVPLKILSIEDGSVLKAFNHLLHRNKKLDFIEQFNEKLLVKQENENLQILDVRNAQLTEVSRTEFMTPSAFIFLYENQLFLTFRNRTVAVWNFRGELVTSFEDHLLWYPDCNTNNIYITSEQDLIISYCKAQGCDEETGSINISNILTGKCLAKIRADDPSVKVSPRCHANSSNIRGSVREALEDVTALFYDEERNEIYTGNRQGLVHVWSN

SEQ ID NO: 12093 - protein, 483 aa, Helianthus annuus
MDGRRITASPRVSTGRRVVAKKRPRGGADAFLNSVKKLQRREICSKRDRSFSMCDAQERFRNIRLQEEYDTHDPKGQCSTVLPFLKKRSKIVEIVAARDIVFALAQSGICAAYSRETSQRICFLNVSPDEVIRSLFYNKNNDSLITVSVYASDSFSSLKCRTTGIEYIRRGKPDAGFALFESESLKWPGFVEFDDVNGKVLTFSAQDSIYKVFDLKNYMMLYSISDKNVQEIKISPGIMLLIFNKASGHVPLKILSIEDGTVLKTFNHLLHRNKKVDFIEQFNEKLLVKQENENLQILDVRNSELTEVSRTEFMTPSAFIFLYENQLFLTFRNRTVAVWNFRGELVTSFEDHLLWHPDCNTNNIYITSDQDLIISYCKADSEDSSTDGNAAAGSINISNILTGKCLAKVKAMDGAMVNDCICSDVVKSSGKRCRCNSKQRAQGRRITSSVSEALEDITALFYDEERNEIYTGNRLGLVHVWSN

SEQ ID NO: 12094 - protein, 90 aa, Ambrosia trifida
MDGRRITASPRVSSGRRVVAKKRPRGSGDGFLNSVKKLQRREICSKRDRSFSMCDAQERFRNIRLQEEYDTHDPKGNALQYCHFSRKGQK

SEQ ID NO: 12095 - protein, 324 aa, Ambrosia trifida
MEGSSSSSRRRRVLATKKRDWTNCLSLNNSLKRIHRREISSKRHRSVSLTNSLHRFKNIRLTEQYDTHDPKGQSSFVLPFLMKRAKVIEIVAAHGIVFALASSGVCAAFSRDTNTRICLLNIFPDEVIRSLFYNKNNDSLITVSVYASDNFSSLKCRSTRIEYIQRGQPDAGFPLFESESLKWPGFVEFDDVNGKVLTYSAQDSIYKVFDLKNYTLLYSITHKDVEEIKISPGIMLLIFARAQSHVPLKILSIEDGTVLKEFNHLLHRNKKVDFIEQFNEKLLVKQENENLQILDVRNAEVKEVAKTEFMTPSAFIFLYENQLF

SEQ ID NO: 12096 - protein, 220 aa, Amorphophallus konjac
MLLIFERASSHVLLKILSIEDGTVLKSFNHLLHRNKKIDFIEQFNEKLLVKQENENLQILDVRNSQLTEVSRKEFTTPSAFIFLYENQLFLTFRNRTVAVWNFRGELVTSFEDHLLWHPDCNTNNIYITSDQDLIISYCKAESDDSADGHAAGSINISNILTGKCLAKIHANSSEKLIHASRFRNTVTEALEDITALYYDEDRNEIYTGNRQGLVHVWSN

SEQ ID NO: 12097 - protein, 140 aa, Arnica chamissonis
MESSSGSSRPPPHCGGRRRVVATKKRDWGNWLSVKNSVKKIHRREISSKRHRSLSITNSVHRFRNIRLTEQYDTHDPKGQSSFVLPFLMKRAKVIEIVAAHGIVFALASSGVCAAFSRDTNKRICFLNIYPDEVIRSLFY

SEQ ID NO: 12098 - protein, 474 aa, Cirsium arvense
MASSTGNGGNRRPPLCGGRRRVVATKKRGWTNPLAVNNTVKKLQRREICSKPHRSSSITKSLHRFCNFRLTERYDIHDPVGQCSLVLPLLMKRAKVIEIVVVHDIVFALASSGVCAAFSRDTNKRICFLNIYPDEVIRSLFYNKNNESLITVSVYASDNFSSLKCRSIRIEYIQRGKPDEGFPLFETESLKWPGFVEFDDVNEKVLTFSAQDSIYKVFDLKNYTLLYSIADQQVEEIKISPGIMLLIFSRAQSHVPLKILSIEDGTVLKDFNHLLHRNKKVDFIEQFNEKLLVKQDNENLQILDVRNAEVKEVASTEFMTPSAFIFLYENQLFLTFRNQTVSVWNFRGELVTSFEDHVLSHPDCNTNNIYITSDQDLIVSFCKADNEPLTDRRGAGSINISNIWTGKCIAKINASNAVSSKQDDEEDGSSSNQRQIEVNMVEEALEDITSLYYDEERNEIYTGNSNGLVHVWSN

SEQ ID NO: 12099 - protein, 151 aa, Cirsium arvense
MLLIYNKVSSHVPLKILSIEDGTVLKSFNHLLHRNKKVDFIEQFNEKLLVKQENENLQILDVRNSDLTEVSRTEFMTPSAFIFLYENQLFLTFRNRTVAVWNFRGELVTSFEDHLLWHPDCNTNNIYITSDQDLIISYCKAESDDPLTEGN

SEQ ID NO: 12100 - protein, 247 aa, Fagopyrum esculentum
MLLIFNKGVSHVPLKILSIEDGTVLKSFNHLIHRNKKVDFIEQFNEKLLVKQENENLQILDVRNSDLREVSRTEFMTPSAFIFLYENQLFLTFRNRTVAVWNFRGELVTSFEDHLLWHSDCNTNNIYITSDQDLIISYCKADADDPKAEGTAGSINVSNILSGKCLAKIKVEKKSDEGEDISSSGSSNGGSGSSSSRRRNSRKRAHASRMGRSVEEALEDITALFYDEERNEIYTGNSHGLLHVWSN

SEQ ID NO: 12101 - protein, 483 aa, Flaveria ramosissima
MEGIGGSRNRRFTTSSSGSNGGSRTPLCSGRRRVVATKRGGWSNPLVVNNTVKKLQQREITSSPHRSASITKSLLRFRNFRLTERYDIHEPVGRCSLVLPLLMRRAKVIEIVVVHNIVFALAGSGVCAAFSRGSNKPICFLNVYPDEVIRSLFYNKNNDSLITVSVYASDNFSSLKCRSIRIEYIQRGKPDEGFPLFETESLKWPGFVEFDDVNEKVLTFSAQDSIYEVFDLKNYTLLYSIADRQVEEIKISPGIMLLIFSRAQSHVPLKILSIEDGTVLKDFNHLLHRNKKVDFIEQFNEKLLVKQDNENLQILDVRNAEVIEVGSTEFMTPSAFIFLYENQLFLTFRNQTVSVWNFRGELVTSFEDHVLSHPDCNTNNIYITSDQDLIVSFCKTNNDQSTHTRAGSINISNIWTGKCIAKINPSTAIPSKDEQEGSSSNTRQVEVNMVEEALEDITALYFDEEHNEIYTGNSNGLVHVWSN

SEQ ID NO: 12102 - protein, 443 aa, Flaveria ramosissima
MEGIGGSRNRRFTTSSSGSSGGSRPPLCGGRRRVVATKRGGWSNPLVVNNTVKKLQQREITSSPHRSASITKSLLRFRNFRLTERYDIHEPVGRCSLVLPLLMRRAKVIEIVVVHNIVFALAGSGVCAAFSRGSNKPICFLNVYPDEVIRSLFYNKNNDSLITVSVYASDNFSSLKCRSIRIEYIQRGKPDEGFPLFETESLKWPGFVEFDDVNEKVLTYSAQDSIYKVFDLKNYTLLYSIADRQVEEIKISPGIMLLIFSRAQSHVPLKILSIEDGTVLKDFNHLLHRNKKVDFIEQFNEKLLVKQDNENLQILDVRNAEVIEVGSTEFMTPSAFIFLYENQLFLTFRNQTVSVWNFRGELVTSFEDHVLSHPDCNTNNIYITSDQDLIVSFCKTNDDHSTRTRAGSINISNIWTGKCIAKINSSTAIRSKDEQEGSSSNTR

SEQ ID NO: 12103 - protein, 274 aa, Flaveria ramosissima
KGHCSMVLPFLRNVKIIEIVAACDIVFALAQSGVCAAFSRETNKRICFLNVSPDEVIRSLFYNKNNDSLITVSVYASDSFSSLKCRTTRIEYIRRGQPDAGFALFESESLKWPGFVEFDDVNGKVLTFSAQDCIYKVFDLKNYTMLYSIADKNVQEIKISPGIMLLIYNKASGHVPLKILSIEDGTVLKSFNHLLHRNKKVDFIEQFNEKLLVKQENENLQILDVRNSVLTEVSRTEFMTPSAFIFLYENQLFFDVQKSDSSCVELSWGTSDFI

SEQ ID NO: 12104 - protein, 450 aa, Vinca minor
MDGFVNSVKKLQRREISSKRDRAFSMSDAQERFRNIRLQEEYDTHDPKGQFTMVLPFLRKRSKIIEIVAARDVVFALAQSGICAAFSRETNERISFLNVSPDEVIRSLFYNKNNDSLITVSVYASDNFSSLKCRTTRIEYIRRGKPDAGFPLFESESLKWPGFVEFDDVNGKVLTYSSQDSIYKVFDLKNYSMLYSISDKNVQEIKISPGIMLLIFTKASGHVPLKILSIEDGTVLKSFNHLLHRNKKVDFIEQFNEKLLVKQDTENLQILDVRNSELTEVSRTEFMTPSAFIFLYENQLFLTFRNRTVAVWNFRGELVTSFEDHLLWHPDCNTNNIYITSDQDLIISYCKADSDDPVSEGNAGSINISNILTGKCLAKIKANNSLPVDDCTCNADCGGKSCNAKKRAKAANMRSSVAEALEDITALFYDEERNEIYTGNRLGLVHVWSN

SEQ ID NO: 12105 - protein, 474 aa, Aquilegia formosa
MDKKSHVRLRVRVTASKRERELIPRTSLLRKFRDSETFNSVKKLQRREIGGLRNICSGASSNAQEKFRNFQLQEEFDTYDPKAHLFLRLQFLKKRSKIIEIVAAKDVIFALAQSGLCAAFSRSSNTRICFLNISPDEVIRSLFYNKNNESLITVSVYASDHFSSLKCRTTPIEYIRRNQLDAGFPLFESESLKWPGFVEFDDVNGKVLTYSAQDGIYKVFDLKNYSFLYSISDKNVQEIKISPGIMLLIFHRAVGYVPLKILSIEDGTVLKSFHHLLHRNKKVDFIEQFNEKLLVKQENENLQILDVRNSELTEVSRTEFMTPSAFIFLYENHLFLTFRNRTVAVWNFRGELVTSFEDHLLWHPDCNTNNIYITSDQDLIISYCKAEEAPDEDGEFGAVGSINMSNILTGKCIAKICSNDPNLRISPRGRMGGRSVIQSTVREALEDVTALFYDEDRNEIYTGNKQGLIHVWSN

SEQ ID NO: 12106 - protein, 231 aa, Centaurea maculosa
MLLIFSRAQSHVPLKILSIEDGTVLKDFNHLLHRNKKVDFIEQFNEKLLVKQDNENLQILDVRNAEVKEVASTEFMTPSAFIFLYENQLFLTFRNQTVSVWNFRGELVTSFEDHVLSHPDCNTNNIYITSDQDLIVSFCKADNEPLTDRRGAGSINISNIWTGKCIAKINASNAVSSKQDDEEDGSSSNQRQIEVNMVEEALEDITSLYYDEERNEIYTGNSNGLVHVWSN

SEQ ID NO: 12107 - protein, 72 aa, Lotus japonicus
NISMLHDGDTCTLFLSCSIYKVFDLKNYTMLYSISDKNVQEIKISPGIMLLIFAKASSHVPLKILSIEDGLF

SEQ ID NO: 12108 - protein, 259 aa, Arachis hypogaea
MLYSISDKNVQEIKISPGIMLLIFAKSSSHVPLKILSIEDGTVLKSFNHLLHRNKKVDFIEQFNEKLLVKQENENLQILDVRTFEITEVSRSEFMTPSAFIFLYENQLFLTFRNRTVAVWNFRGELVTSFEDHLLWHPDCNTNNIYITSDQDLIISYCKADSDDSLSEGNAGSINVSNILTGKCLAKIKASNSSPIVNQCSCGDDCSGSCRNTRKQKHDTKTRSTVAEALEDITALFYDEERNEIYTGNSHGLVHVWSN

SEQ ID NO: 12109 - protein, 318 aa, Capsicum annuum
HEARIEYIRRGKPDAGFALFESESLKWPGFVEFDDVNGKVLTYSAQDSIYKVFDLKNYTMLYSISDKNVQEIKISPGIMLLIFTKASGHVPLKILSIEDGTVLKSFNHLLHRNKKVDFIEQFNEKLLVKQENENLQILDVLNSELTEVSRTEFMTPSAFIFLYENQLFLTFRNRTVAVWNFRGEVVTSFEDHLLWHPDCNTNNIYITSDQDLIISYCKADSDDPLSEGNAGSINISNILTGKCLAKIKATSGKATDDCSASCSVPGRRSCNSNKRVQDSRIRSTVAEALEDITALFYDEERNEIYTGNRLGLVHVWSN

SEQ ID NO: 12110 - protein, 461 aa, Physcomitrella patens
MESMSKVRMSPRPTCGRRIVAGKRPRPDDSKNCVRKLLKREISRAGNWSFNRTNSQEKFRNFHLQEEFDTHDPKAHQFLKLPFLKKRSRIVEIVAARDTVFALTHSGICAAFSRDTNKRICFLNISADEVIRSLFYNKNNDSLITVSVYASDNFSSLKCRTTPIEYIRRGQPGAGFSLFESESLRWPGFVEFDDVNGKVLTYSAQDRIYKVFDLKNYTMLYSISDEHVQEIKISPGIMLLIFDRAQSHVPLKILSIEDGSVLKAFNHLLHRNKKVDFIEQFNEKLLVKQENENLQILDVRNSQMTEVSRTEFMTPSAFIFLYENQLFLTFRNRTVAVWNFRGELVTSFEDHLLWYPDCNTNNIYITSEQDLIISYCKAHPDNSAEEVGSINISNILTGKCLAKIRADDPSVGVSPRTRSNSSNIRSSVQEALEDVTALFYDEERNEIYTGNRHGLVHVWSN

SEQ ID NO: 12111 - protein, 147 aa, Cajanus cajan
IVAARDIVFALAQSGVCAAFSRETNERICLLNVSPDEVIRSLFYNKNNDSLITVSVYASDSYSSLKCRSTRIEYIRRVKPDAGFALFESESLKWPGFVEFDDVNGKVLTYSAQDSIYKVFDLKTILCCTPFQIKMYTKLRSVQGSCC

SEQ ID NO: 12112 - protein, 121 aa, Taxus baccata
MEGKRVSASPRPSSGRRVVAGKRKRSYEYNNCVRKLQRREIGSIGDKAFSSTNSQERFRNFQLQEEFDTYDPKASWFLRLQFLKKRSKIIEIVAARDIIFALAQSGVCAAFSREINKKFAS

SEQ ID NO: 12113 - protein, 469 aa, Ambrosia trifida
MEATGSRNRRITTSSSRRRVVATKNAGWTNPLLPNNTVKKLHRREITSLRHRSASVSNSLHRFRNFRLTERYDMHDPVGQCSMVLPLLMRRAKVIEIVVVHDIVFALASSGVCAAFSRGTNKTICFLNIYPDEVIRSLFYNKNNDSLITVSVYASDNFSSLKCRSIRIEYIQRGKPEEGFPLFETESLKWPGFVEFDDVNEKVLTYSAQDSIYKVFDLKNYALLYSITDRQVEEIKISPGIMLLIFSRGQSHVPLKILSIEDGTVLKDFNHLLHRNKKVDFIEQFNEKLLVKQDNENLQILDVRNAEVKEVGSTEFMTPSAFIFLYENQLFLTFRNQTVSVWNFRGELVTSFEDHVLSHPDCNTNNIYITSDQDLIVSFCKADNDQATDRRAGSINISNIWTGKCIAKINSSNAIPSKDEQEGSSSNTRQVEVNMVEEALEDITALYFDEEHNEIYTGNSNGLVHVWSN

SEQ ID NO: 12114 - protein, 419 aa, Ambrosia trifida
MEATGSRNRRITTSSSRRRVVATKNAGWTNPLLPNNTVKKLHRREITSLRHRSASVSNSLHRFRNFRLTERYDMHDPVGQCSMVLPLLMRRAKVIEIVVVHDIVFALASSGVCAAFSRGTNKTICFLNIYPDEVIRSLFYNKNNDSLITVSVYASDNFSSLKCRSIRIEYIQRGKPEEGFPLFETESLKWPGFVEFDDVNEKVLTYSAQDSIYKVFDLKNYALLYSITDRQVEEIKISPGIMLLIFSRGQSHVPLKILSIEDGTVLKDFNHLLHRNKKVDFIEQFNEKLLVKQDNENLQILDVRNAEVKEVGSTEFMTPSAFIFLYENQLFLTFRNQTVSVWNFRGELVTSFEDHVLSHPDCNTNNIYITSDQDLIVSFCKADNDQATDRRAGSINISNIWTGKCIAKINSSNAIPYKG

SEQ ID NO: 12115 - protein, 438 aa, Cirsium arvense
QRREICSKRDRAFRMCDAQERFRNIRLQEEYDTHDPKGHCSIVLPFLKKRSKIIEIVAARDIVFALAQSGVCAAFSRETNERICFLNVSPDEVIRSLFYNKNNDSLITVSVYASDSFSSLKCRTTRIEYIRRGQPDAGFALFESESLKWPGFVEFDDVNGKVLTFSAQDSIYKVFDLKNYTLLYSISDKSVQEIKISPGIMLLIYNKASGYVPLKILSIEDGTVLKSFNHLLHRNKKVDFIEQFNEKLLVKQENENLQILDVRNSDLTEVSRTEFMTPSAFIFLYENQLFLTFRNRTVAVWNFRGELVTSFEDHLLWHPDCNTNNIYITSDQDLIISYCKAESDDPLTEGNGSINISNILTGKCLAKIKAKDGVPMEECDCGSGSGSSCKCRRPGKRMRREMSSVTEALEDITALFYDEERNEIYTGNRLGLVHVWSN

SEQ ID NO: 12116 - protein, 463 aa, Pteridium aquilinum
METKKKIPSSPRPSSSRRVLAGKRACPADASSNCVKKLLRREISASGNRALNCTNAQEKFRNFHLQEEFDTYDPKGNWFLQLNFLKKRSKIVEIVAAREIVFALAQSGVCAAFSRETNKKICYLNISPDEVIRSLSTQNNDSLITVSVYASDNFSTLKCRTTPIQYIRRGQPDAGFGLFGSESLKWPGFVEFDDVNGKVLTYSAQDKIYKVFDLKNYTPLYSIPDDQVSEIKISPGIMLLIYERAASHVPLKILSIEDGTVLKDFRHLLHRNKKVDFIEQFNEKLLVKQDNENLQILDVRNSQLTEVSRTEFMTPSAFIFLYENQLFLTFRNRTVVVWNFRGELVTSFEDHLLWHPDCNTNNIYITSDQDLIISYCKSHPHECTEEERVGSINISNILTGKCLAKICATDSNVKVSPRERANSSPVQSSVREALEDITALFYDEEKNEIYTGNRHGRVHVWSN

SEQ ID NO: 12117 - protein, 132 aa, Scabiosa columbaria
KNYTMLYSISDKNVQEIKISPGIMLLIFTKASGHVPLKILSIEDGTVLKSFNHLLHRNKKVDFIEQFNEKLLVKQENENLQILDVRNSEQTEVSRTEFMTPSAFIFLYENQLFLTFRNRTVAVWNFRGELVT

SEQ ID NO: 12118 - protein, 165 aa, Valeriana officinalis
YNKNNDSLITVSVYASDNFSSLKCRTTRIEYIRRGKPDAGFALFESESLKWPGFVEFDDVNGKVLTYSAQDSIYKVFDLKNYTMLYSISDKNVQEIKISPGIMLLIFTKLSGHVPLKILSIEDGTVLKSFNHLLHRNKKVDFIEQFNEKLLVKQENENLQILGCA

SEQ ID NO: 12119 - protein, 299 aa, Amaranthus tuberculatus
FALFESESLKWPGFVEFDDVNGKVLTYSAQDSVYKVFDLKNYTMLYSISDKNVQEIKISPGIMLLIFTKGTGHVPLKILSIEDGTVLKSFNHLIHRNKKVDFIEQFNEKLLVKQENENLQILDVRNSELTEVSKTDFMTPSAFIFLYENQLFLTFRNRTVAVWNFRGELVTSFEDHLLWHPDCNTNNIYITSDQDLIISYCKADSDDPVSEGNAGSINVSNILTGKCLAKIRADNCSVLEDDCSCSSSSGSSSKKRIKAARIRSTPAEALEDITALFYDEERNEIYTGNRHGLVHVWSN

SEQ ID NO: 12120 - protein, 352 aa, Musa acuminata
HEKRICFLNISPDEVIRSLFYNKNNDSLITVSVYASDHFSSLKCRTTPIEYIRRNQLDAGYPLFESESLKWPGFVEFDDVNGKVLTYSAQDGTYKVFDLKNYSFLYSICDKDIQEIKISPGIMLLIYQRTQSHVPLKILSIEDGKVLKSFNHLLHRNKKVDFIEQFNEKLLVKQENENLQILDVRNSNLIEVSRTEFMTPSAFIFLYENHLFLTFRNRTVAVWNFRGELVTSFEDHLLWHPDCNTNNIYITSDQDLIISYCKAEDGCDEEGEVPTVGSINMSNILTGKCIAKICPLDPALQITPRKRGDNSRSTIRSTIREALEDVTALFYDEDRNEIYTGNKQGLIHVWSN

SEQ ID NO: 12121 - protein, 304 aa, Phaseolus coccineus
MEGGRRITVSPRPCCGRRIVAAKKRPRAADGFVNSVKKLQRREISSKRDRAFTMSDAQERFRNIRLQEEYDTHDPKGPSTMVLPFLRKRSKIIEIVAARDIVFALAQSGVCAAFSRETNQRICFLNVSPDEVIRSLFYNKNNDSLITVSVYASDGYSSLKCRSTRIEYIRRGKPDAGFALFESESLKWPGFVEFDDVNGKVLTYSAQDSIYKVFDLKNYTMLYSISDKNVQEIKISPGIMLLIFVKASSHVPLKILSIEDGTVLKSFTHLLYRNKKVDFIEQFNEKLLVKQENENLQILDVRTF

SEQ ID NO: 12122 - protein, 228 aa, Cichorium intybus
MLLIFNRGQSHVPLKILSIEDGTVLKDFNHLLHRNKKVDFIEQFNEKLLVKQDNENLQILDVRNAEVREVGSTEFMTPSAFIFLYENQLFLTFRNQTVSVWNFRGELVTSFEDHALSHPDCNTNNIYITSDQDLIVSFCKADNDQLTDRRAGSINISNIWTGKCIAKINSSNAISCKDEEGSSSVNGKRIEVNMVEEALEDITALYFDEDRNEIYTGNSNGLVHVWSN

SEQ ID NO: 12123 - protein, 233 aa, Cichorium intybus
MMLYSISDKNVQEIKISAGIMLMIFNKASGHVPLKILSIEDGTDLKTFNHLLHRNKKVDFIEQFNEKLLVKQENENLQILDVRNSELTEVSRTEFMTPSAFIFLYENQLFLTFRNRTVAVWNFRGELVTSFEDHLLWHPDCNTNNIYITSDQDLIISYCKADSDDPLTQGNAGSINISNILTGKCLAKVKAKNSDGNTSDDCICVSSGAHKRCRCNLKQRMARRRITSSVTEA

SEQ ID NO: 12124 - protein, 221 aa, Cynara scolymus
  misc_feature (8)..(8): Xaa can be any naturally occurring amino acid
  misc_feature (46)..(46): Xaa can be any naturally occurring amino acid
  misc_feature (131)..(131): Xaa can be any naturally occurring amino acid
MNIFPDEXIRSLFYNKNNESLITVSVYASDNFSSLKCRSTQIEYIXRGKPDAGFPLFESESLKWPGFVEFDDVNGKVLTYSAQDSIYKVFDLKNYTLLYSIADKNVEEIKISPGIMLLIFSRALSHVPLKXLSIEDGTVLKDFNHLLHRNKKVDFIEQFNEKLLVKQENENLQILDVRNAEVKEVGRTEFMTPSAFIFLYENQLFLTFRNRLFCLELPREL

SEQ ID NO: 12125 - protein, 264 aa, Elaeis guineensis
VSGLCAAFSRTTNKRICFLNISPDEVIRSLFYNKNNDSLITVSVYASDHFSSLKCRTTPIEYIRRNQLNAGFPLFETESLKWPGFVEFDDVNGKVLTYSAQDGIYKVFDLKNYNFLYSISDKNVQEIKISPGIMLLIFQRTPGYVPLKILSIEDGTVLKSFNHLLHRNKKVDFIEQFNEKLLVKQENENLQILDVRNSVLTEVSRTEFMTPSAFIFLYENHLFLTFRNRTVAVWNFRGELVTSFEDHLLWHPDCNTNNIYITSD

SEQ ID NO: 12126 - protein, 282 aa, Arachis hypogaea
MGRYSHTLHKIAYTRYLTLKTIQCCTPFLIKIVQEIKISPGIMLLIFAKTSSHVPLKILSIEDGTVLKSFNHLLCRNKKVDFIEQFNEKLLVKQENENLQILDVRTFDLTEVSRSEFMTPSAFIFLYENQLFLTFRNRTVAVWNFRGELVTSFEDHLLWHPDCNTNNIYITSDQDLIISYCKADSEDSLTEGNAGSINVSNILTGKCLAKIRASNSFPIENECSCGDDCSGSRCNSKKRKHSSKIRSTVAEALEDITALFYDEERNEIYTGNRHGLVHVWSN

SEQ ID NO: 12127 - protein, 493 aa, Cajanus cajan
MKYDPQQRCFVEVVRMEEKRRGGWCGRRVVASKRGSSDGNVSDNGSNSRSSNISVIKKLQSREISSKPHRAFASATVSHRFRTMRLTHQYDTHDPSKARSSLLPFLMKRTKVVEIVAAKNVVFALYHSGLCAAFSRVTNERICFLNVCHDEVIRSLFYNKNNDSLITVSVYASENFSSLKCRSTKIEYIQRGKPEAGFPLFQSESLKWPGFVEFDDVNGKVLTYSAQDSIYKVFDLKNYTMLYSISDRHVHEIKISPGIMLLIFNRTSGHIPLKIISIEDGTVLKAFNHLLHRNKKVDFIEQFNEKLLVKQENENLQILDVRNAELMEVSRKVFTTPSAFIFLYENQLFLTFRNRTVSVWNFRGELVTTFEDHQLWHTDCNTNNIYITIDQDLIISYCKPDSDDQWMEGNAGSINVSNILNGKCVAKIDARSSSMKAEKCSSSGCSICEQSHSSLLRSSVAEALEDITALFYDEDMNEIYTGNRHGLVHVWSN

SEQ ID NO: 12128 - protein, 487 aa, Helianthus annuus
MDAIGSSSGGSRNRRITTSSSAGNGGSRSPLCGGRRRVVATKNDGWSNPLLANNTVKKLQRREITSNRHRSGAITKSVHRFRNFRLTERYDMHDPVGQCSLVLPLLMRRAKVIEIVVVHDIVFALASSGVCAAFSRGTNKTICFLNIYPDEVIRSLFYNKNNDSLITVSVYASDNFSSLKCRSIRIEYIQRGKPDEGFPLFETESLKWPGFVEFDDVNEKVLTYSAQDSIYKVFDLKNYTLLYSITDRQVEEIKISPGIMLLIFSRGQSHVPLKILSIEDGTVLKDFNHLLHRNKKVDFIEQFNEKLLVKQDNENLQILDVRNAEVKEVGSTEFMTPSAFIFLYENQLFLTFRNQTVSVWNFRGELVTSFEDHVLSHPDCNTNNIYITSDQDLIVSFCKADNDQATDTRAGSINISNIWTGKCIAKINSSNAMPSKDEQEGSSSNKRQVEVNMVEEALEDITALYFDEEHNEIYTGNSNGLVHVWSN

SEQ ID NO: 12129 - protein, 407 aa, Sequoia sempervirens
APIHRRGSGIFSCRKSLILMIPRQMVLLSRLQFLNKRSRIIEIVAARDIIFALAQSGVCAAFSRETNRRVCFLNISPDEVIRSLFYNKNNDSLITVSVYALDSYSSLKCRTTPIEYIRRGQPDGGFPLFDSESLRWPGFVEFDDVNGKVLTFSAQDGVYKVFDLKNYTLLYSISDKNVEEIKISPGIMLLIFKKSSSGSHVPLKISNIEDGTVLKSFNHLLHRNKKVDFIEQFNEKLLVKQENENLQILDVRNTQLTEVSRTEFMTPSAFIFLYENQLFLTFRNRAVAVWNFRGELVTSFEDHLLWHPDCNTNNIYITSDQDLIISYCKAYPQGCDEKNAGSINISNILTGKCLAKIRANDPNVCVSSRNRPNASVIQSTVEEALEDITALFYDEERNEFIRATDRG

SEQ ID NO: 12130 - protein, 480 aa, Amorphophallus konjac
MENHKRSLLRMRVRVTARKRGREVNACGGSSSGRKRSGRGCVNNSVRKLQRREIGGFPRIARGSSSNAPEKFRNVQLQEEFDTYDPNAHWFLRLQFLKKRSKIIEIVSAKDVIFALAQSGLCAAFSRTTNGRICFLNISQDEVIRSLFYNKNNDSLITVSVYASDHFSSLKCRTTPIEYIRRNQLDAGFPLFETESLKWPGFVEFDDVNGKVLTYSAQDGIYKVFDLKNYSFLYSISDKNVQEIKISPGIMLLIFHRAPGYVPLKILSIEDGTLLKSFNHLLHRNKKIDFIEQFNEKLLVKQENENLQILDVRNSELTEVSRTEFMTPSAFIFLYENHLFLTFRNRTVAVWNFKGELVTSFEDHLLWHPDCNTNNIYITSDQDLIISYCKAEEGCEDEGEVSAVGSINMSNILTGKCIAKICSNDTALQINPRSRNATGRSYIRSTVREALEDVTALFYDEDRNEIYTGNKQGLIHVWSN

SEQ ID NO: 12131 - protein, 291 aa, Arnica chamissonis
MESSSGSGSSRPPYGGRRRVVATKKRDWANWLLVNNSVKKIHRREISSKRRRSFSITNSFDRFRNIRLTEQYDTHDPKGQSSFVLPFLMKRAKVIEIVAAHGIVFALASSGVCAAFSRDTNKRICFLNIFPDEVIRSLFYNKNNDSLITVSVYASDNFSSLKCRSTRIEYIQRGQPDAGFPLFESESLKWPGFVEFDDVNGKVLTYSAQDSIYKVFDLKNYTLLYSIEDKDVEEIKISPGIMLLIFTRAQSHVPLKILSIEDGTVLKDFNHLLHRNKKVDFTEQFNEKASC

SEQ ID NO: 12132 - protein, 254 aa, Cirsium arvense
FNMCDAQERFRNILLQEEYDTHDPKGHCSTVLPFLKKRSKIIEIVAAHDIVFALAQSGVCAAFNRETNKRICFLNVSPDEVIRSLFYNKNNDSLITVSVYASDSFSSLKCRTTRIEYIRRGQPDAGFALFTSESLKWPGFVEFDDVNGKVLTFSAQDSIYKVFDLKNYTMLYSISDKNVQEIKISPGIMLLIFNKSSGHVPLKILSIEDGTVLKSFNHLLHRHKKVDFIEQFNEKLLVKQEMRIFKFLMYAIPT

SEQ ID NO: 12133 - protein, 428 aa, Flaveria ramosissima
MCDAQERFRNIRLQEEYDTHDPKGHCSTVLPFLKKRSKIVEIVAARDIVFALAQSGICAAYSRETSQRICFLNVSPDEVIRSLFYNKNNDSLITVSVYASDSFSSLKCRTTGIEYIRRGKPDAGFPLFESESLKWPGFVEFDDVNGKVLTFSAQDSIYKVFDLKNYMMLYSISDKNVQEIKISPGIMLLIFNKASGHVPLKILSIEDGTVLKTFNHLLHRNKKVDFIEQFNEKLLVKQENENLQIRDVRNSELTEINRTEFMTPSAFIFLYENQLFLTFRNRTVAVWNFRGELVTSFEDHLLWHPDCNTNNIYITSDQDLIISYCKADSDDSVAEGNAAGSINISNILTGKCLAKVKAMDGAAVNECICSEIIKSSGRRCRCNSKQRAQGRRITSSVSEALEDITALFYDEERNEIYTGNRLGLVHVW

SEQ ID NO: 12134 - protein, 462 aa, Pinus pinaster
MDGKKISASPRPSFGRRVVAGKRRRVDDCHNCVKKLQRREIGSIGNRAFNSTNAQEKFRNFQLQEEFDTYDPKAHWFLKLQFLKKRSKIIEIVAARDIIFALAQSGVCAAFSRETNRKVCFLNISPDEVIRSLFYNKNNESLITVSVYASDNFSSLKCRTTPIEYIRRGKPDAGFALFESESLKWPGFVEFDDVNGKVLTYSAQDGIYKVFDLKNYTMLYSISDEQVQEIKISPGIMLLIFERTSGHVPLKILSIEDGTVLKSFNFLLHRNKKVDFIEQFNEKLLVKQENENLQILDVRNSHMTEVSRTEFMTPSAFIFLYENQLFLTFRNRTVAVWNFRGVLVTSFEDHLLWHPDCNTNNIYITSDQDLIISYCKAHPDGSDEEENVGSINMSNILTGKCLAKIRANDPNVRISPRNRPNASAIRSTVQEALEDITALFYDEERNEIYTGNRHGLIHVWSN

SEQ ID NO: 12135 - protein, 154 aa, Lippia dulcis
DQSWNHAFDIHKKPRRVPLKILSIEDGTVLKSFNHLLHRNKKVDFIEQFNEKLLVKQENENLQIVDVRNVEITEVSRTEFMTPSAFIFLYENQLFLTFRNRTVAVWNFRGELVTSFEDHLLWHPDCNTNNIYITSDQDLIISYCKADSDEPLSD

SEQ ID NO: 12136 - protein, 163 aa, Plantago ovata
MDGNGNGSGRRITATPRPCNGRRVVAKKRPRGAMDGFVNSVKKLQRREISAKRDRSFSMSDAQERFRNIRLQEEYDTHDPKGHSSLTLPFLKRRSKIIEIVAAHDIVFALAQSGICAAFSRETNESICFLNVSPDEVIRSLFYNKTMIHSSLFLSMRQIILAP

SEQ ID NO: 12137 - protein, 191 aa, Pteridium aquilinum
MESKKKISSSPRPSCSRRILAGKRACPFDSSSNCTKKLFRREISASGNRTFNCTNAQEKFRNFQLQEEFDTYDPKGNWFLQLNFLKKRSKITEIVAARDVVFALAQSGVCAAFSRETNKKICYLNINPDEVIRSLFYNKNNDSLITVSVYASDHFSTLKCRTTPIQYIRRGQPDAGFGLFGSESLKVARLC

SEQ ID NO: 12138 - protein, 244 aa, Artemisia annua
RVSTVTDKDVDEIKISPGIMLLIYKRAQGHVPLKILSIEDGTVLKNFNHLLHRNKKVDFIEQFNEKLLVKQDDENLQIRDVRNADVKEVSKTEFMTPSAFIFLYENQLFLTFRNRTVSVWNFRGELVTSFEDHELWHADCNTNNIYITSDQDVIISFCKSNLNDQWTDEKAGSINISNIWTGKSVARINSSNAVLSEDVNKKQKMIGGNMIGEALEDITALYYDEERNEIYTGNGHGLVHVWSN

SEQ ID NO: 12139 - protein, 74 aa, Citrus sinensis
MEVSITEFMTPSAFIFLYENQLFLTFINQTVAVWNFRGELVTSFDDHLYWNQDCNTNKIYYNKGSGYYYFLLQG

SEQ ID NO: 12140 - protein, 337 aa, Lactuca sativa
MMASSSGSGGSRPPPHCGGRRRVVATKKRDWTNWLSVNNSVKKIQRREISSKRQRSVSISNSVHRFRNIRLTEQYSTHDPKESSSFALPFLTKRAKVVEIVAGRGIIFALTSSGVCAAFRRDTKKRICFLNIFPDEVIRSLFYNKNNDSLITVSVYASDSFSSLKCRSTRIEYIERGKPDSGFPLFESESLKWPGFVEFDDVNGKVLTYSAEDSIYKVFDLKNYTLLYSVADKNVEEIKISPGIMLLIYSRAASHVPLKILSIEDGSVLKDFNHLLHRNKKVEFIEQFNEKLLVKQENENLQILDVRNADVKEVGRTEFMTPSAFIFLYENQLFFNI

SEQ ID NO: 12141 - protein, 488 aa, Medicago truncatula
MEGGGGSGGGRRVSSSPRPCCGRRVVAKKKQGRGGAGDGFINSVRKLQRREISTKSVRGFSITDAQERFRNIRLQEEYDTYDPKGPSSIVLPFLRKRSKIIEIVAAQDIVFALAQSGVCAAFNRETNERICFLNISPDEVIRSLFYNKNNDSLITVSVYASDSYSSLKCRSTRIEYIRRVQPDAGFALFESESLKWPGFVEFDDVNGKVLTYSAQDSIYKVFDLKNYSMLYSVADKNVQEIKISPGIMLLIYTKASSHVPLKILSIEDGTVLKSFNHLIHRNSKVDFIEQFNEKLLVKQENENLQILDVRTFELTEVSKTEFMTPSAFIFLYENQLFLTFRNRTVAVWNFRGELVTSFEDHLLWHPDCNTNNIYITSDQDLIISYCKADSDESLSEGNAGSINISNILTGKCLAKIRASNSFPIAKECNCGDDCSTDGCNSRKRKQASSRIRNTVREALEDITALFYDEDRNEIYTGNRHGLVHVWSN

SEQ ID NO: 12142 - protein, 462 aa, Pinus taeda
MDGKKISASPRPSFGRRVVAGKRRRVDECHNCVKKLQRREIGSIGNRAFNSTNAQEKFRNFQLQEEFDTYDPKAHWFLKLQFLKKRSKIIEIVAARDIIFALAQSGVCAAFSRETNRKVCFLNISPDEVIRSLFYNKNNESLITVSVYASDNFSSLKCRTTPIEYIRRGKPDAGFALFESESLKWPGFVEFDDVNGKVLTYSAQDGIYKVFDLKNYTMLYSISDEQVQEIKISPGIMLLIFERTSGHVPLKILSIEDGTVLKSFNFLLHRNKKVDFIEQFNEKLLVKQENENLQILDVRNSHMTEVSRTEFMTPSAFIFLYENQLFLTFRNRTVAVWNFRGVLVTSFEDHLLWHPDCNTNNIYITSDQDLIISYCKAHPDGSDEEENVGSINMSNILTGKCLAKIRANDPNVRISPRNRPNASAIRSTVQEALEDITALFYDEERNEIYTGNRHGLIHVWSN

SEQ ID NO: 12143 - protein, 455 aa, Oryza sativa
MEARRISASPRPCSGRRVVARKRPRHEAAVNSVRKLQRREISSCRDRAFSMSAAQERFRNIQLQEEFDTHDPKENSLLLPYLRKRSKIIEIVAARDIVFALSQSGVCAAFSRETNRRICFLNGSPDEVIRSLFYNKNNESLITVSVYGSENFSALRCRTTRIEYIRRAKPDAGFPLFESESLKWPGFVEFDDVNGKVLTYSAQDSTYKVFDLKNYTLLYSISDKNVQEIKISPGIMLLIYTRTSSSVPLKILSIEDGTVLKSFNHLLHRNKKVDFIEQFNEKLLVKQEGENLQILDVRNFQLTEVSRTEFMTPSAFIFLYELQLFLTFRNRSVAVWNFRGELVTSFEDHLLWHPDCNTNNIYITSDQDLIISYCKADSNDSSSEENAGSINISNILTGKCLAKIKASDLCKQKKAWKFQSTALEALEDITALYYDEERDEIYTGNRQGLVHVWSN

SEQ ID NO: 12144 - protein, 479 aa, Tragopogon dubius
MEGFGGNGGSRNRRITMASSTGSGGSRPPPLCGGRRRVVATKKRGWSNPLSVNNSVKKLQRREISSKPHRSSAITKSLHRFRNFRLTERYDIHDPVGQCSLVLPLLMKRAKVIEIVVVHDIVFSLASSGVCAAFSRDTNKRICFLNIYPDEVIRSLFYNKNNDSLITVSVYASDNFSSLKCRSIRIEYIQRGKPSEGFPLFETESLKWPGFVEFDDVNEKVLTYSAQDSIYKVFDLKNYTLLYSIADKQVEEIKISPGIMLLIFSRGQSHVPLKILSIEDGTVLKDMNHLLHRNKKVDFIEQFNEKLLVKQDNENLQILDVRNAEVKEVGSTEFMTPSAFIFLYENQLFLTFRNQTVSVWNFRGELVTSFEDHVLSHPDCNTNNIYITSDQDLIVSFCKANNNQLTDQRAAGSINISNIWTGKCIAKINSTNAVSEGRSRNEVNMVEEALEDITALYFDEDRNEIYTGNSNGLVHVWSN

SEQ ID NO: 12145 - protein, 496 aa, Triphysaria pusilla
MDGRRITANPRPCSGRRVVAKKRPRGGLDGIVNSVRKLQRREISSKRDRSFTMSDAQERFRNIRLQEEYDTHDPKGFCPLSLPFLKKRSKVIEIVAARDIVFALAQSGVCAAFSRETNQRICFLNISPDEVIRSLFYNKNNDSLITVSVYASDNFSSLKCRTTKIEYILRGKPDAGFPLFESESLKWPGFVEFDDVNGKVLTYSAQDSIYKVFDLKNYTMLYSISDKNVQEIKISPGIMLLIFTKTQGSVPLKILSIEDGTVLKSFTHLLHRNKKVDFIEQFNEKLLVKQENENLQILDVRNSDLTEVSRTEFMTPSAFIFLYENQLFLTFRNRTVAVWNFRGELVTSFEDHLLWHPDCNTNNIYITSDQDLIISYCKAGSDEPLADESAGSFDVADFLSGLRPGTINISNILTGKCLAKITASNSLPIDKRSCCANCNDGQDCSNSKRCKKESSSSRNTSTVAEALKDITALFYDEERNEIYTGNRHGLVHVWSN

SEQ ID NO: 12146 - protein, 248 aa, Distylium racemosum
EIGSIGNKAFSSTNSQERFRNFQLQEEFDTYDPKANWFLRLQFLKKRSKIIEIVAARDIIFALAQSGICAAFSRETNKKVCFLNISPDEVIRSLFYNKNNDSLITVSVYASDNFSSLKCRTTPIEYIRRGQPDAGFALFETESLRWPGFVEFDDVNGKVLTYSAHDGIYKVFDLKNYTLLYSISDKKVEEIKISPGIMLLIFKKSSNGSHVPLKILSIEDGTVLKAFNHLLHKGKRLISLSSSMRSFL

SEQ ID NO: 12147 - protein, 414 aa, Arnica chamissonis
MAGVGHRCAVVGGEWLLQRMVAGTTRCWPTTPLKSFRDAKLHPNPHRSAAITKSLHRFRNFRLTERYDMHDPVGQCSLVLPLLMRRAKVIEIVVVHDIVFALASSGVCAAFGRGTNKTICFLNIYPDEVIRSLFYNKNNDSLITVSVYASDNFSSLKCRSIRIEYIQRGKPDEGFPLFETESLKWPGFVEFDDVNEKVLTFSAQDSIYKVFDLKNYTMLYSIADRQVEEIKISPGIMLLILSRGQSHVPLKILSIEDGTVLKDFNHLLHRNKKVDFIEQFNEKLLVKQDSENLQILDVRNAEVKEVGSTEFMTPSAFIFLYENQLFLTFRNQTVSVWNFRGELVTSFEDHVLSHPDCNTNNIYITSDQDLIVSFCKTDNSQSTDTRAGSINISNIWTGKCIAKINSSNVIRSRD

SEQ ID NO: 12148 - protein, 257 aa, Lippia dulcis
SAQDSIYKVFDLKNYTMLYSISDKNVQEIKISPGIMLLIFTKTNSGVPLKILSIEDGTVLKSFNHLLHKNKKVDFIEQFNEKLLVKQENENLQIRDVRNTDVTEVSRTEFMTPSAFIFLYENQLFLTFRNRTVAVWNFRGELVTSFEDHLLWHPDCNTNNIYITSDQDLIISYCKADSEEPLSDGNAGSINISNILTGKCLAKIKASNSVPIDEGSCSTSCGGRDYKTSKRLKTSRIRSTVAEALEDITALFYDEDR

SEQ ID NO: 12149 - protein, 71 aa, Trigonella foenum-graecum
ESESLKWPGFVEFDDVNGKVLTYSAQDSIYKVFDLKNYTMLYSVADKNVQEIKISPGIMLLIYTKQAAMSH

SEQ ID NO: 12150 - protein, 473 aa, Aristolochia fimbriata
MENKKSLLRLRLRVTARKRSRALKQCDSVKKLRESYSCNSVKKLQQREIGALRKMGRGAASNAQEKFRNFQLQEEFDTYDPKSHWFLRLQFLKKRSKIIEIVAAKDVIFALAQSGLCAAFSRTTNQRICFLNISPDEVIRSLFYNKNNDSLITVSVYASDHFSSLKCRTTPIEYIRRNQLDAGFPLFESESLRWPGFVEFDDVNGKVLTYSAQDGIYKVFDLKNYSFLYSISDKNVQEIKISPGVMLLIFHRAPGYVPLKILSIEDGSVLKSFNHLLHRNKKVDFIEQFNEKLLVKQENENLQILDVRNSKLTEVSRTEFMTPSAFIFLYENHLFLTFLNRTVAVWNFWGELVTSFEDHLLWHPDCNTNNIYITSDQDLIISYCKAEEGSEDDGEGCAIGSINMSNILTGKCIAKICANDPNLQISPRGRVGRSWIRSTVREALEDVTALFYDEDRNEIYTGNKQGLIHVWSN

SEQ ID NO: 12151 - protein, 459 aa, Brachypodium distachyon
MEPRRISASPRPCSGRRVVASRKRPRQEAVVSSVRKLQRREISTRRERSFAMNSARERFRNIQLQEEFDTHDPKENSLLLPYMRKRSKIIEIVAARDIVFALSQSGVCAAFSRVTNKRICFLNGSPDEVIRSLFYNKNNESLITVSVYGSENFSALRCKTTPVEYIRRGTPDAGFPLFETESLKWPGFVEFDDVNGKVLTYSAQDSTYKVFDLKNYTLLYSISDKNVQEIKISPGIMLLIYTRASSSIPLKILSIEDGTVLKSFSHLLHRNKKVDFIEQFNEKLLVKQEGENLQILDVRNFQLTEVSRTEFMTPSAFIFLYELQLFLTFRNRSVAVWNFRGELVTSFEDHLLWHPDCNTNNIYITSDQDLIISYCKADSSSSDSSPEENAGSINISNILTGKCLAKIKADDLCKKPKKAWKFQSTMSEALEDITALYYDEERDEIYTGNRQGLVHVWAN

SEQ ID NO: 12152 - protein, 223 aa, Cenchrus ciliaris
IMLLIYTRTSSSVPLKILSIEDGTVLKSFSHLLHRNKKVDFIEQFNEKLLVKQEGENLQILDVRNFQLTEVSRTEFMTPSAFIFLYELQLFLTFRNRSVAVWNFRGELVTSFEDHLLWHPDCNTNNIYITSDQDLIISYCKADSTDSSSEENAGSINISSILTGKCLAKVNPGNGNSCKQKKAWKFQNTVSEALEDITALYYDEERDEIYTGNRHGLVHVWSN

SEQ ID NO: 12153 - protein, 234 aa, Taraxacum officinale
CFLNVTPDEVIRSLFYNKNNDSLITVSMYASDSFSSLKCRTTRIEYIRRGQPDAGFALFESESLKWPGFVEFDDVNGKVLTFSAQDSIYKVFDLKNYMMLYSISDKNVQEIKISPGIMLLIYNQSSGHVPLKILSIEDGIVLKSFNHLLHRNKKVDFIEQFNEKLLVKQENENLQILDVRTSEVIEVSRTEFMTPSAFIFLYENQLFLTFRNRTVAVWNFRGELVTSFEDHLLW

SEQ ID NO: 12154 - protein, 247 aa, Setaria italica
VIRSLFYNKNNDSLITVSVYGSENFSALRCRTTRIEYIRRGQPDAGFSLFETESLKWPGFVEFDDVNGKVLTYSAQDSTYKVFDLKNYTLLYSVSDKNVQEIKISPGIMLLIYTRTSSSVPLKILSIEDGTVLKSFSHLLHRNKKVDFIEQFNEKLLVKQEGENLQILDVRNFQLTEVSRTEFMTPSAFIFLYELQLFLTFRNRSVAVWNFRGELVTSFEDHLLWHPDCNTNNIYITSDQDLIISYC

SEQ ID NO: 12155 - protein, 457 aa, Setaria italica
MEPRRISASPRPCSGRRVVARKRPRQESVVSSVRKLQRREISSRRDRACAMTAAQERFRNITLQEEFDTHDPKENCLLLPYLRKRSKIIEIVAARDIVFALSQSGVCAAFSRETNQRICFLNGSPDEVIRSLFYNKNNDSLITVSVYGSENFSALRCRTTRIEYIRRGQPDAGFSLFETESLKWPGFVEFDDVNGKVLTYSAQDSTYKVFDLKNYTLLYSVSDKNVQEIKISPGIMLLIYTRTSSSVPLKILSIEDGTVLKSFSHLLHRNKKVDFIEQFNEKLLVKQEGENLQILDVRNFQLTEVSRTEFMTPSAFIFLYELQLFLTFRNRSVAVWNFRGELVTSFEDHLLWHPDCNTNNIYITSDQDLIISYCKADSTDSSSEENAGSINISSILTGKCLAKVNSGNGNSCKQKKAWKFQNTVSEALEDITALYYDEERDEIYTGNRHGLVHVWSN

SEQ ID NO: 12156 - protein, 461 aa, Zea mays
MEPRRISASPRPCSVRRVVARKRPRQEAVVSSVRKLQRREISSRRDRAFAMSAAQERFRNIHLQEEFDTHDPKENTLLLPYLRKRSKIIEIVAARDIVFALSQSGVCAAFSREANERICFLNGSPDEVIRSLFYNKNNDSLITVSVYGSENFSALRCRTTRIEYIRRGQPDAGFPLFESESLKWPGFVEFDDVNGKVLTYSAQDSTYKVFDLKNYTLLYSVSDKNVQEIKISPGIMLLIYTRTNSSVPLKILSIEDGTVLKSFSHLLHRNKKVDFIEQFNEKLLVKQEGENLQILDVRNFQLTEVSRTEFMTPSAFIFLYELQLFLTFRNRSVAVWNFRGELVTSFEDHLLWHPDCNTNNIYITSDQDLIISYCKADSTDSSSEENAGSINISSILTGKCLAKINPGNSCKQKDPCKQKKAWRFQNTVSEALEDITALYYDEDRDEIYTGNRHGLVHVWSN

SEQ ID NO: 12157 - protein, 457 aa, Pennisetum glaucum
MEPRRISASPRPCSGRRVVARKRPRQESVVSSVRKLQRREISSRRDRTFAMTAAQERFRNITLQEEFDTHDAKENSLLLPYLRKRSKIIEIVAARDIVFALSQSGVCAAFSRETNQRICFLNGSPDEVIRSLFYNKNNDSLITVSVYGSENFSALRCRTTRIEYIRRGQPDAGFPLFETESLKWPGFVEFDDVNGKVLTYSAQDSTYKVFDLKNYTLLYSVSDKNVQEIKISPGIMLLIYTRTSSSVPLKILSIEDGTVLKSFSHLLHRNKKVDFIEQFNEKLLVKQEGENLQILDVRNFQLTEVSRTEFMTPSAFIFLYELQLFLTFRNRSVAVWNFRGELVTSFEDHLLWHPDCNTNNIYITSDQDLIISYCKADSTDSSSEENAGSINISSILTGKCLAKVNPGNGNSCKQKKAWKFQNTVSEALEDITALYYDEERDEIYTGNRHGLVHVWSN

SEQ ID NO: 12158 - protein, 248 aa, Nuphar advena
ICFLNISPDEVIRSLFYNKNNDSLITVSVYASDCFSSLKCRTTPIEYIRRNQLDSGYALFESESLKWPGFVEFDDVNGKVLTYSAQDGIYKVFDLKNYSFLYSIPDKDIQEIKISPGIMLLIFNRAPGYVPLKILSIEDGTVLKSFNHLLHRNKKVDFIEQFNEKLLVKQENENLQILDVRDSEITEVSRTEFMIPSAFIFLYENHLFLTFRNQTVAVWNFRGELVTSFEDHLLWHPDCNTNNIYITS

SEQ ID NO: 12159 - protein, 456 aa, Sorghum bicolor
MEPRRISASPRPCSGRRVVAARKRPRQEAVVSSVRKLQRREISSRRDRAFAMSAAQERFRNIQLQEEFDTHDPKENTSLLPYLRKRSKIIEIVAARDIVFALSQSGVCAAFSRETNQRICFLNGSPDEVIRSLFYNKNNDSLITVSVYGSENFSALRCRTTRIEYIRRGQPDAGFPLFESESLKWPGFVEFDDVNGKVLTYSAQDSTYKVFDLKNYTLLYSVSDKNVQEIKISPGIMLLIYTRTSSSVPLKILSIEDGTVLKSFSHLLHRNKKVDFIEQFNEKLLVKQEGENLQILDVRNFQLTEVSRTEFMTPSAFIFLYELQLFLTFRNRSVAVWNFRGELVTSFEDHLLWHPDCNTNNIYITSDQDLIISYCKADSTDSSSEENAGSINISSILTGKCLAKINPGNSSKQKKAWRFQNTVSEALEDITALYYDEDRDEIYTGNRHGLVHVWSN

SEQ ID NO: 12160 - protein, 481 aa, Glycine max
MEGRMRGGYSGRRIVASRRGSGKGNVNIIINNNNNNNNKNNTNVIKKLQSREICSKPHRAFASVTASHRFRSMRLTHQYDTHDPSKTRSSLWPFLMKRTKVVEIVAAKNVVFALYHSGLCAAFSRETDERICFLNVCPDEVIRSLFYNKNNDSLITVSVYASENFCSLKCRSTKIEYIRRGKPDAGFPLFQSESLKWPGFVEFDDVNGKVLTYSAQDCIYKVFDLKNYTLLYSISDRNVQEIKISPGIMLLIYNRTSGHIPLKIISIEDGTILKVFNHLLHRNKKVDFIEQFNEKLLVKQENENLQILDVRSSELMEVSRLEFMTPSAFIFLYENQLFLSFRNRTVSVWNFRGELVTSFEDHQLWHPDCNTNNIYITSDQDLIISYCKADSDDQWIEGTAGSINVSNILTGKCVAKITAISSSAKADECRSSGCSCKKSHSCLMRSPVAEALEDITALFYDEDRNEIYTGNRHGLVHVWSN

SEQ ID NO: 12161 - protein, 669 aa, Glycine max
MEGRRRGGYSGRRIVASRRGSGKSNANNNNNNNNKNNNNINVIKKLQSREIWSKPHRAFASVTASHRFRSMCLTHQYDTHDPSKTPSSLWPFLMKRTKVVEIVAAKNVVFALYHSGLCAAFSRETDERICFLNVCPDEIIRSLFYNKNNDSLITVSVYASENFSSLKCRSTKIEYLRRGKPDAGFPLFQSESLKWPGFVEFDDVNGKVLTYSAQDCIYKVFDLKNYTMLYSILDRNVQEIKISPGIMLLIYNRTSGHIPLKIISIEDGTVLKVFNHLLHRNKKVDFIEQFNEKLLVKQENENLQILDVHNSELMEVSRTEFMTPSAFIFLYDNQLFLTFRNRTVSVWNFHGELVTSFEDHQLWHPDCNTNNIYITSDQDLIMSYCKADSDDQWIEGTAGSINVSNILTGKCVAKIIATSSSAKADECSSSGCSCKQSDSCLMRNSVAEALEDITALFYEEDRNEIYTGNRHGLVHVWCESPYLRSIAEMDGLGRGASMGLGLPPSTSFLSVKLCLGDLLVMGSNPETASLHMQGKGCVQHPSPIPSHSEEPLGNGYSLMLLRNSTLSNADPQTLKFDNLNGKVLTYSAEDSIYKVFDLKDYTLLYSISDKHVQDIKIRELVTQFEDHQFVTRLGCNTNNTYITRDQDFIISYCKADSDDQWMEGNGNRL

SEQ ID NO: 12162 - protein, 456 aa, Saccharum officinarum
MEPRRISASPRPCSGRRVVAARKRQRQEAVVSSVRKLQRREISSRRDRSFALSAAQERFRNIQLQEEFDTHDPKENTLLLPYLRKRSKIIEIVAARDIVFALSQSGVCAAFSRETNQRICFLNGSPDEVIRSLFYNKNNDSLITVSVYGSENFSALRCRTTRIEYIRRGQPDAGFPLFESESLKWPGFVEFDDVNGKVLTYSAQDSTYKVFDLKNYTLLYSVSDKNVQEIKISPGIMLLIYTRTSSSVPLKILSIEDGTVLKSFSHLLHRNKKVDFIEQFNEKLLVKQEGENLQILDVRNFQLTEVSRTEFMTPSAFIFLYELQLFLTFRNRSVAVWNFRGELVTSFEDHLLWHTDCNTNNIYITSDQDLIISYCKADSTDSSSEENAGSINISSILTGKCLAKINPGNSCKQKKAWRFQNTVSEALEDITALYYDEDRDEIYTGNRHGLVHVWSN

SEQ ID NO: 12163 - protein, 405 aa, Panicum virgatum
VGVQMLDSAPSQEEFDTHDPKENSLLLPYLRKRSKIIEIVAARDIVFALSQSGVCAAFSRETNERICFLNGSPDEVIRSLFYNKNNDSLITVSVYGSENFSALRCRTTRIEYIRRGQPDAGFPLFETESLKWPGFVEFDDVNGKVLTYSAQDSTYKVFDLKNYTLLYSVSDKDVQEIKISPGIMLLIYIRTSSSVPLKILSIEDGTVLKSFTHLLHRNKKVDFIEQFNEKLLVKQEGENLQILDVRNFQLTEVSRTEFMTPSAFIFLYELQLFLTFRNRSVAVWNFRGELVTSFEDHLLWHPDCNTNNIYITSDQDLIISYCKADSTDSSSEEKAGSINISSILTGKCLAKINPGNGNSCKQKKAWKFQNTVSEALEDITALYYDEERDEIYTGNRHGLVHVWSN

SEQ ID NO: 12164 - protein, 453 aa, Ambrosia trifida
MEGSSSSRRRRVVATKKQRDWTNCLSVNNNSVKRIHRREISSKRHRSVSLTNSLHRFKNIRLTEQYDTHDPKGQSSFVLPFLMKRAKVIEIVAAHGIVFALASSGVCAAFSRDTNTRICLLNIFPDEVIRSLFYNKNNDSLITVSVYASDNFSSLKCRSTRIEYIQRGQPDAGFALFESESLKWPGFVEFDDVNGKVLTYSAQDSIYKVFDLKNYTLLYSITDKDVEEIKISPGIMLLIFTRAQSHVPLKILSIEDGTVLKEFNHLLHRNKKVDFIEQFNEKLLVKQDSENLQILDVRNAEVKEVAKTEFMTPSAFIFLYENQLFLTFKDQTVSVWNFRGELMTSFEDHELWHSDCNTNNIYITSDQGLIISFCKGDSNDQRISGKAGSINISNIWTGKCVAKINSGNATLSEDRKQRTTETHMVAEALEEITALYFDEERNEIYTGNNYGLV

SEQ ID NO: 12165 - protein, 114 aa, Scabiosa columbaria
ASGHVPLQILSIEDGTVLKSFNHLLHRNKKVDFIEQFNEKLLVKQENENLQILDVRNSEQTEVSRTEFMTPSAFIFLYENQLFLTFRNRTVAVWNFRGELVTSFEDHLLWHPDC

SEQ ID NO: 12166 - protein, 458 aa, Zea mays
MEPRRISASPRPCSGRRVVARKRPRQEAVVSSVRKLQRREISSRRDRTFTMSAAQERFRNIQLQEEFDTHDPKENASLLPYLRKRSKIIEIVAARDIVFALSQSGVCAAFSRETNRRICFLNGSPDEVIRSLFYNKNNDSLITVSVYGSENFSALRCRTTRIEYVRRGQPDAGFPLFESESLKWPGFVEFDDVNGRVLTYSAQDSTYKVFDLKNYTLLYLVSDKNVQEIKISPGIMLLIYARTSSSVPLKILSIDDGTVLKSFSHLLHRNKKVDFIEQFNEKLLVKQEGENLQILDVRNFQLTEVSRTEFMTPSAFIFLHELQLFLTFRNRAVSVWNFRGELVTSFEDHLLWHPDCNTNNIYITSDQDLIISYCKADSTDSTSEENAGSINISSILSGKCLAKINTGNSNACKERKKAWKFRNTVSEALEDITALYYDEDRDEIYTGNRHGLVHVWSS

SEQ ID NO: 12167 - protein, 176 aa, Populus trichocarpa
FCFFLCSPGIMLLILTKSGGCVPLEILSIEDGTVLKSFNHLLHRNKKVDFIEQFNEKLLVKQENENLQILDVRDFQLIEVSRTEFMTPSAFIFLYENQLFLTFRNRTVAVWNFRGELVTSFEDHLLWHPDCNTNNIHITSDQDLIISYCKADSDDPLSEGNGSHHISNILTGKCLA

SEQ ID NO: 12168 - protein, 256 aa, Panicum virgatum
AQDSTYKVFDLKNYTLLYSVSDQNVQEIKISPGIMLLIYIRTSSSVPLKILSIEDGTVLKSFTHLLHRNKKVDFIEQFNEKLLVKQDGENLQILDVRNFQLTEVSRTEFMTPSAFIFLYELQLFLTFRNRSVAVWNFRGELVTSFEDHLLWHPDCNTNNIYITSDQDLIISYCKADSTDSSSEENAGSINISSILTGKCLAKINPGNGNSCKQKKAWKFQNTVSEALEDITALYFDEEHDEIYTGNQHGLVHVWSN

SEQ ID NO: 12169 - protein, 80 aa, Cedrus atlantica
YRAEWACSFKNFIYRGRHCFKSTFNHLLHRNKKVDFIEQFNEKLLVKQENENLQILDVRNAQLTEVSRAEFLTPSAFIFL

SEQ ID NO: 12170 - protein, 193 aa, Olea europaea
ASDNFSSLKCRTTRIEYIRRGKPDAGFPLFESESLKWPGFVEFDDVNGKVLTYSAQDSIYKVFDLKNYTMLYSISDKNVQEIKISPGIMLLIFTKASGYVPLKILSIEDGTVLKSFNHLLHRNKKVDFIEQFNEKLLVKQENENLQILDVRNSELTEVSRTEFMTPSAFIFLYENQLFLTFRNRTVAVWNFRG

SEQ ID NO: 12171 - protein, 474 aa, Phalaenopsis aphrodite
MENHKRNVPRPRVRVTAKRRGKESESSTGSSKKPRKGECVNSVTKLQRREIGGFPRIARGTSSNAPEKFRNIQLQEEFDTYDHNVHWFLKLQFLKKRSKIIEIVAAKDVIFALAQSGLCAAFSRTTNKRICFLNISPDEVIRSLFYNKNNESLITVSVYASDHFSSLKCRTTPIEYIRRNQLDAGFALFETESLKWPGFVEFDDVNGKVLTYSAQDGIYKVFDLKNYSFLYSISDKNVQEIKISPGIMLLICRRSPGFVPLKILSIEDGTVLKSFNHLLHRNKKVDFIEQFNEKLLVKQENENLQILDVRNSELTEVGKTQFVTPSAFIFLYENHLFLTFRNRTVAVWNFRGELVTSFDDHLLWHPDCNTNNIYITSDQDLIISYCKSEGCEDEASAVGSINMSNILTGKCIAKISANDPLIQMSPRKGGDASRSSIRCSVREALEDVTALFYDEDRNEIYTGNKQGLIHVWSN

SEQ ID NO: 12172 - protein, 383 aa, Lippia dulcis
VAARDIVFALAQSGVCAAFSRETNQRICFLNVCPDEVIRSLFYNKNNDSLITVSVYASDNFSSLKCRTTRIEYIRRGQPDAGFPLFESESLKWPGFVEFDDVNGKVLTYSAQDSIYKVFDLKNYTMLYSISDKNVQEIKISPGIMLLIFTKSAASVPLKILSIEDGTVLKSFIHVLHRNKKVDFIEQFNEKLLVKQENENLQIVDVRNNDITEVSRTEFMTPSAFIFLYENQLFLTFRNRTVAVWNFRGELVTSFEDHLLWHPDCNTNNIYITSDQDLIISYCKADSDEPLSDGNAGSINISNILTGKCLAKIKVSNSLPMDECHCSASCGGKNCNSRKRIKASRIRSTVAEALEDITALFYDEDRNEIYTGNRLGLVHVWSN

SEQ ID NO: 12173 - protein, 219 aa, Carthamus tinctorius
GTELEPCSSEILSIEDGTVLKDFNHLLHRNKKVDFIEQFNEKLLVKQENENLQILAVRNAEVKEVGRTEFMTPSAFIFLYENQLFLTFRNRTVSVWNFRGELVTSFEDHILWHSDCNTNNIYITSEQDLIISFCKDDSDDQWTDGKAGSINISNIWTGKRIGKINSSNATPNEDGNHRSKIGGNMVAEALEDITALYYDEERNEIYTGNSHGLVHVWSN

SEQ ID NO: 12174 - protein, 252 aa, Triphysaria pusilla
EIKISPGIMLLILTKSHGGVPLKILSIEDGTVLKSFSHLLHKNKKVDFIEQFNEKLLVKQENENLQIVDVRNTEITEVSRTEFMTPSAFIFLYENQLFLTFRNRTVAVWNFRGELVTSFEDHLLWHPDCNTNNIYITSDQDLIISYCKADAEEPLSDGHAGSINISNILTGKCLAKIKASNGLPTSECFCSLNCGGKNCSSSSSSRKRKSTSSGIRSTVAEALEDITALFYDEDRNEIYTGNRLGLVHVWSN

SEQ ID NO: 12175 - protein, 289 aa, Utricularia gibba
GFVEFDDVNGKVLTYSAQDSIYKVFDLKNYTMLYSISDKNVQEIKISPGIMLLIFTKKEGCVPLKILSIEDGTVLKSFKQLLHRNKKVDFIEQFNEKLLVKQENEDLQIVDVRNGDITEVSRTEFMTPSAFIFLYENQLFLTFRNRTVAVWNFRGELVTSFEDHLLWHPDCNTNNIYITSDQDLIISYCKADSDDRLTDGNVGSINISNILTGKCLAKITASNSVSANECDCSLSCGGRKCRSRKHIRASGMRSTAAEALEDITALFYDEDRNEIYTGNKHGLLHVWSN

SEQ ID NO: 12176 - protein, 455 aa, Hordeum vulgare
MEARRISASPRPCNGRRVVARKRPRQEAVVSSVRKLQRREISSRRERSFAMNSAQERFRNIQLQEEFDTHDPKENNALLPYIRKRSKIIEIVAARDIIFALSQSGVCAAFSRVMNKRICFLNGSPDEVVRSLFYNKNNDSLITVSVYGSENFSALRCKTTRIEYIRRGTPDAGFPLFETESLKWPGFVEFDDVNGKVLTYSAQDSTYKVFDLKNYTLLYSICDKNVQEIKISPGIMLLIYTRTSSSIPLKILSIEDGTVLKFFNHLLHRNKKVDFIEQFNEKLLVKQDGENLQILDVRNFHLTEVSSTEFMTPSAFIFLYELQLFLTFRNRSVAVWNFRGELVTSFEDHLLWHPDCNTNNIYITSDQDIIISYCKADSSDSSSEENAGSINISNILTGKCLAKIKAGNFDKQQKTWKFQNTITEALEDITALHYDEVRDEIYTGNRHGLVHVWAN

SEQ ID NO: 12177 - protein, 471 aa, Zingiber officinale
  misc_feature (156)..(156): Xaa can be any naturally occurring amino acid
PVRVRFRVRAKKHGLEAGGSGSSDARKRRRQLDCTNSVRKLLCREIGGHPRMARCSSSDAAEKFRNFQLQEEFDTYDNNVNWFVKLQFLKKRSKIIEIVSAKDIIFALAQSGLCAAFSRTTNKRICCLNISPDEVIRSLFYNKNNDSLITVSVYAXVFSSLKCRTTPIGYIKRNQLDAGFPLFESESLKWPGFVEFDDVNGKILTYSAQDGIYKVFDLKNYSFLYAISDKNVQEIKISPGIMLLIFNREPHCVPLKILSIEDGTVLKSFKHLLHRSKKVDFIEQFNEKLLVKQENENLQIFDVRNSEITEVSRTEFMTPSAFIFLYENHLFLTFRNRTIAVWNFRGQLVTSFEDHLLWHPDCNTNNIYITSDQDLIISYCKAEEGHGNDGEVSTVGSINMSNILTGKCIAKISASDPAVQISPRKRGDTGRSLIRSTVREALEDVTALFFDEDRNEIYTGNKQGLIHVWSN

SEQ ID NO: 12178 - protein, 455 aa, Avena sativa
MEARRISASPRPCNGRRVVAKKRPRQEAPVSSVRKLQRREISSRRDRSFAMNSAQERFRNIQLQEEFDTHDPKENSSLLPYVRKRSKIIEIVAARDIVFALSQSGVCAAFSRVTNKRICFLNGSPDEVVRSLFYNKNNDSLITVSVYGSENFSALRCKTTRIEYIRRGKPDAGFPLFETESLKWPGFVEFDDVNGKVLTYSAQDSTYKVFDLKNYTLLYSISDKNVQEIKISPGIMLLIYTRTSSSIPLKILSIEDGTVLKFFNHLLHRNKKVDFIEQFNEKLLVKQDGENLQILDVRNFQLTEVSSTEFMTPSAFIFLYELQLFLTFRNRSVAVWNFRGELVTSFEDHLLWHPDCNTNNIYITSDQDLIISYCKADSSDSSSEENAGSINISNILTGKCLAKIKAGDFSKQKKTWKFQSTITEALEDITALYYDEERDEIYTGNRHGLVHVWAN

SEQ ID NO: 12179 - protein, 106 aa, Sarracenia psittacina
MLLIFTKASGHVPLKILSIEDGTVLKTFHHLLHRQKKVDFIEQFNEKLLVKQENENLQILDVRNSELTEVSRTEFMTPSAFIFLYENQLFLTFRNRTVAVWNFRGE

SEQ ID NO: 12180 - protein, 213 aa, Silene vulgaris
VNSVRKLQRREISSKHYRAFSMSDAQERFRNICLQEEYDTHDPKDQCPTILPFLRKRSKIIEIVAAHDIVFALAQSGICAAFSRETNQRICFLNVSSDEVIRSLFYNKNNDSLITVSVYASDNFSSLKCRTTRIEYIKRGKPDAGFALFESESLKWPGFVEFDDVNGKVLTYSAQDSVYKVFDLKNYTMLYSISDKNVQEIKNQPGNHVTDIY

SEQ ID NO: 12181 - protein, 241 aa, Artemisia annua
MLLRYNKSSGHVPLKILSIEDGTVLKSFNHLLHRNKKVDFIEQFNEKLLVKQENENLQILDVRNSELIEVSKSEFKTPSAFIFLYENQLFLTFKDRSVAVWNFKGQLVTSFEDHELWYPDCNTNNIYITSNQDVIISYCKADSGDPLSDGKEGSINISNILTGKSLAKVTATNNLQLDECGCSDSVRSGRCNCYLRNRTANSRIVSSVAEALEDITALYYNEERNEIYTGNRLGLIHMWSN

SEQ ID NO: 12182 - protein, 374 aa, Festuca arundinacea
  misc_feature (239)..(239): Xaa can be any naturally occurring amino acid
GTRARRISASPRPCNGRRVVAKKRPRQEAPVSSVRKLQRREISSRRERSFAMNSAQERFRNIQLQEEFDTHDPKENSSLLPYVRKRSKIIEIVAARDIVFALSQSGVCAAFSRVTNKRICFLNGSPDEVVRSLFYNKNNDSLITVSVYGSENFSALRCKTTRIEYIRRGKPDAGYPLFETESLKWPGFVEFDDVNGKVLTYSAQDSTYKVFDLKNYTLLYSISDKNVQEIKISPGIMLXIYTRTSSSIPLKILSIEDGTVLKFFNHLLHRNKKVDFIEQFNEKLLVKQDGENLQILDVRNFQLTEVSSTEFMTPSAFIFLYELQLFLTFRNRSVAVWNFRGELVTSFEDHLLWHPDCNTNNIYITSDQDLIISY

SEQ ID NO: 12183 - protein, 354 aa, Elaeis guineensis
MENHKKSQLRVRFRVTARKRGLESSSGEGSARKLRERDNANSVRKLHHREIGGFPRMARGTATNSPEKFRNMQLQEEFDTYDHNIHFFLRLQFLKKRSKIIEIVAAKDVIFALAQSGLCAAFSRTTNKRICFLNISPDEVIRSLFYNKNNESLITVSVYASDHFSSLKCRTTPIEYIRRNQLDAGYPLFETESLKWPGFVEFDDVNGKVLTYSAQDGTYKVFDLKNYSYLYSISDKNIQEIKISPGIMLLIYQRTPGYVPLTILSIEDGTVLKSFNHLLHRNKKVDFIEQFNEKLLVKQENENLQIRDVRNSNLIEVSRSEFMTPSAFIFLYENQLFLTFRNRTVAVWNFRGEL

SEQ ID NO: 12184 - protein, 99 aa, Orobanche aegyptiaca
RGGLDGFVNSVKKLQRREISSKRDRSFSMSDAQERFRNICLQEEYDTHDPKGYCSLSLPFLKKRSKIIEIVAARDIVFALAQSGVCAAFSQSPTREYVS

SEQ ID NO: 12185 - protein, 455 aa, Triticum aestivum
MEARRISATPRPCNGRRVVARKRPRQEAVISSVRKLQRREISSRRERSFAMNSAQERFRNIQLQEEFDTHDPKENNALLPYIRKRSKIIEIVAARDIVFALSQSGVCAAFSRVTNKRICFLNGSPDEVVRSLFYNKNNDSLITVSVYGSENFSALRCKTTRIEYIRRGTPDAGFPLFETESLKWPGFVEFDDVNGKVLTYSAQDSTYKVFDLKNYTLLYSISDKNVQEIKISPGIMLLIYTRTSSSIPLKILNIEDGTVLKFFNHLLHRNKKVDFIEQFNEKLLVKQDGENLQILDVRNFQLTEVSSTEFMTPSAFIFLYELQLFLTFRNRSVAVWNFRGELVTSFEDHLLWHPDCNTNNIYITSDQDLIISYCKADSTDSSSEENAGSINISNILTGKCLAKIKAGNFNEQKKTWKFQNTITEALEDITALYYDEERDEIYTGNRHGLVHVWAN

SEQ ID NO: 12186 - protein, 217 aa, Pseudoroegneria spicata
IYTRTSSSIPLKILSIEDGTVLKFFNHLLHRNKKVDFIEQFNEKLLVKQDGENLQILDVRNFQLTEVSSTEFMTPSAFIFLYELQLFLTFRNRSVAVWNFRGELVTSFEDHLLWHPDCNTNNIYITSDQDLIISYCKADSTDSSSEENAGSINISNILTGKCLAKIKAGNFNEQKKTWKFQNTITEALEDITALYYDEERDEIYTGNRHGLVHVWAN

SEQ ID NO: 12187 - protein, 488 aa, Oryza sativa
MEGPKRSQLRVRLRVTARRRGGDGGADGGGSGGGGGGAGGRKRLLDAPAFNSAAKLQRREIGGRQLAARGGGAASAVPERFRNMHLQEEFDTYDHNAHLFVKLQFLKKRSKIIEIVAAKDIIFALAHSGLCAAFSRVTNKRISFLNLSPDEVIRSLFYNKNNDSLITVSVYASDHFSTLKCRTTPIEYIRRNQLDAGFPLFETESLKWPGFVEFDDVNGKVLTYSAQDGIYKVFDLKNYSFLYSIPDTNVQEIKISPGIMLLIYERTPCHVPLKILSIEDGRPLKSFTHLLHRNKKIDFIEQFNEKLLVKQEDENLQILDVRSSELIEVSVTKFMTPSAFIFLYENNLFLTFRNRTVAVWNFRGELVTSFEDHLLWHQDCSTNNIYITSDQDLIISYCKSEAGVDDGTVPPIGSINMSDIMTGKCIAKIAANDPTLRIGPRKNGNSERSSIWSTIPEALEDVTALFYDEDRNEIYTGNRHGLVHVWSN

SEQ ID NO: 12188 - protein, 235 aa, Centaurea maculosa
MLLIYNKASGYVLSDPLYEDGTVLKSFNHLLHRNKKVDFIEQFNEKLLVKQENENLQILDVRNSDLTEVSRTEFMTPSAFIFLYENQLFLTFRNRTVAVWNFRGELVTSFEDHLLWHPDCNTNNIYITSDQDLIISYCKAESDDPLTEGNGSINISNILTGKCLAKIKAKDGVPMEECDCGSGSSCKCRRSGKRMRREMSSVTEALEDITALFYDEERNEIYTGNRLGLVHVWSN

SEQ ID NO: 12189 - protein, 150 aa, Platanus occidentalis
MSNAQERFRNIRLQEEYDTHDPKGHCSLVLPFLKKRSKIIEIVAAHDIVFALAQSGVCAAFSREFDDVNGKVLTYSAQDSIYKVFDLKNYTMLYSISDKNVQEIKISPGIMLLIFSRASSYVPLKILSIEDGTVLKAFNHLFIEIRKWTS

SEQ ID NO: 12190 - protein, 483 aa, Sorghum bicolor
MDGPKRSQLRVRLRVTARRRGADGDGAGGAAGPGGRKRRMEAPVLNSAAKLQRREIGGRQLAARGGGPAAAVPERFRNMQLQEEFDTYDANAHLFVKLQFLKRRSKIIEIVAAKDIIFALANSGLCAAFNRVTNKRIAFLNLSPDEVIRSLFYNKNNDSLITVSVYASDNFSTLKCRTTPIEYIRRNQLDAGFPLFESESLKWPGFVEFDDVNGKVLTYSAQDGIYKVFDLKNYSFLYSIPDENVQEIKISPGIMLLIYDRTPSYVPLKILSIEDGKPLKSFKHLLHRNKKIDFIEQFNEKLLVKQEDENFQILDVRSSELIEVSVSKFMTPSAFIFLYENNLFLTFRNRTVAVWNFRGELVTSFEDHLLWHHDCSTNNIYITSDQDLIISYCKSEAVAEDGTVIPVGSINMSEIMTGKCIAKITANDPALSVAPHRNDRSKRSLGWSTVPEALEDVTALFYDEDRNEIYTGNSHGLVHVWSN

SEQ ID NO: 12191 - protein, 223 aa, Fagopyrum esculentum
ILSIEDGTVLKSFNHLIHRGKKVDFIEQFNEKLLVKQENENLQILDVRNSELREVSRTEFMTPSAFIFLYENQLFLTFRNRTVAVWNFRGELVTSFEDHLLWHPDCNTNNIYITSDQDLIISYCKADSDELLSEGTAGSINVSNILTGKCLAKIKVDNCSQTGEDVESSGSNRRSSSRKRTQASRLRSSVQEALEDITALFYDEERNEIYTGNRHGLVHVWSN

SEQ ID NO: 12192 - protein, 153 aa, Amborella trichopoda
  misc_feature (5)..(5): Xaa can be any naturally occurring amino acid
  misc_feature (11)..(11): Xaa can be any naturally occurring amino acid
  misc_feature (16)..(16): Xaa can be any naturally occurring amino acid
  misc_feature (56)..(56): Xaa can be any naturally occurring amino acid
MTPSXFIFLYXNQLFXTFRNGTVAVWNFRGELVTSFEDHMLWHPDCNTNNIYITSXQDLIISYCKADPDDSSVEGKVGSINISNILTGKCLAKIHANDSNVIVNKNKPNKNKRPRFRNTVADALEDITALFYDEERNEIYTGNRQGLVHVWSN

SEQ ID NO: 12193 - protein, 484 aa, Brachypodium distachyon
MDGPKRSQLRVRLRVTARRRGVADGADRFGAGGSGAGGGRKRRLDAPLVNSAAKLQRREIGGRQLAARGGGAAAAVPERFRNMQLQEEFDTYDQDAHLFVKLQFLKKRSKIIEIVAAKDIIFALAHSGLCAAFSRVTNKRISFLNLSPDEVIRSLFYNKNNDSLITVSVYASDNFSTLKCRTTPIEYIRRNQLDAGFPLFETESLKWPGFVEFDDVNGKVLTYSAQDGIYKVFDLKNYSFLYSIPDTNVQEIKISPGIMLLIYDRTPSYVPLKILSIEDGKLLKSFKHLLHRGKKIDFIEQFNEKLLVKQEDENLQILDVRSSELIEVGINKFMTPSAFIFLYENNLFLTFRNRTVAVWNFRGELVTSFEDHLLWHQDCSTNNIYITSDQDLIISYCKSEAATNDSTASPIGSINMSDIMTGKCIAKIAANDPTLSIAPRKNGSPSIWSTVPEALEDVTALFYDEDRNEIYTGNSHGLVHVWSS

SEQ ID NO: 12194 - protein, 244 aa, Citrus sinensis
NFHLLEEYDTCDPKDNCPMELLPFMKKRSKVTEIVAAQDIVFALAQSGVCAAYSRETNRRICFLNATADEVVRSLFFNKYNDSLIIVSVYASDNFNSLKCRSTRIECIKRGIADAGFPLFESESLKWPGFVEFDDVNGKIVTYSAEDSTYKVFDMKSYTMLYSISDKNVQELKTSPGVMLLIFNRTGGHVPLKILSIEDGSVLNLLTILFIGIRRWTSSNCSMRSYFLSKKMRISRFLMSTILS

SEQ ID NO: 12195 - protein, 483 aa, Zea mays
MDGPKRSQLRVRLRVTARRRGADGDGAGGAAGPGGRKRRMEAPVRNSVAKLQRREIGGRQLAARGGGPAAAVPERFRNMQLQEEFDTYDENAHLFVKLQFLKRRSKIIEIVAAKDIIFALANSGLCAAFDRVTNKRIAFLNLSPDEVIRSLFYNKNNDSLITVSVYAADKFSTLKCRTTPIEYIRRNQLDAGFPLFESESLKWPGFVEFDDVNGKVLTYSAQDGIYKVFELKNYSFLYSIPDENVQEIKISPGIMLLIYDRTPSYVPLKILSIEDGKQLKSFKHLLHRNKKIDFIEQFNEKLLVKQENENFQIFDVRSSELIEVSVSKFMTPSAFIFLYENNLFLTFRNRTVAVWDFRGELVTSFEDHLLWHNDCSTNNIYITSDQDLIISYCKSEAVAEDGTVVPVGSINISEIMTGRCIAKITANDPSLSVPGRRNGYSKRSSDWSTVPEALEDVTALFYDEDRNEIYTGNSHGLVHVWSN

SEQ ID NO: 12196 - protein, 356 aa, Saccharum officinarum
LCAAFNRVTNKRIAFLNLSPDEVIRSLFYNKNNDSLITVSVYASDNFSTLKCRTTPIEYIRRNQLDAGFPLFESESLKWPGFVEFDDVNGKVLTYSAQDGIYKVFDLKNYSFLYSIPDENVQEIKISPGIMLLIYDRTPSYVPLKILSIEDGKPLKFFKHLLHRNKKIDFIEQFNEKLLVKQEDENFQILDVRSSELIEVSVSKFMTPSAFIFLYENNLFLTFRNRTVAVWNFRGELVTSFEDHLLWHHDCSTNNIYITSDQDLIISYCKSEAVAEDGTVIPVGSINMSEIMTGKCIAKITANDPALSVAPRRNGRNKLWSTVPEALEDVTALFYDEDRNEIYTGNSHGLVHVWSN

SEQ ID NO: 12197 - protein, 400 aa, Citrus clementina
EEYDTCDPKDNCPMELLPFMKKRSKVIEIVAAQDIVFALAQSGVCAAYSRETNRRICFLNATADEVVRSLFFNKYNDSLIIVSVYASDNFSSLKCRSTRIECIKRGIADAGFPLFESESLKWPGFVEFDDVNGKIVTYSAEDRQGTYTVFDMKSYTMLYSISDKNVQEFKIGPGVILLIFTRTGDHVPLKILSIEDGSVVKSFNHIIHRNKRVDFIELFNEKLLIKQENENLQILDVNNFELTEVSSTEFLTPSAFIFLYEEQLFLTFRNQTVSVWNSRGERVTSFEDHLLWNPDYNTNNIYITTDQEQIISYCRDDSDDPQSKGNGSINISHILTGKCLAKIRASDSHSPASRIRSTDAEALKDITTLFYDEARNEIYTGNKHGSVHVWSRSYQCRSLL

SEQ ID NO: 12198 - protein, 482 aa, Hordeum vulgare
MDGPKRSQLRVRLRVTARRRGGDGADRAGPGGGAGGERKRRMDAPLINSAAKLQRREIGGRQLAARGGGAAAAVPERFRNMQLQEEFDTYDHDAHLFVKLQFLKKRSKIIEIVAAKDIIFALAHSGLCAAFSRVTNKRLSFLNLSPDEVIRSLFYNKNNDSLITVSVYASDQFSTLKCRTTPIEYIRRDQLDAGFPLFESESLKWPGFVEFDDVNGKVLTYSAQDGIYKVFDLKNYSFLYSIPDTNVQEIKISPGIMLLIYDRMPSYVPLKILSIEDGKPLKLFKHLLHRGKKIDFIEQFNEKLLVKQEDENLQILDVRSSELIEISIEKFMTPSAFIFLYENNLFLTFRNRTVAVWNFRGELVTSFEDHLLWHQDCSTNNIYITTDQDLIISYCKSDAASDDGTASPIGSINMSDIMTGKCIAKIAANDPSLSIAPRKNGSPSIWSSIPEALEDVTALFYDEDRNEIYTGNSQGLVHVWSS

SEQ ID NO: 12199 - protein, 243 aa, Pseudoroegneria spicata
  misc_feature (9)..(11): Xaa can be any naturally occurring amino acid
YSIPDTNVXXXKISPGIMLLIYDRTPSYVPLKILSIEDGKPLKLFKHLLHRGKKIDFIEQFNEKLLVKQEDENLQILDVRSSELIEISIEKFMTPSAFIFLYENNLFLTFRNRTVAVWNFRGELVTSFEDHLLWHQDCSTNNIYITTDQDLIISYCKSDAAADDGTASSLGSINMSDIMTGKCIAKIAANDPALSIAPRKNGSPSIWSSIPEALEDVTALFYDEDRNEIYTGNSQGLVHVWSS

SEQ ID NO: 12200 - protein, 454 aa, Oryza sativa
MEARRVSANPRPSCVRRVLARKRRRPEATANSARKLQRREISALPCRAFSASTTRERFRNIQLQEEFDTHDPKEMGSLLPYLMKRSEIIEIVGASDIIFALSQSGVCAAFSRVSNQRICFLNGRPDEVIRSLFYNKNNDSLITVSVYGSENFSALRCRTTRIEYIRRGKPDAGFPLFETESLKWPGFVEFDDVNGKVLTYSAQDSTYKVFDLKNYTLLYTISDKNVQEIKISPGIMLLIYSRKKGCIPLDILSIEDGKRLKSFKHLLHRNKKVDFIEQFNEKLLIKQEGENLQILDVRNFQSIEVSRSEFVTPSAFIFLYEMQLFLTFRSRSVSVWNFRGELVTSFEDHMLWHPDCNTNSIYITSNQDLIISYCKADPNDPSSEENACSINISEILTGKCLAKIKAGNLNKQRVSKFQSTPSEALGDITALYYDEEREEIYTGNRLGLVHVWSN

SEQ ID NO: 12201 - protein, 412 aa, Panicum virgatum
VPERFRNMRLQEEFDTYDHNAHLFVKLQFLRRRSKIIEIVAAKDIIFALAHSGLCAAFNRVTNKRIAFLNLSPDEVIRSLFYNKNNDSLITVSVYASDNFSTLKCRTTPIEYIRRNQLDAGFPLFESESLKWPGFVEFDDVNGKVLTYSAQDGIYKVFDLKNYSFLYSVPDENVQEIKISPGIMLLIYDRTPSYVPLKIISIEDGKPLKFFKHLLHRNKKIDFIEQFNEKLLVKQEDENFQILDVRTSELIEVSVSKFMTPSAFIFLYENNLFLTFRNRTVAVWNFRGELVTSFEDHLLWHHDCSTNNIYITSDQDLIISYCKSEVVAEDGTVTPIGSINMSEIMTGKCIAKIAASDPSLNVTPRRNCRKKRSSVWSTVPEALEDVTALFYDEDRNEIYTGNSHGLVHVWSN

SEQ ID NO: 12202 - protein, 339 aa, Panicum virgatum
DEVIRSLFYNKNNDSLITVSVYASDNFSTLKCRTTPIEYIRRNQLDAGFPLFESESLKWPGFVEFDDVNGKVLTYSAQDGIYKVFDLKNYSFLYSIPDENVQEIKISPGIMLLIYDRTPSYVQLKILSIEDGKPLKFFKHLLHRNKKIDFIEQFNEKLLVKQEDENFQILDVRTSELIEVSVSKFMTPSAFIFLYENNLFLTFRNRTVAVWNFRGELVTSFEDHLLWHHDCSTNNIYITSDQDLIISYCKSEVVAEDGTVTPIGSINMSEIMTGKCIAKIAASDPALNAIPRRNGRKKRSSVWSTVPEALEDVTALFYDEDRNEIYTGNSHGLVHVWSN

SEQ ID NO: 12203 - protein, 482 aa, Triticum aestivum
MDGPKRSQVRVRLRVTARRRGGDGADRAGPGGGTGGERKRRLDAPLINSAAKLQRREIGGRQLAARGGGAAAAVPERFRNMQLQEEFDTYDHDAHLFVKLQFLKKRSKIIEIVAAKDIIFALAHSGLCAAFSRVTNKRLSFLNLSPDEVIRSLFYNKNNDSLITVSVYASDHFSTLKCRTTPIEYIRRDQLDAGFPLFESESLKWPGFVEFDDVNGKVLTYSAQDGIYKVFDLKNYSFLYSIPDTNVQEIKISPGIMLLIYDRTPSYVPLKILSIEDGKPLKLFKHLLHRGKKIDFIEQFNEKLLVKQEDENLQILDVRSSELIEISIEKFMTPSAFIFLYENNLFLTFRNRTVAVWNFRGELVTSFEDHLLWHQDCSTNNIYITTDQDLIISYCKSDAAADDGTASSIGSINMSDIMTGKCIAKIAANDPALSIAPRKNGSPSIWSSIPEALEDVTALFYDEDRNEIYTGNSQGLVHVWSS

SEQ ID NO: 12204 - protein, 713 aa, Festuca arundinacea
  misc_feature (395)..(395): Xaa can be any naturally occurring amino acid
  misc_feature (552)..(552): Xaa can be any naturally occurring amino acid
GTRLYLLQFSCGLSHPNSAATYINVAMMEEGMGNVHVALRYLHEALKCNKRLLGADHIQTAASYHAIAIALSMMDAYSLSVQHEQTTLQILQEKLGEDDLRTQDAAAWLEYFDSKALEQQEAARRGIPKPDSSIASKGHLSVSDLLDYISPDQERKERDMQRKCRRAKNNTRAQQGESVEEKENFQYDSGSLLEAVKNDFQEAKLEPEAPVVSVVTEEVYAVHDELKQVEALSPEEYSDEGWQAATLRGRSANVRKKSIRRRPALAKLAVGRIEDGRTASVQRTDVQPQTKEHKEEAIYSPSQLSFGNFFNSDKLNGDPVITEDKSCNATSKSEQSIKPTGINRPTSIASKLVSYKDVAASPPGTVWKPILEQKEAKEKDTEEVTDVTPSSEEDXKLTDEVEKSSDEGSKEIVSSQPEGGSHSEKASDSDGSTSPHKKTSGSKLSASAPPFNPGSLLSVSHPYSTVAIYDASVVLQPIPSQAMEILPHAVDTRVPRGPRSTLYYRTGHSFQRKQGYTQSQSTILRGSTSPPAMNPHAAEFVPGKAVQQTDLXNGKHVADSADQQLTPQTSDEVKADIHAADKAGQVEKITPGKGKENRGEDAMRDSYKAELARQILLSFIVKSVHDSLGSTRAQPDRKPSVSDEPSNEQSSNITKPTSTRKEFDKQPKAAEVPKSEKDTEGFTVVSKRRRSKQHFMNPINGLYSQQSICTSVS

SEQ ID NO: 12205 - protein, 183 aa, Brassica juncea
IWSPANVCCVQFSAYSNHLLAFGSADYKVYCYDLRYVKTPWCTLAGHEKAVSYVKFMDSETIVTASTDNSLKLWNLNKTNSTGLSTGACSMTYKGHTNQKNFVGLSVLDGYIACGSETNEVYSYYRSLPMPMTSYKFGSVDPISGNEYFDDNGQFVSSVCWRKKSNMLVAANSTGNMKLLKLV

SEQ ID NO: 12206 - protein, 613 aa, Brassica napus
MKNLGVPSVTRKQSMSTWLEEQWYTCPEEINGEDIGEKSNIYALGVLLFELLCHCESSEMHAAMMADLRHRILPPAFLSRYPKEAGFCLWLLHPEPSSRPTAREILKSELICVEDSVKSTAADEEISELLLHFLSSLEKQKKKNASKLLQDIQTLEDDIKEAERRYSSRASLVRSHEATERKVQSSPIGEGSTTTSGALFVPTANTDRLMSNIRQLEDAYFIMRSQMKLSDSTASARSDKSLLKDKDKWSENQNKDQDARTKGKSSDQLEVFFEGLCKFARYSKFETCGTIRSGDLLNSASVVCSLSFDPDEEHIAAAGISKKIKIFDFNAFMNESVGVHYPLVEMVNKSKLSCVCWNSYIKNYLASTDYDGVVQIWDAGTGQGFSQYTEHQKRAWSVDFSPSDPTKFVSGSDDCSVKLWSVNEKRSLGTIWSPANVCCVQFSSYSNHLLAFGSADYKVYCYDLRYVKTPWCTLAGHEKAVSYVKFMDSETIVTASTDNSLKLWNLNKTNSSGLSPGACSMTYKGHTNQKNFVGLSVLDGYIACGSETNEVYSYYRSLPMPMTSYKFGSVDPVSGNEYFDDNGQFVSSVCWRKKSNMLVAANSTGNMKLLKLV

SEQ ID NO: 12207 - protein, 390 aa, Brassica napus
MRSQMKLSDSAASARSDKSLLKDKDKWSENQNKDQDARTKGKSSDQLEVFFEGLCKFARYSKFETCGTIRSGDLLNSASVVCSLSFDPDEEHIAAAGISKKIKIFDFNAFMNESVGVHYPLVEMVNKSKLSCVCWNSYIKNYLASTDYDGVVQIWDAGTGQGFSQYTEHQKRAWSVDFSPSDPTKFVSGSDDCSVKLWSVNEKRSLGTIWSPANVCCVQFSAYSNHLLAFGSADYKVYCYDLRYVKTPWCTLAGHEKAVSYVKFMDSETIVTASTDNSLKLWNLNKTNSTGLSTGACSMTYKGHTNQKNFVGLSVLDGYIACGSETNEVYSYYRSLPMPMTSYKFGSVDPISGNEYFDDNGQFVSSVCEKKSNMLVAANSTGNMKLLKLV

SEQ ID NO: 12208 - protein, 336 aa, Raphanus sativus
KFARYSKFETCGTIRSGDLLNSASVVCSLSFDPDEEHIAAAGISKKIKIFDFNAFMNESVGVHYPLVEMVNKSKLGCVCWNSYIKNYLASTDYDGVVQIWDAGTGQGFSQYTEHQKRAWSVDFSPSDPTKFVSGSDDCSVKLWSVNEKRSLGTIWSPANVCCVQFSAYSNHLLAFGSADYKVYCYDLRYVKTPWCTLAGHEKAVSYVKFVDSETIVTASTDNSLKLWNLNKTTSSGLSPGACSMTYKGHTNQKNFVGLSVLDGYIACGSETNEVYSYYRSLPMPMTSYKFGSVDPISGNEYFDDNGQFVSSVCWRKKSNMLVAANSTGNMKLLKLV

SEQ ID NO: 12209 - protein, 184 aa, Brassica rapa
  misc_feature (78)..(78): Xaa can be any naturally occurring amino acid
  misc_feature (141)..(141): Xaa can be any naturally occurring amino acid
TIWSPANVCCVQFSAYSNHLLAFGSADYKVYCYDLRYVKTPWCTLAGHEKAVSYVKFMDSETIVTASTDNSLKLWNLXKTNSTGLSTGACSMTYKGHTNQKNFVGLSVLDGYIACGSETNEVYSYYRSLPMPMTSYKFGSXDPISGNEYFDDNGQFVSSVCWRKKSNMLVAANSTGNMKLLKLV

SEQ ID NO: 12210 - protein, 442 aa, Brassica napus
TKLLQDIQTLEDDIKEAEQRYSSNASLVRSHGAMETRLQSSLMSNIHQLEDAYFFMRSQMKLSNSACHSDKSLLKDRDRWSENQNENQDTKTKGKSSDQVEVFFEGLCKFARYSKFETCGTIRSGDLLNSTASVVCSLSFDAEEEHIAAAGISKKIKIFDFNAFMNESVGVQYPLVEMVSKSKLSCVCWNSYIKNYLASTDYDGVVQIWDAGTGQGFSQYTEHQKRAWSVDFSPSDPTKFVSGSDDCSVKLWSVNEKRSLGTIWSPANVCCVQFSAYSNHLLAFGSADYKVYCYDLRYVKTPWCTLAGHEKTVSYVKFMDSETIVSASTDNSLKLWNLNKTGLSPGACPLTYKGHTNQKNFAGLSVLDGYIACGSETNEVYSYYKSLPMPMTSYKFGSVDPISGNECFDDNGQFVSSVCWRKKSNMLVAANSTGNMTLLKLV

SEQ ID NO: 12211 - protein, 106 aa, Brassica napus
MQGLDKDSPSIQNIRREPGQLIFSPSDPTKFVSGSDDCSVKLWSVNEKRSLGTIWSPANVCCVQFSSYSNHLVAFGSADYKVYCYDLGTSELLGAHCLAMRKLLAM

SEQ ID NO: 12212 - protein, 165 aa, Brassica oleracea
LLAFGSADYKVYCYDLRYVKTPWCTLAGHEKAVSYVKFMDSETIVTASTDNSLKLWNLNKTNSSGLSPGACSMTYKGHTNQKNFVGLSVLDGYIACGSETNEVYSYYRSLPMPMTSYKFGSVDPVSGNEYFDDNGQFVSSVCWRKKSNMLVAANSTGNMKLLKLV

SEQ ID NO: 12213 - protein, 77 aa, Cleome spinosa
HYPLVEMCNKSKLSCVCWNSYIKTTWPQLTMMVWFRYGMLGLDKDFLSTRSIREEPGQLIFLHLTRQSLSAEVMIVL

SEQ ID NO: 12214 - protein, 370 aa, Brassica rapa
MMKFSEMLGTHEAGASQDPYGQRTLSRRKFVNQLGPSRSSMMGVNLQSESQGSGTSHYPHMPNQYMATSGFGNPYSTVPVVSAFQRPDVNKNQLMHPSYNPASAISANMVTDAAARPSTMTPQEKLEKLRRRQQMQAMLAIQRQQQQFRHQVPVADQSITQLVDKTSLQGLTAIPSFDPNSSLELDDSGNFAAAVDNPSEFSVLYRLQDVVAKLDMETRTCIRDSLFRLADSAGQRHHTSDTPHSNKTSQDDQEVIPQEKSRYRYAGMLDTETVTNPTDRTVAHLLFHRPFDMSAAKHTEGLESPSSSKMGTEVKGSFPSTRESHMNKQKAKEEDVPAGSTALGYASNSGSSSTVGERVNEASQGNKRKL

SEQ ID NO: 12215 - protein, 149 aa, Brassica juncea
RKRKNNAIGCNIGHFDNEIDMQGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGARLTKLTKDQSDYVSIPIEGPYKPGHYRY

SEQ ID NO: 12216 - protein, 408 aa, Brassica napus
ARKSDGAPRNISQPKDHAAAAIARDSAAVFAWKGETLQEYWWCTERALDWGPGGGPDLIVDDGGDATLLIHEGVKAEEIFEKTGQVPDPTSTDNPEFQIVLSIIKEGLQVDPKKYHKMKERLVGVSEETTTGVKRLYQMQESGALLFPAINVNDSVTKSKFDNLYGCRHSLPDGLMRATDVMIAGKVAVICGYGDVGKGCAAAMKTAGARVIVTEIDPICALQAMMEGLQVLTLEDVVSEADIFVTTTGNKDIIMVDHMRKMKNNAIVCNIGHFDNEIDMQGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPIEGPYKPAHYRY

SEQ ID NO: 12217 - protein, 144 aa, Brassica napus
MLLFVNIGHFDNEIDMLGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPIEGPYKPAHYRY

SEQ ID NO: 12218 - protein, 254 aa, Eutrema halophilum
MALLVEKTSSGREYKVKDMSQADFGRLEIELAEVEMPGLVSCRTEFGPSQPLKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKTGQFPDPTSTDNPEFQIVLSIIKDGLQVDPKKYHKMKERLVGVSEETTTGVKRLYQMQETGTLLFPAINVNDSVTKSKVLDLTCMDVVTLSLTVS

SEQ ID NO: 12219 - protein, 210 aa, Brassica juncea
GCAAAMKTAGARVIVTEIDPICALQAMMEGLQVLTLEDVVSEADIFVTTTGNKDIIMVDHMRKMKNNAIVCNIGHFDNEIDMLGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPIEGPYKPAHYRY

SEQ ID NO: 12220 - protein, 348 aa, Brassica juncea
DDGGDATLLIHEGVKAEEIFAKTRQLPDPTSTDNPEFQIVLSIIKDGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMLGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGARLTKLTKDQSDYVSIPVEGPYKPVHYRY

SEQ ID NO: 12221 - protein, 194 aa, Brassica juncea
EIDPICALQAMMEGLQVLTLEDVVSEADIFVTTTGNKDIIMVDHMRKMKNNAIVCNIGHFDNEIDMLGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPIEGPYKPAHYRY

SEQ ID NO: 12222 - protein, 212 aa, Brassica juncea
GKGCAAAMKTAGARVIVTEIDPICALQAMMEGLQVLTLEDVVSEADIFVTTTGNKDIIMVDHMRKMKNNAIVCNIGHFDNEIDMLGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPIEGPYKPAHYRY

SEQ ID NO: 12223 - protein, 201 aa, Brassica juncea
GARVIVTEIDPICALQAMMEGLQVLTLEDVVSEADIFVTTTGNKDIIMVDHMRKMKNNAIVCNIGHFDNEIDMQGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPIEGPYKPAHYRY

SEQ ID NO: 12224 - protein, 270 aa, Brassica juncea
MQESGALLFPAINVNDSVTKSKFDNLYGCRHSLPDGLMRATDVMIAGKVAVICGYGDVGKGCAAAMKTAGARVIVTEIDPICALQAMMEGLQVLTLEDVVSEADIFVTTTGNKDIIMVDHMRKMKNNAIVCNIGHFDNEIDMLGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPIEGPYKPAHYRY

SEQ ID NO: 12225 - protein, 180 aa, Raphanus sativus
LQVLTLEDVVSEADIFCTTTGNKDIIMVDHMRKMKNNAIVCNIGHFDNEIDMLGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGARLTKLTKDQSDYVSIPVEGPYKPVHYRY

SEQ ID NO: 12226 - protein, 198 aa, Raphanus sativus
VIVTEIDPICALQAMMEGLQVLTLEDVVSEADIFVTTTGNKDIIMVDHMRKMKNNAIVCNIGHFDNEIDMLGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPIEGPYKPAHYRY

SEQ ID NO: 12227 - protein, 210 aa, Raphanus sativus
  misc_feature (75)..(75): Xaa can be any naturally occurring amino acid
GCAAAMKTAGARVIVTEIDPICVLQAMMEGLQVLTLEDVVSEADIFVTTTGNKDIIMVDHMRKMKNNAIVCNIGXFDNEIDMLGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPIEGPYKPAHYRY

SEQ ID NO: 12228 - protein, 173 aa, Raphanus sativus
  misc_feature (5)..(5): Xaa can be any naturally occurring amino acid
  misc_feature (30)..(30): Xaa can be any naturally occurring amino acid
GCRLXSDIFVTTTGNKDIIMVDHMRKMKNXAIVCNIGHFDNEIDMLGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPIEGPYKPAHYRY

SEQ ID NO: 12229 - protein, 87 aa, Brassica napus
PTSTDNPVVSDRVSIIKDGLQVDPKKYHKMKERLVGVSEETTTGVKRLYQMQETGALLFPAITLMTPSPRASLTTCMDVATLSLTVS

SEQ ID NO: 12230 - protein, 269 aa, Brassica napus
QETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMQGLETYPGVKRITIKPQTDRWVFPDTKSGIIVLAEGRLMNLGCATGHPSFVMSCSFTNQVIAQLELWNEKSSGKYEKKVYVLPKHLDEKVAALHLGKLGARLTKLTKDQSDYVSIPVEGPYKPVSYRY

SEQ ID NO: 12231 - protein, 103 aa, Brassica napus
KDIIMVDHMRKMKNNAIVCNIGHFDNEIDMQGLETFPGVKRITIKPQTDRWVFPDTKSGIIVLAEGRLMNLGCATGHPSFVMSCSFTNQVIAQLESLEREVER

SEQ ID NO: 12232 - protein, 255 aa, Eutrema parvulum
MALLVEKTSSGREYKVKDMSQADFGRLEIELAEVEMPGLVSCVTEFGPSQPLKGARITGSLHMTIQTAVLIETLTKLGAEVRWCSCNIFSTQDHAAAAIARDSAAVFAWKGETLQEYWWCTERALDWGPGGGPDLIVDDGGDATLLIHEGVKAEEIFAKNGQLPDPTSTENPEFQIVLSIIKDGLQVDPKKYHKMKERLVGVSEETTTGVKRLYQMQETGTLLFPAINVNDSVTKSKVSIYLTCMDVATLSLTVS

SEQ ID NO: 12233 - protein, 202 aa, Brassica juncea
AGARVIVTEIDPICALQALMEGLQVLTLEDVVSEADIFCTTTGNKDIIMVDHMRKMKNNAIVCNIGHFDNEIDMQGLETYPGVKRITIKPQTDRWVFPDTKSGIIVLAEGRLMNLGCATGHPSFVMSCSFTNQVIAQLELWNEKSSGKYEKKVYVLPKHLDEKVAALHLGKLGARLTKLTKDQSDYVSIPVEGPYKPVSYRY

SEQ ID NO: 12234 - protein, 241 aa, Brassica juncea
RHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMQGLETYPGVKRITIKPQTDRWVFPDTKSGIIVLAEGRLMNLGCATGHPSFVMSCSFTNQVIAQLELWNEKSSGKYEKKVYVLPKHLDEKVAALHLGKLGARLTKLTKDQSDYVSIPVEGPYKPVSYRY

SEQ ID NO: 12235 - protein, 334 aa, Brassica juncea
GVKAEEIFEKTGQVPDPSSTDNPEFQIVLSIIKEGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQAMMEGLQVLTLEDVVSEADIFVTTTGNKDIIMVDHMRKMKNNAIVCNIGHFDNEIDMLGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPIEGPYKPAHY

SEQ ID NO: 12236 - protein, 147 aa, Brassica nigra
DEEHAIVCNIGHFDNEIDMLGLETFPGVKRITIKPQTDRWVFPDTKSGIIVLAEGRLMNLGCATGHPSFVMSCSFTNQVIAQLELWNERSSGKYEKKVYVLPKHLDEKVAALHLGKLGAKLTKLTKDQSDYVSIPIEGPHKPAHYRY

SEQ ID NO: 12237 - protein, 262 aa, Thellungiella halophila
  misc_feature (123)..(123): Xaa can be any naturally occurring amino acid
ARGINVNDSVTKSKFDNLYGCRHSLPDGLMRATDVMIAGKVAVICGYGDVGKGCAAAMKTAGARVIVTEIDPICALQALMEGLQVLTLEDVVSEADIFVTTTGNKDIIMVDHMRKMKNNAIVXNIGHFDNEIDMLGLETYPGVKRITIKPQTDRWVFPETKTGIIVLAEGRLMNLGCATGHPSFVMSCSFTNQVIAQLELWNEKSSGKYEKKVYVLPKHLDEKVAALHLGKLGARLTKLSKDQSDYISIPIEGPYKPAHYRY

SEQ ID NO: 12238 - protein, 364 aa, Solanum tuberosum
ERALDWGPGGGPDLIVDDGGDATLLIHEGVKAEEEFAKNGTIPDPTSTDNVEFQLVLTIIKESLKTDPLRYTKMKERLVGVSEETTTGVKRLYQMQANGTLLFPAINVNDSVTKSKFDNLYGCRHSLPDGLMRATDVMIAGKVALVAGYGDVGKGCAAAMKQAGARVIVTEIDPICALQATMEGLQVLPLEDVVSEVDIFVTTTGNKDIIMVDHMRKMKNNAIVCNIGHFDNEIDMHGLETFPGVKRITIKPQTDRWVFPDTKSGIIVLAEGRLMNLGCATGHPSFVMSCSFTNQVIAQLELWNERSSGKYEKKVYVLPKHLDEKVAALHLGKLGAKLTKLTKDQADYISIPVEGPYKPAHYRY

SEQ ID NO: 12239 - protein, 188 aa, Papaver somniferum
  misc_feature (20)..(21): Xaa can be any naturally occurring amino acid
ALQALMEGIPVQTLEDVVDXXDIFVTTTGNKDIIMLSHMRKMKNNAIVCNIGHFDNEIDMAGLETFPGVQRITIKPQTDRWVFPDTKSGIIILAEGRLMNLGCATGHPSFVMSCSFTNQVIAQLELWNERKSGKYAKKVYVLPKHLDEKVAALHLGKLGAKLTKLTKDQSDYISIPIEGPYKPAHYRY

SEQ ID NO: 12240 - protein, 184 aa, Solanum lycopersicum
MKGSNLLVKVLWQDVHLLLVFATAPLIPQLELSNDLVSERARHHKTRVSSGTSQVHETTLGQHNDATVGVWEDPSVGLWLDCDPLHTREGLKTMHVDFVVKVTNVADNSIVLHLPHVVNHNDVLVTSGGHKDINLRNNILKRKNLEAFHGSLESTDWVNLSHNHTGTSLFHGSSTSLADISITS

SEQ ID NO: 12241 - protein, 244 aa, Ocimum basilicum
YGCRHSLPDGLMRATDVMIAGKVGVVFGYGDVGKGCAAALKQAGARVIVTEIDPICALQALMEGFQVLRLEDVVSEADIFVTTTGNKDIIMVSDMRKMKNNAIVCNIGHFDNEIDMHGLETYPGVKRITIKPQTDRWVFPDTKSGIIVLAEGRLMNLGCATGHPSFVMSCSFTNQVIAQLELWNERNSGKYEKKVYVLPKHLDEKVAALHLGKLGAKLTKLSKDQADYISVPIEGPYKPAHYRY

SEQ ID NO: 12242 - protein, 173 aa, Ocimum basilicum
DVVSEADMFVTTTGNKDIIMVSDMRKMKNNAIVCNIGHFDNEIDMHGLETYPGVKRITIKPQTDRWVFPDTKSGIIVLAEGRLMNLGCATGHPSFVMSCSFTNQVIAQLELWKERSSGKYEKKVYVLPKHLDEKVAALHLGKLGAKLTKLSKDQADYISVPIEGPYKPAHYRY

SEQ ID NO: 12243 - protein, 320 aa, Cleome spinosa
PSSTDNPEFQIVLQIIKDGLPVDPKKYHKMKERLVGVSEETTTGVKRLYQMQVNGTLLFPAINVNDSVTKSKFDNLYGCRHSLPDGLMRATDVMIAGKVGVVCGYGDVGKGCALALKAAGARVIVTEIDPICALQALMEGFQILTLEDVVSEADTFVTTTGNKDIIMVDHMRKMKNNAIVCNIGHFDNEIDMHGLETFPGVKRITIKPQTDRWVFPDTKTGIIVLAEGRLMNLGCATGHPSFVMSCSFTNQVIAQLELWKEKATGKYEKKVYVLPKHLDEKVAALHLGKLGARLTKLSKDQSDYISVPIEGPYKPPHYRY

SEQ ID NO: 12244 - protein, 156 aa, Nicotiana benthamiana
IIMVDHMRKMKNNAIVCNIGHFDNEIDMLGLETYPGVKRITIKPQTDRWVFPDTNSGIIVLAEGRLMNLGCATGHPSFVMSCSFTNQVIAQLELWNEKSSGKYEKKVYVLPKHLDEKVAALHLGKLGAKLTKLSKDQADYISVPVEGPYKPAHYRY

SEQ ID NO: 12245 - protein, 291 aa, Petunia hybrida
MKERLVGVSEETTTGVKRLYQMQANGTLLFPAINVNDSVTKSKFDNLYGCRHSLPDGLMRATDVMIAGKVAVVAGYGDVGKGCASALKQAGARVIVTEIDPICALQALMEGLQVLTLEDVVSDADIFVTTTGNKDIIMVDHMRKMKNNAIVCNIGHFDNEIDMLGLETFPGVKRITIKPQTDRWVFPDTNSGIIVLAEGRLMNLGCATGHPSFVMSCSFTNQVIAQLELWKEKSTGKYEKKVYVLPKHLDEKVAALHLGKLGARLTKLSKDQSDYISVPVEGPYKPAHYRY

SEQ ID NO: 12246 - protein, 202 aa, Solanum tuberosum
AGARVIVTEIDPICALQATMEGLQVLPLEDVVSEVDIFVTTTGNKDIIMVDHMRKMKNNAIVCNIGHFDNEIDMHGLETFPGVKRITIKPQTDRWVFPDTNSGIIVLAEGRLMNLGCATGHPSFVMSCSFTNQVIAQLELWNERSSGKYEKKVYVLPKHLDEKVAALHLGKLGAKLTKLTKDQADYISVPVEGPYKPVHYRY

SEQ ID NO: 12247 - protein, 174 aa, Salvia sclarea
TRPWLSLNIFVTTTGNKDIIMLSHMRKMKNNAIVCNIGHFDNEIDMHGLETFPGVKRITIKPQTDRWVFPDTKTGIIVLAEGRLMNLGCATGHPSFVMSCSFTNQVIAQLELWNEKSSGKYEKKVYVLPKHLDEKVAALHLGKLGAKLTKLSKDQADYISVPVEGPYKPAHYRY

SEQ ID NO: 12248 - protein, 162 aa, Solanum lycopersicum
MKGSNLLVKVLWQDVHLLLVFATAPLIPQLELSNDLVSERARHHKTRVSSGTSQVHETTLGQHNDATVGVWEDPSVGLWLDCDPLHTREGLKTMHVDFVVKVTNVADNSIVLHLPHVVNHNDVLVTSGGHKDINLRNNILKRKNLEAFHGSLESTDWVNLSH

SEQ ID NO: 12249 - protein, 105 aa, Brassica napus
MLGLETFPGVKRITIKPQDRQVGGSPDTKSGIIVLAEGRLMNLGCATGHPSFVMSCSFTNQVIAQLELWNEKSSGKYEKKCRLPSIWTRRLQLFTWESLELSSPS

SEQ ID NO: 12250 - protein, 251 aa, Vitis vinifera
MSLLVEKTSSGREYKVKDMSQADFGRLEIELAEVEMPGLMSCRTEFGPQQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYAKSGKLPDPSSTDNAEFQIVLTIIRDGLKTDPKRYHKMKGRLVGVSEETTTGVKRLYQMQANGTLLFPAINVNDSVTKSKVLVRQFVWMPPFTP

SEQ ID NO: 12251 - protein, 183 aa, Cenchrus ciliaris
MEGLQVLTLEDVVSEADIFVTTTGNKDIIMVDHMRKMKNNAIVCNIGHFDNEIDMHGLETYPGVKRITIKPQTDRWVFPETKTGIIVLAEGRLMNLGCATGHPSFVMSCSFTNQVIAQLELWKEKSSGKYEKKVYVLPKHLDEKVAALHLGKLGARLTKLTKSQADYISVPVEGPYKPAHYRY

SEQ ID NO: 12252 - protein, 191 aa, Setaria italica
PICALQALMEGLQVLTLEDVVSEADIFVTTTGNKDIIMVDHMRKMKNNAIVCNIGHFDNEIDMHGLETYPGVKRITIKPQTDRWVFPETKTGIIVLAEGRLMNLGCATGHPSFVMSCSFTNQVIAQLELWNEKATGKYEKKVYVLPKHLDEKVAALHLGKLGARLTKLTKSQSDYISIPVEGPYKPAAYRY

SEQ ID NO: 12253 - protein, 218 aa, Pseudoroegneria spicata
CGYGDVGKGCAAALKQAGARVIVTEIDPICALQALMEGIQILTLEDVVSEADIFVTTTGNKDIIMVDHMRKMKNNAIVCNIGHFDNEIDMNGLETYPGVKRITIKPQTDRWVFPETKTGIIVLAEGRLMNLGCATGHPSFVMSCSFTNQVIAQLELWNEKATGKYEKKVYVLPKHLDEKVAALHLGKLGAKLTKLTKSQSDYISIPIEGPYKPAAYRY

SEQ ID NO: 12254 - protein, 176 aa, Salvia sclarea
ARGDVVSEADIFVTTTGNKDIIMLDHMRKMKNNAIVCNIGHFDNEIDMHGLETFPGVKRITIKPQTDRWVFPDTKTGIIILAEGRLMNLGCATGHPSFVMSCSFTNQVIAQLELWNEKTSGKYEKKVYVLPKHLDEKVAALHLGKLGARLTKLSKDQADYISVPVEGPYKPAHYRY

SEQ ID NO: 12255 - protein, 247 aa, Panicum virgatum
DNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMHGLETYPGVKRITIKPQTDRWVFPETKTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 12256 - protein, 232 aa, Camellia sinensis
RATDVMIAGKVAVVCGYGDVGKGCAAAMKQAGARVIVTEIDPICALQALMEGLQVLTLEDVVSEADIFVTTTGNKDTIMVHHMRKMKNNAIVCNIGHFDNEIDMHGLETYPGVKRITIKPQTDRWVFPDTKSGIIVLAEGRLMNLGCATGHPSFVMSCSFTNQVIAQLELWKEKSTGKYEKKVYVLPKHLDEKVAALHLGKLGAKLTILTKDQADYIRIPVEGPYKPAHYRY

SEQ ID NO: 12257 - protein, 406 aa, Nicotiana tabacum
EVRWCSCNIFSTQDHAAAAIARDSAAVFAWKGETLQEYWWCTERALDWGPGGGPDLIVDDGGDATLLIHEGVKAEEEYAKSGKLPDPSSTDNAEFQLVLTIIRDGLKTDPLKYTKMKERLVGVSEETTTGVKRLYQMQANGTLLFPAINVNDSVTKSKFDNLYGCRHSLPDGLMRATDVMIAGKVALVAGYGDVGKGCAAALKQAGARVIVTEIDPICALQATMEGLQVLTLEDVVSDVDIFVTTTGNKDIIMVDHMRKMKNNAIVCNIGHFDNEIDMLGLETFPGVKRITIKPQTDRWVFPDTNSGIIVLAEGRLMNLGCATGHPSFVMSCSFTNQVIAQLELWKEKSTGKYEKKVYVLPKHLDEKVAALHLGKLGARLTKLSKDQADYISVPVEGPYKPPHYRY

SEQ ID NO: 12258 - protein, 62 aa, Triticum aestivum
MALSVEKTSSGREYKVKDLSQADFGRLELDLAEVEMPGLMACRTEFGPSQPFKAPGSPAPST

SEQ ID NO: 12259 - protein, 385 aa, Fagopyrum esculentum
RDSAAVFAWKGETLQEYWWCTERALDWGPGGGPDLIVDDGGDTTLLIHEGVKAEEEYAKTGKLPDPSSTDNAEFKIVLTIIKDGLKADPQKYHKMKDRVVGVSEETTTGVKRLYQMQANGSLLFPAINVNDSVTKSKFDNLYGCRHSLPDGLMRATDVMIAGKVGVVCGYGDVGKGCAAALKAGGARVIVTEIDPICALQALMEGYQVLTLEDVVADADIFVTTTGNKDIIMLEHMKKMKNNAIVCNIGHFDNEIDMQGLETYPGIKRITIKPQTDRFVFPETKNGVIVLAEGRLMNLGCATGHPSFVMSCSFTNQVIAQLELWNEKSSGKYEKKVYVLPKHLDEKVAALHLGKLGARLTKLSKDQADYISVPVEGPYKPPHYRY

SEQ ID NO: 12260 - protein, 147 aa, Linum usitatissimum
MKNNAIVCNIGHFDNEIDMNGLETFPGVKRITIKPQTDRWVFPDTKSGIIVLAEGRLMNLGCATGHPSFVMSCSFTNQVIAQLELWNERASGKYEKKVYVLPKHLDEKVASLHLGKLGARLTKLSKDQADYISVPVEGPYKPAQYRY

SEQ ID NO: 12261 - protein, 364 aa, Olea europaea
TERALDWGPGGGPDLIVDDGGDATLLIHEGFKAEEEYEKTGKVPDRFDRHAEFQIVLTIIRDGLKSDPKKYTRMKERLVGVSEETTTGVKRLYQMQANGTLLFPAINVNDSVTKSKFDNLYGCRHSLPDGLMRATDVMIAGKVAVVAGYGDVGKGCAAALKQAGARVIVTEIDPICALQALMEGLQVLTLEDVVSEADIFVTTTGNKDIIMVDHMRKMKNNAIVCNIGHFDNEIDMHGLETYPGVKRITIKPQTDRWVFPDTNSGIIVLAEGRLMNLGCATGHPSFVMSCSFTNQVIAQLELWNERKTGKYEKKVYVLPKHLDEKVAALHLGKLGAKLTKLSKDQADYISIPVEGPYKPPHYRY

SEQ ID NO: 12262 - protein, 292 aa, Phaseolus coccineus
KMKQRLVGVSEETTTGVKRLYQMQANGTLLFPAINVNDSVTKSKFDNLYGCRHSLPDGLMRATDVMIAGKVAVVAGYGDVGKGCAAALKQAGARVIVTEIDPICALQALMEGLQVLTLEDVVSDADIFVTTTGNKDIIMVDHMRKMKNNAIVCNIGHFDNEIDMLGLENYPGVKRITIKPQTDRWVFPETNTGIIVLAEGRLMNLGCATGHPSFVMSCSFTNQVIAQLELWNEKSSGKYEKKVYVLPKHLDEKVAALHLGKLGARLTKLSKDQADYISVAVEGPYKPTHYRY

SEQ ID NO: 12263 - protein, 194 aa, Brachypodium distachyon
MALSVEKTSSGREYKVKDLSQADFGRLELELAEVEMPGLMACRTEFGPSQPFKGARISGSLHMTIQTAVLIETLTALGAEVRWCSCTSSPPRTTPPPPSRATRPPSSHGRGRRSRSTGGARSDASTGASAVGPTSSSTTAVTPRCSSMRVLRPRRSSRSPARSPTRSPPTTPSSRSCSPSSVMGSRPTPGSTAR

SEQ ID NO: 12264 - protein, 97 aa, Cynodon dactylon
RKMKERLVGVSEETTTGVKRLYQMQESGTLLFPAINVNDSVTKSKFDNLYGCRHSLPDGLMRATDVMIAGKVAVVCGYGDVGKGCAAALNRLVPVSL

SEQ ID NO: 12265 - protein, 137 aa, Solanum melongena
GHFDNEIDMHGLETFPGVKRITIKPQTDRWVFPDTNSGIIVLAEGRLMNLGCATGHPSFVMSCSFTNQVIAQLELWKEKNSGKYEKKVYVLPKHLDEKVAALHLGKLGAKLTKLSKEQADYISVPIEGPYKPAHYRY

SEQ ID NO: 12266 - protein, 186 aa, Solanum melongena
QATMEGLQVLPLEDVVSEVDIFVTTTGNKDIIMVDHMRKMKNNAIVCNIGHFDNEIDMHGLETFPGVKRITIKPQTDRWVFPDTNSGIIVLAEGRLMNLGCATGHPSFVMSCSFTNQVIAQLELWKEKNSGKYEKKVYVLPKHLDEKVAALHLGKLGAKLTKLTKEQADYISVPVEGPYKPAHYRY

SEQ ID NO: 12267 - protein, 380 aa, Setaria italica
VFAWKGETLEEYWWCTERCLDWGEGGGPDLIVDDGGDATLLIHEGVKAEEEYEKTGKVPDPESTDNAEFKIVLTIIRDGLKSDPKRYRKMKERLVGVSEETTTGVKRLYQMQETGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMHGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLSKSQSDYISVPIEGPYKPAHYRY

SEQ ID NO: 12268 - protein, 157 aa, Lolium multiflorum
DIIMVDHMRKMKNNAIVCNIGHFDNEIDMNGLETYPGVKRITIKPQTDRWVFPETKTGIIVLAEGRLMNLGCATGHPSFVMSCSFTNQVIAQLELWNERKSGKYEKKVYVLPKHLDEKVAALHLGKLGAKLTKLTKSQSDYISIPVEGPYKPAAYRY

SEQ ID NO: 12269 - protein, 273 aa, Eragrostis curvula
WPPRLCRHPSSFPAINVNDSVTKSKFDNLYGCRHSLPDGLMRATDVMIAGKVAVVCGYGGVGKGCAAALKQAGARVIVTEIGPICALQALMEGLQVLTLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGARLTKLSKSQADYISVPIEGPYKPAHYRY

SEQ ID NO: 12270 - protein, 75 aa, Tropaeolum majus
MALIVEKTTSGREYKVKDMSQADFGRLEIELAEVEMPGLISCRTEFGPSQPFKGARIPHDHPNRCSDRDSDCSWS

SEQ ID NO: 12271 - protein, 402 aa, Saccharum officinarum
CSCNIFSTQDHAAAAIARDSAAVFAWKGETLEEYWWCTERCLDWGEGGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 12272 - protein, 122 aa, Triticum aestivum
LYGCRHSLPDGLMRATNVMIAGKVAVVCGYGDVGKGCAAALKQAGAHFIITEIDPICTHQGLMEGIQILTLEDVVSEADIFVTTTGNKDIIMVDHMRKMKNNAIVCNIGHFDNEIDMNGLET

SEQ ID NO: 12273 - protein, 143 aa, Cirsium arvense
PSSATSVTSTTKSTCLDLKPTPVFKESPSNPKPTGGSSPKPRLASLFLAEGRLMNLGCATGHPSFVMSCSFTNQVIAQLELWNEKSTGKYKKEVYVLPKHLDEKVAALHLGKLGAKLTKLTKDQADYISVPVEGPYKPAHYRY

SEQ ID NO: 12274 - protein, 246 aa, Cucurbita pepo
NLYGCRHSLPDGLMRATDVMIAGKVAVVCGYGDVGKGCASALKQAGARVIVTEIDPICALQALMEGLPVLTLEDVLSEADIFVTTTGNKDIIMVDHMRKMKNNAIVCNIGHFDNEIDMLGLESYPGVKRITIKPQTDRWVFPETNSGIIVLAEGRLMNLGCATGHPSFVMSCSFTNQVIAQLELWNERTSGKYEKKVYVLPKHLDEKVAALHLGKLGARLTKLSKDQADYINVPVEGPYKPAHYRY

SEQ ID NO: 12275 - protein, 210 aa, Euphorbia peplus
GCAAALKQAGSRVIVTEIDPICALQALMEGFQVLTLEDVVSEADIFVTTTGNKDIIMVNHMRKMKNNAIVCNIGHFDNEIDMHGLETFPGVKRITIKPQTDRWVFPDTNSGIIVLAEGRLMNLGCATGHPSFVMSCSFTNQVIAQLELWKEKASGKYEKKVYVLPKHLDEKVAALHLGKLGAKLTKLSKEQADYISVPVEGPYKPAHYRY

SEQ ID NO: 12276 - protein, 158 aa, Platanus occidentalis
KDIIMVDHMRKMKNNAIVCNIGHFDNEIDMLGLETFPGVMRITIKPQTDRWVFPDTKSGVIVLAEGRLMNLGCATGHPSFVMSCSFTNQVIAQLELWKEKSTGKYEKKVYVLPKHLDEKVAALHLGKLGAKLTKLTADQADYISVPVEGPYKPAQYRY

SEQ ID NO: 12277 - protein, 227 aa, Scabiosa columbaria
RATDVMIAGKVAVVCGYGDVGKGCASAMKQAGARVIVTEIDPICALQALMEGFQVLTLEDAVSEADIFVTTTGNKDIIMVNHMRKMKNNAIVCNIGHFDNEIDMMGLETYPGVKRITIKPQTDRWVFPDTKTGILVLAEGRLMNLGCATGHPSFVMSCSFTNQVIAQLELWNERTSGKYEKKVYVLPKHLDEKVAALHLGKLGAKLTKLTKDQSDYISIPIEGPYKP

SEQ ID NO: 12278 - protein, 193 aa, Thalictrum flavum
IDPICALQALMEGFQVLPLEDVVSDADIFVTTTGNKDIIMVDHMRKMKNNAIVCNIGHFDNEIDMQGLETFPGVKRITIKPQTDRWVFPDTKSGVIILAEGRLMNLGCATGHPSFVMSCSFTNQVIAQLELWNERNSGKYEKKVYVLPKHLDEKVAQLHLGKLGAKLTKLTPDQSEYISIPVEGPYKPAHYRY

SEQ ID NO: 12279 - protein, 358 aa, Amaranthus tuberculatus
GPGGGPDLIVDDGGDATLLIHEGVKAEEEFEKTGKVPDPSSTDNVEFQLVLGLIRDSLKVDPKRYHKMKERLVGVSEETTTGVKRLYQMQANGTLLFPAINVNDSVTKSKFDNLYGCRHSLPDGLMRATDVMIAGKVGVVCGYGDVGKGCALALKAAGARVIVTEIDPICALQALMEGFQVLTLEDVVSEADIFVTTTGNKDIIMVDHMKKMKNNAIVCNIGHFDNEIDMAGLENYPGIKRVTIKPQTDRFVFPETKTGIIVLAEGRLMNLGCATGHPSFVMSCSFTNQVIAQLELWNEKASGKYEKKVYVLPKHLDEKVAALHLGKLGAKLTKLSKDQADYISVPVEGPYKPAHYRY

SEQ ID NO: 12280 - protein, 338 aa, Ocimum basilicum
HEGVKAEEEYEKSGTLPDPSSTDNAEFQIVLTLIRDGLKADPSKYRKMKERLVGVSEETTTGVKRLYQMQANGTLLFPAINVNDSVTKSKFDNLYGCRHSLPDGLMRATDVMIAGKVGVVCGYGDVGKGCAVALKQAGARVIVTEIDPICALQALMEGFQVLTLEDVLADADIFVTTTGNKDIIMVDHMRKMKNNAIVCNIGHFDNEIDMQGLETYPGVKRITIKPQTDRWVFPETNTGIIVLAEGRLMNLGCATGHPSFVMSCSFTNQVIAQLELWKERSSGKYEKKVYVLPKHLDEKVAALHLGKLGAKLTKLTKDQADYISVPVEGPYKPPHYRY

SEQ ID NO: 12281 - protein, 145 aa, Gossypium hirsutum
MSSGPLQHWSLDNEIDMPGLETYPGVKRITIKPQTDRWVFPETKTGIIVLAEGRLMNLGCATGHPSFVMSCSFTNQVIAQLELWKEKATGKYEKKVYVLPKHLDEKVAALHLGKLGAKLTKLTKDQADYISVPVEGPYKPPHYRY

SEQ ID NO: 12282 - protein, 412 aa, Gossypium hirsutum
MTIQTAVLIETLTALGAEVRWCSCNIFSTQDHAAAAIARDSAAVFAWKGETLQEYWWCTERALDWGPTGGPDLIVDDGGDATLLIHEGVKAEEVYEKTGQLPDPASTDNAEFQIVLTIIRDGLKADPKKYRRMKERLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETKTGIIVLAEGRLMNLGCATGHPSFVMSCSFTNQVIAQLELWKEKATGKYEKKVYVLPKHLDEKVAALHLGKLGAKLTKLTKDQADYISVTC

SEQ ID NO: 12283 - protein, 163 aa, Solanum melongena
TTTGNKDIVMVDHMRKMKNNAIVCNIGHFDNEIDMHGLETFPGVKRITIKPQTDRWVFPDTKSGIIVLAEGRLMNLGCATGHPSFVMSCSFTNQVIAQLELWKEKGSGKYEKKVYVLPKHLDEKVAALHLGQLGAKLTKLSKDQADYIGVPVEGPYKPAHYRY

SEQ ID NO: 12284 - protein, 332 aa, Eucalyptus grandis
  misc_feature (180)..(180): Xaa can be any naturally occurring amino acid
EEIFAKTGKLPDPASTDNAEFQLVLTIIRDGLKTDPQRYHKMKDRLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGLQVLPLQDVVSEADIFVTTTGNKDIIMXHDMKKMKNNAIVCNIGHFDNEIDMHGLENFPGVKRITIKPQTDRWVFPDTKSGIIVLAEGRLMNLGCATGHPSFVMSCSFTNQVIAQLELWKEKSSGKYKKEVYVLPKHLDEKVAALHLGKLGAKLTKLSKEQADYISVPVEGPYKPPHYRY

SEQ ID NO: 12285 - protein, 364 aa, Leymus cinereus x Leymus triticoides
ERCLDWGVGGGPDLIVDDGGDATLLIHEGVKAEEEFEKSGKVPDPESTDNPEFKIVLTIIRDGLKTDANKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSEADIFVTTTGNKDIIMVDHMRKMKNNAIVCNIGHFDNEIDMNGLETYPGVKRITIKPQTDRWVFPETNTGIIVLAEGRLMNLGCATGHPSFVMSCSFTNQVIAQLELWNEKATGKYEKKVYVLPKHLDEKVAALHLGKLGAKLTKLTKSQSDYISIPVEGPYKPAAYRY

SEQ ID NO: 12286 - protein, 306 aa, Pennisetum glaucum
IIRDGLKADPKKYRKMKDRLVGVSEETTTGVKRLYQMQETGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMHGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLSKSQADYISVPIEGPYKPAHYRY

SEQ ID NO: 12287 - protein, 378 aa, Pennisetum glaucum
MALSVEKTSSGREYKVKDLSQADFGRLEIELAEVEMPGLMSCRTEFGPSKPFAGARISGSLHMTIQTAVLIETLTAVRWCSCNIFSTQDHAAAAIARDSAAVFAWKGETLCTERCLDWGEGGGPDLIVDDGGDATLLIHEGVKAEEEYEKNGTVPDPESTDNAEFKIVLTIIRDGLKAHPNKYRKMKDRLVGVSEETTTGVKRLYQMQETGTLLFPAINVNDSVTKSKFDNLYGCRHLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMHGLETYPSASPSSPRPTAGCSLRQTLASLSSLRVV

SEQ ID NO: 12288 - protein, 266 aa, Pennisetum glaucum
ATLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMHGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLSKSQADYISVPIEGPYKPAHYRY

SEQ ID NO: 12289 - protein, 412 aa, Quercus alba
MTSQTAVLIKTLTALGAEVRNIFSTQDHAAAAVFAWKGETLQEYWWCTERALDWGPGGGPDLIVDDGGDATLLIHEGVKAEELFEKNGTIPDPASTDNAEFQIVLTIIRDGLKTDPKRYHKMKQRLVGVSEETTTGVKRLYQMQANGTLLFPAINVNDSVTKSKFDNLYGCRHSLPDGLMRATDVMIAGKVAVVAGYGDVGKGCAAALKQAGARVIVTEIDPICALQALMEGLQVLTLEDVVSEADIFVTTTGNKDIIMVDHMRKMKNNAIVCNIGHFDNEIDMLGLENYPGVKRITIKPQTDRWVFPDTNSGIIVLAEGRLMNLGCATGHPSFVMSCSFTNQVIAQLELWKERTTGKYEKKVYVLPKHLDEKVAALHLGKLGARLTKLSKDQADYISVPVEGPYKPAHYRY

SEQ ID NO: 12290 - protein, 209 aa, Avena sativa
CAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPETKTGIIVLAEGRLMNLGCATGHPSFVMSCSFTNQVIAQLELWNERKSGKYEKKVYVLPKHLDEKVAALHLGKLGAKLTKLTKSQSEYISIPVEGPYKPAAYRY

SEQ ID NO: 12291 - protein, 54 aa, Elaeis guineensis
TKSKFDNLYGCRHSLPDGLMRATDVMIAGKVAVVCGYGDVGKGCASALNRLEPG

SEQ ID NO: 12292 - protein, 242 aa, Secale cereale
  misc_feature (163)..(163): Xaa can be any naturally occurring amino acid
  misc_feature (166)..(166): Xaa can be any naturally occurring amino acid
  misc_feature (172)..(172): Xaa can be any naturally occurring amino acid
  misc_feature (180)..(180): Xaa can be any naturally occurring amino acid
  misc_feature (188)..(189): Xaa can be any naturally occurring amino acid
  misc_feature (194)..(194): Xaa can be any naturally occurring amino acid
  misc_feature (198)..(198): Xaa can be any naturally occurring amino acid
  misc_feature (201)..(204): Xaa can be any naturally occurring amino acid
  misc_feature (206)..(206): Xaa can be any naturally occurring amino acid
  misc_feature (209)..(209): Xaa can be any naturally occurring amino acid
  misc_feature (212)..(213): Xaa can be any naturally occurring amino acid
  misc_feature (223)..(223): Xaa can be any naturally occurring amino acid
  misc_feature (226)..(226): Xaa can be any naturally occurring amino acid
  misc_feature (231)..(233): Xaa can be any naturally occurring amino acid
  misc_feature (236)..(236): Xaa can be any naturally occurring amino acid
  misc_feature (239)..(239): Xaa can be any naturally occurring amino acid
MEGIQILTLEDVVSYADIFVTTTGNKDIIMVDHMRKMKNNAIVCNIGHFDNEIDMNGLETYPGVKRITIKPQTDRWVFPETKTGIIVLAEGRLMNLGCATGHPSFVMSCSFTNQVIAQLELWKEKASGKYEKKVYVLPKHLDEKVAALHLGKLGARLTKLTKXQSXYISIPXEGPYNLRXTGTSVSSXXSGWPXPEPXQWXXXXPXNYXVSXXLSYMLSLRRXIFXWLCFXXXEGXERXRLL

SEQ ID NO: 12293 - protein, 249 aa, Panicum virgatum
KFDNLYGCRHSLPDGLMRATDVMIAGKVAVVCGYGDVGKGCAAALKQAGARVIVTEIDPICALQALMEGLQVLALEDVISEADIFVTTTGNKDIIMVDHMRKMKNNAIVCNIGHFDNEIDMHGLETYPGVKRITIKPQTDRWVFPETNTGIIVLAEGRLMNLGCATGHPSFVMSCSFTNQVIAQLELWKERSSGKYEKKVYVLPKHLDEKVAALHLGKLGAKLTKLTKSQADYISVPIEGPYKPAHYRY

SEQ ID NO: 12294 - protein, 155 aa, Juglans hindsii x Juglans regia
  misc_feature (111)..(111): Xaa can be any naturally occurring amino acid
IMVSDMKKMKNNAIVCNIGHFDNEIDMLGLENYPGVKRITIKPQTDRWVFPETNSGIIVLAEGRLMNLGCATGHPSFVMSCSFTNQVIAQLELWKEKTSGKYEKKVYVLPXHLDEKVAALHLGKLGAKLTKLSKDQADYISVPIEGPYKPAHYRY

SEQ ID NO: 12295 - protein, 125 aa, Thellungiella halophila
ETFPGVKRITIKPQTDRWVFPDTKTGIIVLAEGRLMNLGCATGHPSFVMSCSFTNQVIAQLELWNEKSSGKYEKKVYVLPKHLDEKVAALHLGKLGARLTKLTKDQSDYVSIPIEGPYKPVHYRY

SEQ ID NO: 12296 - protein, 114 aa, Nicotiana benthamiana
  misc_feature (5)..(5): Xaa can be any naturally occurring amino acid
KLQTXRWVFPDTNSGIIVLAEGRLMNLGCATGHPSFVMSCSFTNQVIAQLELWKENSPGKYEKKVYVLPKHLDEKVAALHLGKLGARLTKLSKDQADYISVPVEGPYKPPHYRY

SEQ ID NO: 12297 - protein, 233 aa, Cirsium arvense
MRATDVMIAGKVAVVCGYGDVGKGCAAAMKQAGARVIVTEIDPICALQATMEGLQVLPLEDVVSEADIFVTTTGNKDIIMVSDMKKMKNNAIVCNIGHFDNEIDMLGLETYPGVKRITIKPQTDRWVFPETKTGIIILAEGRLMNLGCATGHPSFVMSCSFTNQVIAQLELWNEKSSGKYKKEVYVLPKHLDEKVAALHLEKLGAKLTKLTKDQADYISVPVEGPYKPAHYRY

SEQ ID NO: 12298 - protein, 160 aa, Linum usitatissimum
GNKDLIMVNHMRKMKNNAIVCNIGHFDNEIDMHGLETFPGVKRITIKPQTDRWVFPDTKTGIIVLAEGRLMNLGCATGHPSFVMSCSFTNQVIAQLELWKEKTSGKYEKKVYVLPKHLDEKVAALPLRKLGARLTKLSKDQADYISVPVEGPYKPAHSRY

SEQ ID NO: 12299 - protein, 242 aa, Fraxinus spp
MPPLTSRWANESTDVMIAGKVAVVCGYGDVGKGCAAALKQAGARVIVTEIDPICALQALMEGLQVLTLEDVVSEADIFVTTTGNKDIIMVDHMKKMKNNAIVCNIGHFDNEIDMQGLETYPGVKRITIKPQTDRWVFPETNSGIIVLAEGRLMNLGCATGHPSFVMSCSFTNQVIAQLELWKEKSTGKYKKEVYVLPKHLDEKVAALHLGKLGAKLTKLSKDQADYISVPIEGPYKPLHYRY

SEQ ID NO: 12300 - protein, 308 aa, Olea europaea
LTIIRDGLKSDPKKYTRMKERLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMKKMKNNAIVCNIGHFDNEIDMQGLETYPGVKRVTIKPQTDRWVFPETNSGIIVLAEGRLMNLGCATGHPSFVMSCSFTNQVIAQLELWKEKSTGKYKKEVYVLPKHLDEKVAALHLGKLGAKLTKLSKDQADYISVPIEGPYKPPHYRY

SEQ ID NO: 12301 - protein, 192 aa, Thalictrum flavum
DPICALQALMEGFQVLPLEDVVSDADIFVTTTGNKDIIMVDHMRKMKNNAIVCNIGHFDNEIDMHGLETFPGVKRITIKPQTDRWVFPDTKSGVIILAEGRLMNLGCATGHPSFVMSCSFTNQVIAQLELWNERNSGKYEKKVYVLPKHLDEKVAQLHLGKLGAKLTKLTPEQSEYISIPVEGPYKPAHYRY

SEQ ID NO: 12302 - protein, 323 aa, Citrullus lanatus
LPDPSSTDNAEFQIVLTIIRDGLKSDPKRYHKMKERLVGVSEETTTGVKRLYQMQSSGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMLGLENYPGVKRITIKPQTDRWVFPETNTGIIVLAEGRLMNLGCATGHPSFVMSCSFTNQVIAQLELWNEKASGKYEKKVYVLPKHLDEKVAALHLGKLGAKLTKLSKDQADYINVPVEGPYKPAHYRY

SEQ ID NO: 12303 - protein, 183 aa, Fagus grandifolia
MEGLQVLTLEDAVADADIFVTTTGNKDIIMVDHMRKMKNNAIICNIGHFDNEIDMLGLENYPGIKRITIKPQTDRWVFPDTNSGIIVLAEGRLMNLGCATGHPSFVMSCSFTNQVIAQLELWKERATGKYEKKVYVLPKHLDEKVAALHLPKLGARLTKLSKDQADYISVPVEGPYKPAHYRY

SEQ ID NO: 12304 - protein, 345 aa, Centaurea maculosa
GATPRSSSTRESRPRRSLRRPGRYPTRPPPITPSSRSCFRSSRKGFRLTLRSTTDEERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLQVLPLEDVVSEADIFVTTTGNKDIIMVSDMKKMKNNAIVCNIGHFDNEIDMLGLETYPGVKRITIKPQTDRWVFPETKTGIIVLAEGRLMNLGCATGHPSFVMSCSFTNQVIAQLELWNERTSGKYKKEVYVLPKHLDEKVAALHLGKLGAKLTKLTKDQADYISVPVEGPYKPAHYRY

SEQ ID NO: 12305 - protein, 185 aa, Cichorium intybus
GRAGRPPVLTLEDVLSEADIFVTTTGNKDIIMLHHMKKMKNNAIVCNIGHFDNEIDMLGLETYQGIKRITIKPQTDRWVFPETKSGIIVLAEGRLMNLGCATGHPSFVMSCSFTNQVIAQLELWNEKGTGKYKKEVYVLPKHLDEKVAALHLGKLGAKLTKLSKDQADYISVPIDGPYKPAHYRY

SEQ ID NO: 12306 - protein, 332 aa, Gossypium hirsutum
MRMPNKYTRMKERLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVNHMRKMKNNAIVCNIGHFDNEIDMLGLENYPGVKRITIKPQTDRWVFPETNTGIIVLAEGRLMNLGCATGHPSFVMSCSFTNQVIAQLELWKEKATGKYEKKVYVCLSTLMRRWLLFTLESLGLTSPSSPRIRLTTLASPLRVLTSLLTTGTEERIRERERERVGLEKGTIQRDGLIVCFTKIY

SEQ ID NO: 12307 - protein, 165 aa, Cyamopsis tetragonoloba
FVTTTGNKDIIMVDHMRKMKNNAIVCNIGHFDNEIDMQGLENYPGVKRITIKPQTDRWVFPETNSGIIVLAEGRLMNLGCATGHPSFVMSCSFTNQVIAQLELWKEKSTGKYEKKVYVLPKHLDEKVAALHLGKLGAKLTKLSKSQADYISVPVEGPYKPAHYRY

SEQ ID NO: 12308 - protein, 114 aa, Taraxacum officinale
RGREMVGVSEETTTGVKRLYQMQANGSLLFPAINVNDSVTKSKFDNLYGCRHSLPDGLMRATDVMIAGKVAVVCGYGDVGKGCASAMKQAGARVIVQKSIPSAHSKLSWKVSKS

SEQ ID NO: 12309 - protein, 163 aa, Ipomoea nil
TTTGNKDIIMVNHMRKMKNNAIVCNIGHFDNEIDMQGLESYPGVKRITIKPQTDRFVFPDTKTGIIILAEGRLMNLGCATGHPSFVMSCSFTNQVIAQLELCKEKSSGKYEKKVYILPKHLDEKVAALHLGKLGARLTKLTPEQSAYISIPVEGPYKPAHYRY

SEQ ID NO: 12310 - protein, 289 aa, Parthenium argentatum
ERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLQVLTLDDVVSEADIFVTTTGNKDIIMVSDMKKMKNNAIVCNIGHFDNEIDMLGLETYPGVQRITIKPQTDRWVFPETKSGIIVLAEGRLMNLGCATGHPSFVMSCSFTNQVIAQLELWNEKNTGKYKKEVYVLPKHLDEKVAALHLGKLGAKLTKLTKDQADYISVPVEGPSKPAHYRY

SEQ ID NO: 12311 - protein, 127 aa, Ambrosia trifida
MKQAGARVIVTEIDPICALQALMEGLQVLTLEDVLSEADIFVTTTGNKDIIMVDHMKKMKNNAIICNIGHFDNEIDMLGLETYPGVKRITIKPQTDRWVFPETKSGVIVLAEGRLMNLGCATGHQVL

SEQ ID NO: 12312 - protein, 154 aa, Cirsium arvense
MVSDMKKMKNNAIVCNIGHFDNEIDMLGLETYPGVKRITIKPQTDRWVFPETKTGIIVLAEGRLMNLGCATGHPSFVMSCSFTNQVIAQLELWNERTTGKYKKEVYVLPKHLDEKVAALHLGKLGAKLTKLTKDQADYISVPVEGPYKPAHYRY

SEQ ID NO: 12313 - protein, 354 aa, Flaveria ramosissima
GPDLIVDDGGDATLLIHEGVKAEEEFEKTGKLPDPSSTDNAEFQIVLSIIKEGLQSDPKKYHKMKERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLQVLTLDDVVSEADIFVTTTGNKDIIMVSDMKKMKNNAIVCNIGHFDNEIDMLGLETYPGVKRITIKPQTDRWVFPETNTGIIVLAEGRLMNLGCATGHPSFVMSCSFTNQVIAQLELWKEKNSGKYKKEVYVLPKHLDEKVAALHLGKLGAKLTKLTKDQADYISVPVEGPYKPAHYRY

SEQ ID NO: 12314 - protein, 233 aa, Flaveria ramosissima
MRATDVMIAGKVAVVCGYGDVGKGCAAAMKQAGARVIVTEIDPICALQATMEGLQVLTLDDVVSEADIFVTTTGNKDIIMVSDMKKMKNNAIVCNIGHFDNEIDMLGLETYPGVKRITIKPQTDRWVFPETNTGIIVLAEGRLMNLGCATGHPSFVMSCSFTNQVIAQLELWKEKNSGKYKKEVYVLPKHLDEKVAALHLGKLGAKLTKLTKDQADYISVPVEGPYKPAHYRY

SEQ ID NO: 12315 - protein, 273 aa, Flaveria ramosissima
MTIQTGVLIETLTALGAEVRWCSCNIFSTQDHAAAAIARDSAAVFAWKGETLQEYWWCTERALDWGPGGGPDLIVDDGGDATLLIHEGVKAEEEFEKTGKLPDPSSTDNAEFQIVLSIIKEGLQSDPKKYHKMKERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLQVLTLDDVVQRPISSLPPLATRTSSWFPT

SEQ ID NO: 12316 - protein, 90 aa, Flaveria ramosissima
MNLGCATGHPSFVMSCSFTNQVIAQLELWKEKNSGKYKKEVYVLPKHLDEKVAALHLGKLGAKLTKLTKDQADYISVPVEGPYKPAHYRY

SEQ ID NO: 12317 - protein, 159 aa, Phalaenopsis aphrodite
MVDHMRKMKNNAIVCNIGHFDNEIDMLGLESFPGVKRITIKPQTDRWVFPDTNSGILVLAEGRLMNLGCATGHPSFVMSCSFTNQVIAQLELWKERASGKYEKKVYVLPKHLDEKVAALHLGKLGAKLTKLTPSQADYISVPVEGPYKPAPLQVLENFN

SEQ ID NO: 12318 - protein, 272 aa, Sarracenia psittacina
YQMQANGTLLFPAINVNDSVTKSKFDNLYGCRHSLPDGLMRATDVMIAGKVAVVCGYGDVGKGCAAAMKQAGARVIVTEIDPICALQALMEGLQVLPLEDVVSEADIFVTTTGNKDIIMVDHMKKMKNNAIVCNIGHFDNEIDMIGLETYPGVKRITIKPQTDRWVFPETNSGIIVLAEGRLMNLGCATGHPSFVMSCSFTNQVIAQLELWKEKKTGKYEKKVYVLPKHLDEKVASLHLGKLGAKLTKLTKEQADYISVPVEGPYKPAHYRY

SEQ ID NO: 12319 - protein, 319 aa, Malus domestica
SSTDNQEFQLVLTIIRDGLKTDPKRYHKMKDRLVGVSEETTTGVKRLYQMQASGALLFPAINVNDSVTKSKFDNLYGCRHSLPDGLMRATDVMIAGKVSVVCGYGDVGKGCAAALKQAGSRVIVTEIDPICALQALMEGLQVLPLEDVVSEADIFVTTTGNKDIIMVDHMRKMKNNAIVCNIGHFDNEIDMHGLETYPGVKRITIKPQTDRWVFPETNTGIIVLAEGRLMNLGCATGHPSFVMSCSFTNQVIAQLELWNERKSGKYEKKVYVLPKHLDEKVAALHLGKLGAKLTKLSKEQADYISVPVEGPYKPAHYRY

SEQ ID NO: 12320 - protein, 182 aa, Ocimum basilicum
MEGFQVLTLEDVLSEADIFVTTTGNKDIIMVDHMKKMKNNAIVNIGHFDNEIDMLGLETYPGVKRITIKPQTDRWVFPETNSGIIVLAEGRLMNLGCATGHPSFVMSCSFTNQVIAQLELWKERKSGKYKKEVYVLPKHLDEKVAALHLGKLGAKLTKLTKDQADYISVPVEGPYKPLHYRY

SEQ ID NO: 12321 - protein, 264 aa, Trifolium pratense
LLFPAINVNDSVTKSKFDNLYGCRHSLPDGLMRATDVMIAGKVAVVCGYGDVGKGCAAALKQGGARVVVTEIDPICALQALMEGLQVLTLADVVSEADIFVTTTGNKDIIMVSDMKKMKNNAIVCNIGHFDNEIDMHGLETYPGVKRITIKPQTDRWVFPETNSGIIVLAEGRLMNLGCATGHPSFVMSCSFTNQVIAQIELWKEKTSGKYEKKVYVLPKHLDEKVAALHLGQLGAKLTKLSKDQADYISVPVEGPYKPAHYRY

SEQ ID NO: 12322 - protein, 85 aa, Curcuma longa
RLVPNSARGETTTGVKRLYQMQASGALLFPAINVNDSVTKSKFDNLYGCRHSLPDGLMRATDVMIAGKVLWSVATEMSARVAPLL

SEQ ID NO: 12323 - protein, 274 aa, Gerbera hybrid cultivar
ELYQMQANGTLLFPAINVNDSVTKSKFDNLYGCRHSLPDGLMRATDVMIAGKVAVVCGYGDVGKGCAAAMKQAGARVIVTEIDPICALQATMEGLQVLTLEDVVSEADIFVTTTGNKDIIMVDHMRKMKNNAIVCNIGHFDNEIDMLGLETYPGVKRITIKPQTDRWVFPETKTGIIILAEGRLMNLGCATGHPSFVMSCSFTNQVIAQLELWKEKSSGKYKKEVYVLPKHLDEKVAALHLGKLGAKLTKLSKDQADYISVPVEGPYKPAHYRY

SEQ ID NO: 12324 - protein, 203 aa, Zingiber officinale
  misc_feature (113)..(113): Xaa can be any naturally occurring amino acid
QAGAGVIVTEIDPICALQALMEGIPVLTLEDVVSEADIFVTTTGNKDIIMVDHMKKMKNNAIVCNIGHFDNEIDMHGLETYPGVKRITIKPQTDRWVFPETNSGIIVLAEGRXMNLGCATGHPSFVMSCSFTNQVIAQLELWKERSSGKYEKKVYVLPKHLDEKVAALHLGKLGAKLTKLTPAQAAYISIPVEGPYKPAHYRY

SEQ ID NO: 12325 - protein, 140 aa, Heritiera littoralis
CNIGHFDNEIDIQGLENYPRVKRITIKPQTDRWVFPETNIGIIVLAEGRLMNLGCATGHPSFVMSCSFTNQVIAQLELWKEKATGKYEKKVYVLPKHLDEKVAALHLGKLGARLTKLSKAQADYISVPVEGPYKPPHYRY

SEQ ID NO: 12326 - protein, 194 aa, Glycyrrhiza uralensis
LLDPICALQALMEGFQVLTLEDVVSEADIFVTTTGNKDIIMVDHMRKMKNNAIVCNIGHFDNEIDILGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLSQSQADYISVPVEGPYKPAHYRY

SEQ ID NO: 12327 - protein, 414 aa, Carica papaya
ETLTALGAEVRWCSCNIFSTQDHAAAAIARDSAAVFAWKGETLQEYWWCTERALDWGPSGGPDLIVDDGGDATLLIHEGVKAEEIFEKTGQLPDPNSTDNAEFQIVLTIIKDSLKTDPKRYHKMKERLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVSHMKKMKNNAIVCNIGHFDNEIDMHGLETYPGVKRITIKPQTDRWVFPETNTGIIVLAEGRLMNLGCATGHPSFVMSCSFTNQVIAQLELWKEKATGKYEKKVYVLPKHLDEKVAALHLGKLGAKLTKLSKDQADYISVPVEGPYKPAHYRY

SEQ ID NO: 12328 - protein, 274 aa, Arachis hypogaea
RLYQMQANGTLLFPAINVNDSVTKSKFDNLYGCRHSLPDGLMRATDVMIAGKVAVVAGYGDVGKGCVAALKQAGARVIVTEIDPICALQALMEGLQVLTLEDVVSEADIFVTTTGNKDIIMVDHMRKMKNNAIVCNIGHFDNEIDMHGLETYPGVKRITIKPQTDRWVFPETNTGIIVLAEGRLMNLGCATGHPSFVMSCSFTNQVIAQLELWTEKSSGKYEKKVYVLPKHLDEKVAALHLGKLGAKLTKLSQSQADYISVPVEGPYKPPHYRY

SEQ ID NO: 12329 - protein, 229 aa, Cajanus cajan
RRDDCRKGCRVCGYGDVGKGCAAAMKQAGARVIVTEIDPICALQALMEGLQVLTLEETLSVADIFVTTTGNKDIIMLNHMKQMKNNAIVCNIGHFDNEIDMLGLETHPGVKRITIKPQTDRWVFPETKTGIIVLAEGRLMNLGCATGHPSFVMSCSFTNQVIAQLELWKEKGSGKYENKVYVLPKHLDEKVASLHLGKLGANLTKLTKEQADYISVPVEGPYKPAHYRY

SEQ ID NO: 12330 - protein, 90 aa, Podocarpus macrophillus
MNLGCATGHPSFVMSCSFTNQVIAQLELWKEKSTGKYEKKVYVLPKHLDEKVAALHLGKLGAKLTKLTADQADYISVPVDGPYKPAQYRY

SEQ ID NO: 12331 - protein, 339 aa, Senecio madagascariensis
TEFRSLDWGPDGGPDLIVDDGGDATLLIHEGVKAEEEFEKTGKLPDPTSTDNAEFQIVLSIIKEGLSIDPKKYHKMKTRLVGVSEETTTGVKRLYQMQANGTLLFPAINVNDSVTKSKFDNLYGCRHSLPDGLMRATDVMIAGKVAVVCGYGDVGKGCASAMKQAGARVIVTEIDPICALQATMEGLQVLTLEDVVRPRSDIFVTTTGNKDIIMVSDMKKMKNNAIVCNIGHFDNEIDMLGLETYPGVKRITIKPQTDRWVFPETKSGVIILAEGRLMNLGCATGHPSFVMSCSFTNQVIAQLELWNEKGTGKYKKEVYVLPKHLDEKVALLHLGKTWS

SEQ ID NO: 12332 - protein, 248 aa, Tamarix hispida
  misc_feature (17)..(17): Xaa can be any naturally occurring amino acid
GDNLYGCRHSLPDGLMXATDVMIAGKVGVVCGYGDVGKGCAFALKAAGARVIVTEIDPICALQALMEGFQVLTLEDVVAEADIFVTTTGNKDIIMVDDMRKMKNNAIVCNIGHFDNEIDMLGLESYPGVKRITIKPQTDRFVFPDTKRGVIILAEGRLMNLGCATGHPSFVMSCSFTNQCIAQLELWKEKNSGKYEKKVYVLPKHLDEKVAALHLGKLGAKLTKLSKDQADYISVPIEGPYKPAHYRY

SEQ ID NO: 12333 - protein, 291 aa, Tragopogon dubius
MNERLVGVSEETTTGVKRLYQMQANGTLLFPAINVNDSVTKSKFDNLYGCRHSLPDGLMRATDVMIAGKVAVVCGYGDVGKGCAAAMKQAGARVIITEIDPICALQALMEGLQVLTLEDTLSEADIIITTTGNKDIIMVDHMKKMKNNAIVCNIGHFDNEIDMLGLETYPGVKRITIKPQTDRWVFPETKSGIIVLAEGRLMNLGCATGHPSFVMSCSFTNQVIAQLELWKEKGSGKYKKEVYVLPKHLDEKVAALHLGKLGAKLTKLSKDQADYISVPVEGPYKPANYRY

SEQ ID NO: 12334 - protein, 73 aa, Triticum aestivum
MNLGCATGHPNFVKSCSFTNQVIAQLELWNEKASGKYEKKVYVLPKHLDEKVAALQLGKLGARLTKLTKSQSE

SEQ ID NO: 12335 - protein, 423 aa, Flaveria ramosissima
MTIQTGVLIETLTALGAEVRWCSCNIFSTQDHAAAAIARDSAAVFAWKGETLQEYWWCTERALDWGPGGGPDLIVDDGGDATLLIHEGVKAEEEFEKSGKLPDPNSTDNAEFQIVLSIIKEGLQSDPKKCHRMKDRLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQALMEGLQVLTLEDVLSEADIFVTTTGNKDIIMVDHMKKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYKKEVYVLPKHLDEKVAALHLGKLGAKLTKLSQDQADYISVPVEGPYKPAHYRY

SEQ ID NO: 12336 - protein, 358 aa, Flaveria ramosissima
GPGGGPDLIVDDGGDATLLIHEGVKAEEEFEKSGKLPDPNSTDNAEFQIVLSIIKEGLQSDPKKYHRMKDRLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQALMEGLQVLTLEDVLSEADIFVTTTGNKDIIMVDHMKKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYKKEVYVLPKHLDEKVAALHLGKLGAKLTKLSQDQADYISVPVEGPYKPAHYRY

SEQ ID NO: 12337 - protein, 360 aa, Flaveria ramosissima
DWGPGGGPDLIVDDGGDATLLIHEGVKAEEEFAKTGKLPDPASTDNAEFQIVLSIIKEGLQSDPKKYHKMKERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLQVLTLDDVVSEADIFVTTTGNKDIIMVSDMKKMKNNAIVCNIGHFDNEIDMLGLETYPGVKRITIKPQTDRWVFPETNTGIIVLAEGRLMNLGCATGHPSFVMSCSFTNQVIAQLELWKEKNTGKYKKEVYVLPKHLDEKVAALHLGKLGAKLTKLTKDQADYISVPVEGPYKPAHYRY

SEQ ID NO: 12338 - protein, 308 aa, Flaveria ramosissima
LSIIKEGLQSDPKKYHRMKDRLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQALMEGLQVLTLEDVLSEADIFVTTTGNKDIIMVDHMKKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYKKEVYVLPKHLDEKVAALHLGKLGAKLTKLSQDQADYISVPVEGPYKPAHYRY

SEQ ID NO: 12339 - protein, 183 aa, Fraxinus spp
MEGLQILTLEDVVSEADIFVTTTGNKDIIMVDHMKKMKNNAIVCNIGHFDNEIDMQGLETYPGVKRITIKPQTDRWVFPETKTGIIVLAEGRLMNLGCATGHPSFVMSCSFTNQVIAQLELWKEKSTGKYKKEVYVLPKHLDEKVAALHLGKLGAKLTKLSKDQADYISVAIEGPYKPPNYRY

SEQ ID NO: 12340 - protein, 206 aa, Phalaenopsis aphrodite
GGGPDLIVDDGGDATLLIHEGVKAEEEYEKNGKIPDPASTDNAEFQIVLGLIRDSLSVDPKKYRRMKERLVGVSEETTTGVKRLYQMQYSGTLLFPAINVNDSVTKSKFDNLYGCRHSLPDGLMRATDVMIAGKVAVVCGYGDVGKGCAAALKTAGARVIVTEIDPICALQALMEGLPVLRLEDVVSEADIFVTTTGNKDIIMVDT

SEQ ID NO: 12341 - protein, 274 aa, Scabiosa columbaria
RLYQMQANGTLLFPAINVNDSVTKSKFDNLYGCRHSLPDGLMRATDVMIAGKVAVVCGYGDVGKGCASAMKQAGARVIVTEIDPICALQALMEGIPVLTLEDVVSEADIFVTTTGNKDIIMVDHMRKMKNNAIVCNIGHFDNEIDMLGLETYPGVKRITIKPQTDRWIFPETGTGILVLAEGRLMNLGCATGHPSFVMSCSFTNQVIAQLELWNERASGKYEKKVYVLPKHLDEKVAALHLGKLGAKLTKLSPEQSAYISIPIEGPYKPPHYRY

SEQ ID NO: 12342 - protein, 143 aa, Artemisia annua
AIVCNIGHFDNEIDMLGLENYPGVKRITIKPQTDRWVFPETKTGIIILAEGRLMNLGCATGHPSFVMSCSFTNQVIAQLELWNERNSGKYKKEVYVLPKHLDEKVAALHLGKLGAKLTKLSKDQADYISVPVEGPYKPLHYRY

SEQ ID NO: 12343 - protein, 255 aa, Persea americana
DSVTKSKFDNLYGCRHSLPDGLMRATDIMIAGKVAVVCGYGDVGKGCASALKQAGARVIVTEIDPICALQALMEGIPVLTLEDVVAEADIFVTTTGNKDIIMVDHMRKMKNNAIVCNIGHFDNEIDMHGLETFPGVKRITIKPQTDRWVFPGTNSGIIVLAEGRLMNLGCATGHPSFVMSCSFTNQVIAQLELWNERATGKYEKKVYVLPKHLDEKVAALHLGKLGANLTKLTPAQAEYISVPVEGPYKPAHYRY

SEQ ID NO: 12344 - protein, 216 aa, Guizotia abyssinica
YGGVQEGCAAAMKHAGARVIVTEIDPICALHATMEGLQVLTLEDVVSEADIFVTTTGNKDIIMVSDMKKMKNNAIVCNIGHFDNEIDMLGLETYPGVQRITIKPQTDRWVFPETKTGIIVLAEGRLMNLGCATGHPSFVMSCSFTNQVIAQLELWKEKDTGKYKKEVYVLPKHLDEKVAALHLGKLGAKLTKLSKDQADYISVPVEGPYKPAHYRY

SEQ ID NO: 12345 - protein, 230 aa, Liriodendron tulipifera
  misc_feature (162)..(162): Xaa can be any naturally occurring amino acid
  misc_feature (169)..(170): Xaa can be any naturally occurring amino acid
TDIMIAGKVAVVCGYGDVGKGCAAALKQAGARVIVTEIDPICALQALMEGIPVLTLEDVVSETDIFVTTTGNKDIIMVDHMKKMKNNAIVCNIGHFDNEIDMLGLESYPGVKRITIKPQTDRWVFPETNSGIIVLAEGRLMNLGCATGHPSFVMSCSFTNQXIAQLELXXERSSGKYEKKVYVLPKHLDEKVAALHLGKLGAKLTKLSQDQADYISVPVEGPYKPPHYRY

SEQ ID NO: 12346 - protein, 154 aa, Medicago truncatula
MVDDMRKMKNNAIVCNIGHFDNEIDMSGLENYPGVKRVTIKPQTDRWVFPETNTGIIVLAEGRLMNLGCATGHPSFVMSCSFTNQVIAQLELWNERKSGKYEKKVYVLPKHLDEKVAALHLGKLGAKLTKLSQSQADYISVPVEGPYKPAHYRY

SEQ ID NO: 12347 - protein, 244 aa, Nuphar advena
MGADTHWPDGLMRATDVMIAGKVAVVCGYGDVGKGCAAALKQAGARVIVTEIDPICALQALMEGLQVLTLEDVVAEADIFVTTTGNKDIIMVKHMKQMKNNAIVCNIGHFDNEIDMLGLETYPGIKRITIKPQTDRWVFPETNRGIIVLAEGRLMNLGCATGHPSFVMSCSFTNQVIAQLELWKEKGTGKYEKKVYVLPKHLDEKVAALHLGKLGAHLTKLTPEQADYINIPVEGPYKPPHYRY

SEQ ID NO: 12348 - protein, 306 aa, Ananas comosus
LIRDGLKVDPSKYRKMKERLVGVSEETTTGVKRLYQMQASGTLLFPAINVNDSVTKSKFDNLYGCRHSLPDGLMRATDVMIAGKAAVVCGYGDVGKGCAAALKQAGARVIVTEIDPICALQALMEGIPVLTLEDVVSTADIFVTTTGNKDIIMVDHMKQMKNNAIVCNIGHFDNEIDMHGLETYPGVKRITIKPQTDRWVFPETNSGIIVLAEGRLMNLGCATGHPSFVMSCSFTNQVIAQLELWKERKSGKYEKKVYVLPKHLDEKVAALHLGKLGAKLTKLSPSQAEYISVPIEGPYKPPHYRY

SEQ ID NO: 12349 - protein, 239 aa, Salvia sclarea
TRPRAEFGTRDVMIAGKVGVVCGYGDVGKGCAAALKQAGARVIVTEIDPICALQALMEGFQVLTLEDAVSDGDIFVTTTGNKDIIMLDHMRKMKNNAIVCNIGHFDNEIDVQGLETFPGVKRVTIKPQTDRWIFPDTKNGIILLAEGRLMNLGCATGHPSFVMSCSFTNQVIAQLELWNERKSGKYEKKVYVLPKHLDEKVAALHLAKLGAKLTKLSKEQADYISVPVEGPYKPLHYRY

SEQ ID NO: 12350 - protein, 280 aa, Saccharum officinarum
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEGGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGQGAVVCGYGDVGKGCAPL

SEQ ID NO: 12351 - protein, 113 aa, Flaveria ramosissima
PQTDRWVFPETNTGIIVLAEGRLMNLGCATGHPSFVMSCSFTNQVIAQLELWKEKNSGKYKKEVYVLPKHLDEKVAALHLGKLGAKLTKLTKDQADYISVPVEGPYKPAHYRY

SEQ ID NO: 12352 - protein, 143 aa, Fagopyrum esculentum
AIVCNIGHFDNEIDMLGLESYPGVQRITIKPQTDRFVFPDTKKGVIVLAEGRLMNLGCATGHPSFVMSCSFTNQVIAQLELWKEKATGKYKKEVYVLPKHLDEKVAALHLGKLGARLTKLSKDQADYISVAVEGPYKPPHYRY

SEQ ID NO: 12353 - protein, 291 aa, Fagopyrum esculentum
MKDRLVGVSEETTTGVKRLYQMQANGTLLFPAINVNDSVTKSKFDNLYGCRHSLPDGLMRATDVMIAGKVGVVCGFGDVGKGCAAALKAAGARVIVTEIDPICALQALMEGYQVLTLEDVVADADIFVTTTGNKDIIMLDHMRKMKNNAIVCNIGHFDNEIDMLGLENYPGVQRITIKPQTDRFVFPDTKRGVIVLAEGRLMNLGCATGHPSFVMSCSFTNQVIAQLELWKEKATGKYKKEVYVLPKHLDEKVAALHLGKLGARLTKLSKDQADYISVAVEGPYKPPHYRY

SEQ ID NO: 12354 - protein, 358 aa, Amaranthus tuberculatus
GPGGGPDLIVDDGGDATLLIHEGVKAEEEYEKTGKVPDPTSTDNVEFQLVLGLIRDSLKVDPKRYHKMKERLVGVSEETTTGVKRLYQMQANGTLLFPAINVNDSVTKSKFDNLYGCRHSLPDGLMRATDVMIAGKVGVVCGYGDVGKGCALALKAAGARVIVTEIDPICALQALMEGFQVLTLEDVVSEADIFVTTTGNKDIIMVDHMKKMKNNAIVCNIGHFDNEIDMAGLENYPGVKRITIKPQTDRFVFPETNTGIIVLAEGRLMNLGCATGHPSFVMSCSFTNQVIAQLELWNEKASGKYKKEVYVLPKHLDEKVTALHLGKLGAKLTKLSKDQADYISVPVEGPYKPAHYRY

SEQ ID NO: 12355 - protein, 136 aa, Cryptomeria japonica
HFDNEIDMHGLETYPGVKKVTIKPQTDRWVFPETNSGIIVLAEGRLMNLGCATGHPSFVMSCSFTNQVIAQLELWNERKTGKYEKKVYVLPKHLDEKVAALHLPKLGAKLTKLSPDQAAYINVPIEGPYKPVHYRY

SEQ ID NO: 12356 - protein, 129 aa, Cynara scolymus
MLGLETYPGVKRITIKPQTDRWVFPETNTGIIILAEGRLMNLGCATGHPSFVMSCSFTNQVIAQLELWKEKSSGKYGKEVYVLPKHLDEKVAALHLEKLGAKLTKLSKDQADYISVPVEGPYKPAHYRY

SEQ ID NO: 12357 - protein, 409 aa, Cajanus cajan
GGAEVRWCSCNIFSTQDHAAAAIARDSAAVFAWKGETPPGVLVVHRARPRLGAPAAAPTSSWTTAATPRSSSTRAQGQELYEKTGQLPDPASTDNAEFQIVLTIIRDGLKTDPSRYRKMKNRLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQALMEGLQVLTLEDVVSEADIFVTTTGNKDIIMVDHMRKMKNNAIVCNIGHFDNEIDMLGLENYPGVKRITIKPQTDRWVFPETNTGIIILAEGRLMNLGCATGHPSFVMSCSFTNQVIAQLELWKEKDSGKYEKKVYVLPKHLDEKVAALHLGKLGAKLTKLSQSQADYISVPVEGPYKPAHYRY

SEQ ID NO: 12358 - protein, 293 aa, Pisum sativum
RKMKERLVGVSEETTTGVKRLYQMQASGTLLFPAINVNDSVTKSKFDNLYGCRHSLPDGLMRATDVMIAGKVGVVCGYGDVGKGCAVALKQAGARVIVTEIDPICALQALMEGFQVLTLDDVVSYADIFVTTTGNKDIIMVGDMKKMKNNAIVCNIGHFDNEIDMSGVENYPGVKRITIKPQTDRWVFPETNTGIIILAEGRLMNLGCATGHPSFVMSCSFTNQVIAQLELWNERKSGKYEKKVYVLPKHLDEKVAALHLGKLGAKLTKLTQSQADYISVPVEGPYKPAAYRY

SEQ ID NO: 12359 - protein, 89 aa, Phalaenopsis aphrodite
MCHGSPQLCHVVLFYEPGNCSAGAVEGEGVGKYEKKVYVLPKHLDEKVAALHLGKLGPSSPSLLLRRLITSAFRSRVPTNQPITGIREF

SEQ ID NO: 12360 - protein, 244 aa, Musa acuminata
ARVIITEIDPICALQALMEGLPVLTLEDVVSEADIFVTTTGNKDIIMVDHMKKMKNNAIVCNIGHFDNEIDMQGLETYPGIKRITIKPQTDRWVFPETSTGIIVLAEGRLMNLGCATGHPSFVMSCSFTNQVIAQLELWKERKTGKYEKKVYVLPKHLDEKVAALHLGKLGAKLTKLTPSQASTLASQSRAPTSLFTTGIRMALIQEIMTKQWQYQWSCLFCLVIFLLPRIAGFPEYVFDPNVV

SEQ ID NO: 12361 - protein, 216 aa, Ipomoea batatas
AYGRGEGCAAALKQAGARVIVTEIDPICALQALMEGLQVLTLEDVVSDADILVTTTGNKDIIMVSHMKKMKNNAIVCNIGHFDNEIDMQGLETYPGVKRITIKPQTDRFVFPETNTGIIVLAEGRLMNLGCATGHPSFVMSCSFTNQIIAQLELWKEKSTGKYEKKVYVLPKHLDEKVAALHLGKLGARLTKLSPEQAAYISVPVEGPYKPPHYRY

SEQ ID NO: 12362 - protein, 77 aa, Arachis hypogaea
MSCSFTNQVIAQLELWKEKGTGKYEKKVYVLPKHLDEKVASLHLGKLGAKLTRLSKDQADYISVPVGGPYKPAHYRY

SEQ ID NO: 12363 - protein, 61 aa, Brassica napus
MNLGCATGHPSFVMSCPFTNQVIAQLELWNEKSSGKYEKKVYVLPKHLDEKVAALHWESWS

SEQ ID NO: 12364 - protein, 355 aa, Phalaenopsis aphrodite
MGAGGGPDLIVDDGGDATLLIHEGVKAEEEYEKNGKIPDPASTDNAEFQIVLGLIRDSLSVDPKKYRRMKERLVGVSEETTTGVKRLYQMQYSGTLLFPAINVNDSVTKSKFDNLYGCRHSLPDGLMRATDVMIAGKVAVVCGYGDVGKGCAAALKTAGARVIVTEIDPICALQALMEGLPVLRLEDVVSEADIFVTTTGNKDIIMVDHMRKMKNNAIVCNIGHFDNEIDMLGLESFPGVKRITIKPQTDRWVFPDTNSGILVLAEGRLMNLGCATGHPSFVMSCSFTNQVIAQLELWKERASGKYEKKVYVLPKHLDEKVAALHLGKLGAKLTKLTPSQADYISVPVEGPYKPA

SEQ ID NO: 12365 - protein, 145 aa, Primula obconica
NNAIVCNIGHFDNEIDMLGLETYPGVKRVTIKPQTDRWVFPETNTGIIILAEGRLMNLGCATGHPSFVMSCSFTNQVIAQLELWKEKDTGKYKKEVYVLPKHLDEKVAALHLEKLGAKLTKLSKDQADYISVPVEGPYKPAHYRY

SEQ ID NO: 12366 - protein, 299 aa, Pisum sativum
ERPPGPVRKMKERLVGVSEETTTGVKRLYQMQASGTLLFPAINVNDSVTKSKFDNLYGCRHSLPDGLMRATDVMIAGKVGVVCGYGDVGKGCAVALKQAGARVIVTEIDPICALQALMEGFQVLTLDDVVSYADIFVTTTGNKDIIMVGDMKKMKNNAIVCNIGHFDNEIDMSGVENYPGVKRITIKPQTDRWVFPETNTGIIILAEGRLMNLGCATGHPSFVMSCSFTNQVIAQLELWNERKSGKYEKKVYVLPKHLDAKVAALHLGKLGAKLTKLTQSQADYISVPVEGPYKPAAYR

SEQ ID NO: 12367 - protein, 125 aa, Solanum tuberosum
ETFPGVKRITIKPQTDRWVFPDTNSGIIVLAEGRLMNLGCATGHPSFVMSCSFTNQVIAQLELWNERSSGKYEKKVYVLPKHLDEKVAALHLGKLGAKLTKLTKDQADYISVPVEGPYKPAHYRY

SEQ ID NO: 12368 - protein, 296 aa, Flaveria ramosissima
SDPKKYHKMKERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLQVLTLDDVVSEADIFVTTTGNKDIIMVSDMKKMKNNAIVCNIGHFDNEIDMLGLETYPGVKRITIKPQTDRWVFPETNTGIIVLAEGRLMNLGCATGHPSFVMSCSFTNQVIAQIELWKEKNTGKYKKEVYVLPKHLDEKVAALHLGKLGAKLTKLTKDQADYISVPVEGPYKPAH

SEQ ID NO: 12369 - protein, 286 aa, Zingiber officinale
VGVSEETTTGVKRLYQMQDSGSLLFPAINVNDSVTKSKFDNLYGCRHSLPDGLMRATDVMIAGKVGVVCGYGDVGKGCAAALKQAGARVIVTEIDPICALQALMEGIPVLPLEDVVAEADIFVTTTGNKDIIMVDHMKKMKNNAIVCNIGHFDNEIDMHGLETYPGVKRITIKPQTDRWVFPETNSGIIVLAEGRLMNLGCATGHPSFVMSCSFTNQVIAQLELWKERKSGKYDRKVYVLPKHLDEKVAALHLGKLGAKLTKLTPEQAEYIHVAVEGPYKPAHYRY

SEQ ID NO: 12370 - protein, 270 aa, Zea mays
MSRSITLSLTAINVNDSVTKSKFDNLYGCRHSLPDGLMRATDVMIAGKVAVVCGYGDVGKGCAAALKQAGARIIITEIDPICALLALMEGLQVLTLEDVVSEADIFVTTTGNKDIIMVDHMRKMKNNAIVCNIGHFDNEIDMLGLETYPGVKRITIKPQIDRWVFPETNTGIIILAEGRLMNLGCATGHPSFVMSCSFTNQVLAQLELWKEKNSGKYEKKVYVLPKHLDEKVNALHLGKHGAKLTKLTKSQADYIRVPIEGPYKLAHYRY

SEQ ID NO: 12371 - protein, 153 aa, Parthenium argentatum
VDHMKKMKNNAIVCNIGHFDNEIDMLGLETYPGVKRITIKPQTDRWVFPETNSGIIVLAEGRLMNLGCATGHPSFVMSCSFINQVIAQLELWKEKSSGKYKKEVYVLPKHLDEKVAALHLGKLGAKLIKFSQEQADYISVPVEGPYKPAQYRY

SEQ ID NO: 12372 - protein, 124 aa, Cucumis melo
TFPDVKRITIKPQTDRWVFPDTNSGIIVLAEGRLMNLGCATGHPSFVMSCSFTNQVIAQLELWNERKTGKYEKKVYVLPKHLDEKVAALHLGKLGAKLTKLSKDQADYISVPIEGPYKPAHYRY

SEQ ID NO: 12373 - protein, 130 aa, Ipomoea nil
MHGLETYPGVKRTTIKPQTDRFVFPDTKNGIIVLGEGRLMNLGCGSRHPSFVMSCSFTNQVIAQLELWKEKSSGKYDEKKVYVLPKHLDEKVAALHIGKLGAKLTKLSPDQAAYISVPVEGPYKPPNYRY

SEQ ID NO: 12374 - protein, 419 aa, Primula obconica
TAVLIETLTALGAEVRWCSCNIFSTQDHAAAAIARDSAAVFAWKGETLAEYWWCTERALDWGEGGGPDLIVDDGGDATLLIHEGVKAEEEFEKNGTVPDPTSTDNAEFQIVLSIIKEGLKTDPKRYHKMKTRLVGVSEETTTGVKRLYQMQLNGTLLFPAINVNDSVTKSKFDNLYGCRHSLPDGLMRATDVMIAGKVAVVCGYGDVGKGCAAALKQAGARVIVTEIDPICALQATMEGLQVLTLEDVVSQADIFVTTTGNKDIIMVSDMRKMKNNAIVCNIGHFDNEIDMLGLETYPGVKRITIKPQTDRWLFPETNTGIIILAEGRLMNLGCATGHPSFVMSCSFTNQVIAQLELWKEKDTGKYKKEVYVLPKHLDEKVAALHLEKLGAKLTKLSKDQADYISVPVEGPYKPAAYRY

SEQ ID NO: 12375 - protein, 125 aa, Zingiber officinale
  misc_feature (18)..(19): Xaa can be any naturally occurring amino acid
  misc_feature (73)..(73): Xaa can be any naturally occurring amino acid
  misc_feature (124)..(124): Xaa can be any naturally occurring amino acid
GDLPGRQRITIKPQTDRXXFPDTNTGIIVLAEGRLMNLGCATGHPSFVMSCSFTNQVIAQLELWKEKMTGKYXKKVYVLPKHLDEKVAALHLGKLGAKLTKLTPSQAEYISVPVGGPYKPAHYXY

SEQ ID NO: 12376 - protein, 109 aa, Nicotiana tabacum
RWVFPETGTGIIVLAEGRLMNLGCATGHPSFVMSCSFTNQVIAQLELWNERATGKYEKKVYVLPKHLDEKVAALHLGKLGAKLTKLTPEQAAYVSVPTEGPYKPPHYRY

SEQ ID NO: 12377 - protein, 117 aa, Cryptomeria japonica
  misc_feature (15)..(15): Xaa can be any naturally occurring amino acid
ITIKPQTDRWVFPEXNSGIIVLAEGRLMNLGCATGHPSFVMSCSFTNQVIAQLELWNERKTGKYEKKVYVLPKHLDEKVAALHLPKLGAKLTKLSPKQAAYINVPIEGPYKPLHYRY

SEQ ID NO: 12378 - protein, 275 aa, Zamia vazquezii
  misc_feature (120)..(120): Xaa can be any naturally occurring amino acid
  misc_feature (127)..(127): Xaa can be any naturally occurring amino acid
  misc_feature (162)..(162): Xaa can be any naturally occurring amino acid
QRLYQMQANGSLLFPAINVNDSVTKSKFDNLYGCRHSLPDGLMTATDVMIAGKVGVVCGYGDVGKGCAAPLKAAGARVIVTEVDPICALQALMEGIPVLRLEDVLSTANIFVTCTGNKDXIMVDHMXKMKNNAIVCNIGHFDNEIDMQGLETYPGVKRITIXPQTDRWVFPETNTGIIVLAEGRLMNLGCATGHPSFVMSCSFTNQVIAQLELWNERKSGKYKKEVYVLPKHLDEKVAALHLDKLGAKLTKLTPDQAAYINVPVEGPFKPARYRY

SEQ ID NO: 12379 - protein, 123 aa, Flaveria ramosissima
YPDVQRITIKPQTDRWVFPETKTGIIVLAEGRLMNLGCATGHPSFVMSCSFTNQVIAQLELWKEKNTGKYKKEVYVLPKHLDEKVAALHLGKLGAKLTKLTKDQADYISVPVEGPYKPAHYRY

SEQ ID NO: 12380 - protein, 90 aa, Pinus taeda
RMPGPCCFLLSMLSDSVTKSKFDNLYGCRHSLPDGLMRATDVMIAGKWVGDVGKGCAAALKVAGARVIVTEIDPICALQALMEGLPVLTL

SEQ ID NO: 12381 - protein, 132 aa, Utricularia gibba
KTLTESQEEVTTETPTTDRLCLPFETNSGRIIILAEGRLMNLGCATGHPSFVMSCSFTNQVIAQLELWNERSSGKYEKKVTFCQSNSTRKWLPSTLESSVLSSPSSPRSKLTTSASLLRVPTSPPTTGIERF

SEQ ID NO: 12382 - protein, 102 aa, Solanum tuberosum
NSGIIVLAEGRLMNLGCATGHPSFVMSCSFTNQVIAQLELWNERTSGKYEKKVYVLPKHLDEKVAALHLGKLGAKLTKLTKDQADYISVPVEGPYKPAHYRY

SEQ ID NO: 12383 - protein, 122 aa, Utricularia gibba
LESSAPPSSHRLTDRVFPKTGNGIIVLAEGRLMNLGCATGHPSFVMSCSFTNQVIAQLELWNERASGKYKKEVYVLPKHLDEKVALLHLEKLGATLTKLKPDQASYINVPVEGPYKPALYRY

SEQ ID NO: 12384 - protein, 174 aa, Citrus sinensis
EDVVSDADIFVTTTGNKDIIMVDHMKKMKNNAIVCNIGHFDNEIDILGLETYPGVKRITIKPQIDRWVFPETNSGIIVLAEGRLMNLGCATGHPSFVMSCSFTNQVIAQLEFWKEKSTGKYEKKVYVLPKHLDEKVVVFHLGKLGVKLPRLTKEQADYISVSADGPYKPFHYRY

SEQ ID NO: 12385 - protein, 128 aa, Phaseolus coccineus
LGLENYPGVKRITIKPQTDRWVFPETNTGIIVLAEGRLMNLGCATGHPSFVMSCSFTNQVIAQLELWNEKSSGKYEKKVYVLPKHLDEKVAALHLGKLGARLTKLSKDQADYISVAVEGPYKPTHYRY

SEQ ID NO: 12386 - protein, 127 aa, Fraxinus spp
GLETYPGVKRITIKPQTDRWVFPDTNSGIIVLAEGRLMNLGCATGHPSFVMSCSFTNQVIAQLELWNERKTGKYEKKVYVLPKHLDEKVAALHLGKLGAKLTKLSKDQADYISVPVEGPYKPPHYRY

SEQ ID NO: 12387 - protein, 108 aa, Petunia hybrida
FPGVKRITIKPQTDRWVFPDTNSGIIVLAEGRLMNLGCATGHPSFVMSCSFTNQVIAQLELWKEKSTGKYEKKVYVLPKHLDEKVAALHLGKLGAKLTKLSKDQADYI

SEQ ID NO: 12388 - protein, 279 aa, Gossypium hirsutum
MAVKKRKERAVGGESGNSKKFKKYSNSKGPMKKNKNDTRKKGKGPRLPSALRTELDRLDPKIASDSDDGIDLDVGNDVYEYEEEVPQEESRKNRRFDPVENYEYELPEDFEDENVPSDDDDDDGDFGVGGNKGSLNDDVDASDGDEEEDDERHLRMLQGVTGMSTDAFGGKKKRNSVVISEAHPESEYNPTRDVLEGDSHITLQDLLDPIQGKAGYSKLRKRVQHMDRKSTSVQAPLPKVDREKLERMAVYEHSKKDITKWEHLVKRNREAPTVFLVEM

SEQ ID NO: 12389 - protein, 1637 aa, Theobroma cacao
MAEKKRKERAGGGESRTNKKFKKHSNSKGLTKKSKDKSNMRRKRTGPRLPSALRTELDRLNARISSNSDDEINSDVEKDVYEYEEEVPQEESRKNRRFDPVENYEYELPEDFEDENVSSDDDDDDNDDDFDVGGNEGNLIEDLDDSDGVEEEDDGRHLRMLQGITGMSNDAFEGKKKKNNVVISEAHPESEYNPTRDVLEGDGHITVQDLLEPIQGKPGYSKLRKRVQYMDRKSTSIQAPLPKADREKLERMAVYEHSKKDITKWEHLVKRNREAPTIFFGEDVDLGFSTVGAIASEFEPRTEFEKKIASLVYDDKVIEAHKADGSKLLELNKISAEDYMKHRNHIAKMRSLLFHHEMKRKRVKKIKSKTYHRLKNKDKLKAASAEMLMDPEAAKEQARKQEFKRAEERMTLKHKNKSKWARRILERGLNAQDEGTRAAMAEQLHHHALLTRKINTVKDSSSSSSDSSSDEDDEGSDQDRASELLEKAKEKTLKVLEDDEEVPNSGVLSLPFMVRGMKKRKEEAIEEAKLALQEYEQLEGTVGAVNLKPATASGRRVFGMANNEASESNNKIKTDNKKMKMDNYYGNSDSEDDLEAKENLNITGGRKNDVEKDAGPNCVHKEAADVRQDSVFKNFDDIVRDPGPKTTYEVAIFTSDSWRKMKSENGVDANVKKSQEIKEPIVQNQDLKEGEEESDSDSEEQMVDGILSTGPKDSYELPSQSELIRHAFAGDDVEEEFEKDKQEILNDENPEPDKPVLLPGWGQWTHIQQKKGLPSWMLKEHDDAKRKREETLKKRKDAHLKHVIISEKLDKKAEKLQTKTLPYPFTSKERFEQSVRMPIGSEFNPETAIRALNRPDVSYSIFSKLIVLKTSYFPLGGVGVLVRGKMLHELLLALVGYTGDLIIDEREHHKSLGLHLSPDAPISDQRSFKLASDISFIDSSERDLIERLITLGFYYRELDRFATKSRNLSWIRSADVSPLERAAGLSKPKTEKPSVYRRAIANGLVEILSVYRSAVLQIEQKLLSETMPILATVTQGLNKFFVILPPLYELILEIERDDIRGGQLLNLLHKRCHCGVPELQACIQRLLWHGHQVLYNQLASWMVYGILQDQHGEFFIRRQEDRDVDYGSSISDMSEKLARLSTDDSSLTDWHLGFHIFLDMLPEYIPMHVAESILFAGKAVRVLRNPSPAFQFQDALRNQQIKKGSQKVQGSSGRVPFHKEPFLDIKMIGEELLPQSEADKIETMLQDLKESSEFHKRSFECSVDSIRAVAASHLWQLVVVRADLNGHLKALKDYFLLAKGDFFQCFLEESRHLMRLPPRQSTAEADLMVPFQLAAIKTISEEDKYFSLVSLRMPSFGITVKSSQVDLPNTKTYTDGSSGAVLSSTSSETSLDGWDGIALEYSVDWPLQLFFTQEVLSKYRRIFQYLLRLKRTQMELEKSWASVMHQDHTDFAKHRNDRMNCSISQPRRQRCRPMWHVREHMAFLIRNLQFYIQVDVIESQWNVLQSHIQDSHDFTELVGFHQEYLSALISQSFLDIGSVSRILDSIMTVCLQFCWNIENQESSQNTSELERITEEFNKKSNSLYTILRSSRLAGSQRAPFLRRFLLRMNFNSFFEATARGVLNVVRPRPSLPVLNQR

SEQ ID NO: 12390 - protein, 366 aa, Humulus lupulus
MAATMTGSASSSSSLKNFTFNASQRMPATLLSPQSFLGLRSRPSSSLTSSSLSHFFGNARLSSKSVKLTGSNQQTRRRNLSVFSMAADAPADKRAVPLNDYRNIGIMAHIDAGKTTTTERVLFYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRMGANFFRTRDMIVTNLGAKPLVIQIPVGAEDKFKGVVDLVRMKAIIWSGEELGAKFEYVDIPEDLQELAQEYRSQMIENIVELDDSAMESYLEGEEPDEETIKKLIRKGTIGGSLCRFYVAQPLRIRVFNHCLMLL

SEQ ID NO: 12391 - protein, 561 aa, Cajanus cajan
MDRLGANFYRTRDMIITNLGAKPLVIQLPIGAEDSFKGVVDLVRMKAIVWSGEELGAKFDIVDIPEDVLEQAQEYRSQMIETIVEFDDQAMENYLEGIEPDEETVKKLIRKGTISASFVPVMCGSAFKNKGVQPLLDAVVDYLPSPLDLPAMKGSDPENPEATLERVASDEEPFAGLAFKIMSDPFVGSLTFVRVYAGKLTAGSYVLNANKGKKERIGRLLEMHANSREDVKVALAGDIIALAGLKDTITGETLCDPDNPIMLERMDFPDPVIKVAIEPKTKADVDKMATGLIKLAQEDPSFHFSRDEEINQTVIEGMGELHLEIIVDRLKREFKVEANVGAPQVNYRESISKTAEVKYVHKKQSGGQGQFADITVRFEPMDPGSGYEFKSEIKGGAVPKEYIPGVMKGLEECMSNGVLAGFPVVDVRAVLTDGSYHDVDSSVLAFQLAARGAFREGIRKAGPRMLEPIMKVEVVTPEEHLGDVIGDLNSRRGQINSFGDKPGGLKVVDSLVPLAEMFQYVSTLRGMTKGRASYTMQLAMFDVVPQHIQNQLASKEQEVAA

SEQ ID NO: 12392 - protein, 582 aa, Cleome gynandra
MAHIDAGKTTTTERILYYTGRNYKIGEVHEGTATMDWMEQEQERGITITSAATTTYWNKHRINIIDTPGHVDFTLEVERALRVLDGAICLFDSVAGVEPQSETVWRQADKYGVPRICFVNKMDRLGANFFRTRDMIVTNLGAKPLVIQIPIGSEDNFKGVVDLVRMKAIVWSGEELGAKFAYSDIPEDLRDLAEDYRAQMIEMIVELDDEAMENYLEGVEPEEETIKKLIRKGTISSIFVPVMCGSAFKNKGVQPLLDAVVDYLPSPIDLPSMKGSDPENPEATIERKADDDEPFSGLAFKIMSDPFVGSLTFVRIYSGKLSAGSYVLNANKGKKERIGRLLEMHANSREDVKVALTGDIVALAGLKDTITGETLSDPESPVVLERMDFPDPVIKVAIEPKTKADIDKMATGLIKLAQEDPSFHFSRDEEINQTVIEGMGELHLEIIVDRLKREFKVEANVGAPQVNYRESISKIAEVKYVHKKQSGGQGQFADITIRFEPLEAGSGYEFKSEIKGGAVPKEYIPGVMKGLEECMSNGVLAGFPVVDVRAVLVDGSYHDVDSSVLAFQLAARGAFREGIKKD

SEQ ID NO: 12393 - protein, 682 aa, Flaveria ramosissima
AHIDAGKTTTTERVLYYTGRNYKIGEVHEGTATMDWMEQEQERGITITSAATTTFWNNHRINIIDTPGHVDFTLEVERALRVLDGAICLFDSVAGVEPQSETVWRQADKYGVPRICFVNKMDRLGANFFRTRDMIVTNLGAKPLVLQLPIGAEDVFKGVIDLVRMKAIVWSGEELGAKFSYEDIPSDLQELSEEYRALMLETIVELDDEVMEGYLEGVEPDEQTVKKLIRKGTIGGSFVPVLCGSAFKNKGVQPLLDAVVDYLPSPLDLPPMKGTDPENPEIEFDRVASDDAPFAGLAFKIMNDPFVGSLTFVRIYAGKLAAGSYVMNANKGKKERIGRLLEMHANSREDVKVALAGDIVALAGLKDTITGETLCDPEKPIVLERMDFPDPVIKVAIEPKTKADVDKMANGLIKLAQEDPSFHFSRDEEINQTVIEGMGELHLEIIVDRLKREFKVEANVGAPQVNYRESISKVSEVKYVHKKQSGGQGQFADITVRFEPLEAGSGYEFKSEIKGGAVPREYIPGVMKGLEESMTNGVLAGFPVVDLRAVLTDGSYHDVDSSVLAFQLAARGAFREGVRKAGPKILEPIMRVEVVTPEEHLGDVIGDLNSRRGQINSFGDKPGGLKVVDSLVPLAEMFQYVSTLRGMTKGRASYTMQLAKFDVVPQHIQNQLSAAKEEAVAT

SEQ ID NO: 12394 - protein, 134 aa, Ambrosia trifida
MAHIDAGKTTTTERVLYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFLGHGI

SEQ ID NO: 12395 - protein, 682 aa, Vinca minor
MAHIDAGKTTTTERVLYYTGRNYKIGEVHEGTATMDWMEQEQERGITITSAATTTFWDNHRINIIDTPGHVDFTLEVERALRVLDGAICLFDSVAGVEPQSETVWRQADKYGVPRICFVNKMDRLGANFFRTRDMIVTNLGAKPLVLQIPIGAEDNFQGVIDIVRMKAIVWSGEELGAKFSYEDIPADLQELAEDYRAQMIETVVELDDEVMENYLEGNEPDEETIKKLIRKGTISNSFVPVLCGSAFKNKGVQPLLDAVVDYLPSPLDVPAITGTDPENPEVTVEKPPSDDEPFAGLAFKIMSDPFVGSLTFVRVYSGKLAAGSYVLNANKGKKERIGRLLEMHANSREDVKVALTGDIVALAGLKDTVTGETLCDPGTPIVLERMDFPDPVIKVAIEPKTKADIDKMANGLIKLAQEDPSFHFSRDEETNQTVIEGMGELHLEIIVDRLKREYKVEANVGAPQVNYRESISKVAEVKYVHKKQSGGSGQFADITVRFEPLEAGTGYEFKSEIKGGAVLKEYIPGVMKGLEESMPNGVLAGFPMVDVRAVLTDGSYHDVDSSVLAFQLAARGAFREGIRKAGPRMLEPIMKVEVVTPEEHLGDVIGDLNSRRGQINNFGDKPGGLKVVDALVPLAEMFQYVSTLRGMTKGRASYTMQLAKFDVVPQHIQNQLSAKEEAVAS

SEQ ID NO: 12396 - protein, 682 aa, Amorphophallus konjac
MAHIDAGKTTTTERILYYTGRNYKIGEVHEGTATMDWMEQEQERGITITSAATTTFWKNHRINIIDTPGHVDFTLEVERALRVLDGAICLFDSVAGVEPQSETVWRQADKYGVPRICFVNKMDRLGANFFRTRDMIITNLGAKPLVLQLPVGAEDSFKGVIDLLKMKAVIWSGEELGAKFSYEDIPVDLQDLAQEYRMQMIETVVELDDKAMEEYLEGVEPDEETLKKLIRKGTISSSFVPVFCGSAFKNKGVQPLLDAVVDYLPSPLDLPPMKGTDPENPDLIIERAASDDEPFAGLAFKIMSDPFVGSLTFVRVYAGKLVAGSYVLNANKEKKERIGRLLEMHANSREDIKAALTGDIVALAGLKDTITGETLCDPEKPVVLERMDFPDPVIKVAIEPKTKADVDKMALGLIKLAQEDPSFHFSRDDEANQTVIEGMGELHLEIIVDRLKREFKVEANVGAPQVNYRESISRTTEVKYVKKKQSGGQGQFADITVRFEPMEAGSGYEFKSEIKGGAVPKEYIPGVMKGLEECMSNGVLAGYPVVDVRAALVDGSYHDVDSSVLAFQLAARGAFREGMRKAAPRMLEPVMKVEVVTPEEHLGDVIGDLNSRRGQINSFGDKPGGLKVVDALVPLAEMFQYVSTLRGMTKGRASYTMQLAKFDVVPQHIQTQLSSKAEAVAA

SEQ ID NO: 12397 - protein, 165 aa, Trigonella foenum-graecum
IIDTPGHVDFTLEVERALRVLDGAICLFDSVAGVEPQSETVWRQADRYGVPRICFVNKMDRLGANFFRTRDMIVTNLGAKPLVLQLPIGAEDSFKGVIDLVRMKAIVWGGEELGAKFAYEDIPADLLEQAQDYRSQLIETIVELDDETMENYLEGVEPDEETIKN

SEQ ID NO: 12398 - protein, 683 aa, Artemisia annua
MAHIDAGKTTTTERVLYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIITNLGAKPLVLQLPIGAEDVFKGVIDLVRMKAIVWGGEELGAKFSYEDIPADLQKLSEEYRATMLENIVELDDEVMEAYLEGVEPDEATVKKLIRKGTIGGSFVPVLCGSAFKNKGVQPLLDAVVDYLPSPLDVPPMIGTDPDNPEIEIPRVASDDEPFAGLAFKIMNDPFVGSLTFVRIYAGKLAAGSYVVNSNKGKKERIGRLLEMHANSREDVKVALTGDIVALAGLKDTITGETLCDPDKPIVLERMDFPDPVIKVAIEPKTKADVDKMANGLIKLAQEDPSFHFSRDEEINQTVIEGMGELHLEIIVDRLKREFKVEANVGAPQVNYRESISRVSEVKYVHKKQSGGQGQFADITVRFEPLEAGSGYEFKSEIKGGAVPREYIPGVMKGLEESMSNGVLAGFPVVDVRAVLTDGNYHDVDSSVLAFQLAARGAFREGVRKAGPKILEPIMRVEVVTPEEHLGDVIGDLNSRRGQINSFGDKPGGLKVVDSLVPLAEMFQYVSTLRGMTKGRASYTMQLAKFDVVPTHIQNQLAAGKEEAVAA

SEQ ID NO: 12399 - protein, 448 aa, Guizotia abyssinica
MAAEAVTAASLCNFSGSNVASSSRLPRRRYLLSPSLSRHNLHQQRSLTSSFIGTQRIAPGKSNSHFQKRNLSVFAMAAAEDGKREVPLKDYRNIGIMAHIDAGKTTTTERVLYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIITNLGAKPLVLQLPIGAEDVFKGVIDLVRMKAIVWSGEELGAKFSYEDIPSDLQELSEEYRALMLETIVDLDDEVMEAYLEGVEPDEETVKRLVRKGTIGGSFVPVLCGSAFKNKGVQPLLDAVVDYLPSPLDLPPMKGTDPENPEIEIERIASDDEPFSGLAFKIMNDPFVGSLTFVRIYAGKPAAGSYVMNANKGKKELGDYLKCMQIAEKMSK

SEQ ID NO: 12400 - protein, 629 aa, Solanum tuberosum
TTFWNKHRINIIDTPGHVDFTLEVERALRVLDGAICLFDSVAGVEPQSETVWRQADKYGVPRICFVNKMDRLGANFFRTRDMIVTNLGAKPLVIQIPIGAEDTFKGLVDLVMMKAIVWSGEELGAKFSYEDIPADLQELAEEYRALMIETVVELDDDVMEKYLEGVEPDEATIKQLIRKGTISGNFVPVLCGSAFKNKGVQPLLDAVVDYLPSPVDVPPMNGTDPDNPEVIIERAPSDDEPFTGLAFKIMNDPFVGSLTFVRVYSGKLTAGSYVLNANKGRKERIGRLLEMHANSREDVKTALTGDIVALAGLKDTITGETLSDPEKPVVLERMDFPDPVIKVAIEPKTKADIDKMAQGLIKLAQEDPSFHFSRDEEINQTVIEGMGELHLEIIVDRLKREFKVEANVGAPQVNYRESISRNAEVKYVHKKQSGGSGQFADITVRFEPMEAGGGYEFKSEIKGGAVPKEYIPGVMKGLEECMSNGVLAGFPVVDVRAVLVDGSYHDVDSSVLAFQLAARGAFREGMRKASPQLLEPIMKVEVVTPEEHLGDVIGDLNSRRGQINSFGDKPGGLKVVDALVPLAEMFNYVSTLRGMTKGRASYVMQLAKFDVVPQHIQNQLAKKEEAAAA

SEQ ID NO: 12401 - protein, 645 aa, Brassica napus
MEQEQERGITITSAATTTFWDKHRINIIDTPGHVDFTLEVERALRVLDGAICLFDSVAGVEPQSETVWRQADKYGVPRICFVNKMDRLGANFFRTRDMIVTNLGAKPLVLQIPIGAEDSFKGVVDLVRMKAIVWSGEELGAKFNYEDIPADLEELAQEYRAAMMELIVDLDDEVMENYLEGVEPDEATVKRLVRKGTITGKFVPILCGSAFKNKGVQPLLDAVVDYLPSPVEVPPMNGTDPENPEVTIVRKPDDEEPFAGLAFKIMSDPFVGSLTFVRVYSGKLTAGSYVLNANKGKKERIGRLLEMHANSREDVKVALTGDIVALAGLKDTITGETLSDPESPVVLERMDFPDPVIKVAIEPKTKADIDKMATGLIKLAQEDPSFHFSRDEEMNQTVIEGMGELHLEIIVDRLKREFKVEANVGAPQVNYRESISKVAEVKYTHKKQSGGQGQFADITVRFEPLEAGSGYEFKSEIKGGAVPREYIPGVMKGLEECMSSGVLAGFPVVDVRACLVDGSYHDVDSSVLAFQLAARGAFREGMRKAGPRMLEPIMRVEVVTPEEHLGDVIGDLNSRRGQINSFGDKPGGLKVVDSLVPLAEMFQYVSTLRGMTKGRASYIMQLAKFDVVPQHIQNQLSSKDQEVAA

SEQ ID NO: 12402 - protein, 682 aa, Brassica napus
MAHIDAGKTTTTERILYYTGRNYKIGEVHEGTATMDWMEQEQERGITITSAATTTFWDKHRINIIDTPGHVDFTLEVERALRVLDGAICLFDSVAGVEPQSETVWRQADKYGVPRICFVNKMDRLGANFFRTRDMIVTNLGAKPLVLQIPIGAEDSFKGVVDLVRMKAIVWSGEELGAKFNYEDIPADLEELAQEYRAAMMELIVDLDDEVMENYLEGVEPDEATVKRLVRKGTITGKFVPILCGSAFKNKGVQPLLDAVVDYLPSPVEVPPMNGTDPENPEVTIVRKPDDEEPFAGLAFKIMSDPFVGSLTFVRVYSGKLTAGSYVLNANKGKKERIGRLLEMHANSREDVKVALTGDIVALAGLKDTITGETLSDPESPVVLERMDFPDPVIKVAIEPKTKADIDKMATGLIKLAQEDPSFHFSRDEEMNQTVIEGMGELHLEIIVDRLKREFKVEANVGAPQVNYRESISKVAEVKYTHKKQSGGQGQFADITVRFEPLEAGSGYEFKSEIKGGAVPREYIPGVMKGLEECMSSGVLAGFPVVDVRACLVDGSYHDVDSSVLAFQLAARGAFREGMRKAGPRMLEPIMRVEVVTPEEHLGDVIGDLNSRRGQINSFGDKPGGLKVVDSLVPLAEMFQYVSTLRGMTKGRASYIMQLAKFDVVPQHIQNQLSSKDQEVAA

SEQ ID NO: 12403 - protein, 682 aa, Solanum phureja
MAHIDAGKTTTTERVLYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVTNLGAKPLVIQIPIGAEDTFKGLVDLVMMKAIVWSGEELGAKFSYEDIPADLQELAEEYRALMIETVVELDDDVMEKYLEGVEPDDATIKQLIRKGTISGNFVPVLCGSAFKNKGVQPLLDAVVDYLPSPVDVPPMNGTDPDNPEVIIERAPSDDEPFTGLAFKIMNDPFVGSLTFVRVYSGKLTAGSYVLNANKGRKERIGRLLEMHANSREDVKTALTGDIVALAGLKDTITGETLSDPEKPVVLERMDFPDPVIKVAIEPKTKADIDKMAQGLIKLAQEDPSFHFSRDEEVNQTVIEGMGELHLEIIVDRLKREFKVEANVGAPQVNYRESISRNAEVKYVHKKQSGGSGQFADITVRFEPMEAGGGYEFKSEIKGGAVPKEYIPGVMKGLEECMSNGVLAGFPVVDVRAVLVDGSYHDVDSSVLAFQLAARGAFREGMRKASPQLLEPIMKVEVVTPEEHLGDVIGDLNSRRGQINSFGDKPGGLKVVDALVPLAEMFNYVSTLRGMTKGRASYVMQLAKFDVVPQHIQNQLAKKEEAAAA

SEQ ID NO: 12404 - protein, 245 aa, Flaveria ramosissima
MGELHLEIIVDRLKREFKVEANVGAPQVNYRESISKVSEVKYVHKKQSGGQGQFADITVRFEPLEAGSGYEFKSEIKGGAVPREYIPGVMKGLEESMTNGVLAGFPVVDLRAVLTDGSYHDVDSSVLAFQLAARGAFREGVRKAGPKILEPIMRVEVVTPEEHLGDVIGDLNSRRGQINSFGDKPGGLKVVDSLVPLAEMFQYVSTLRGMTKGRASYTMQLAKFDVVPQHIQNQLLLQRKKQLQL

SEQ ID NO: 12405 - protein, 682 aa, Mimulus guttatus
MAHIDAGKTTTTERILYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTIDMIVSNLGAKPLVLQIPVGAEDTFKGVIDIVRMQAIIWSGEELGAKFSYEEIPEDLQDMAQEYRAQMIENIVELDDEAMEGYLEGLEPDEETIKKLIRKGTIGGSFVPVLCGSAFKNKGVQPLLDSVVDYLPSPEEVPPMKGTDPDDPELIIERGANDSEPFAGLAFKIMSDPFVGSLTFVRVYAGKLEAGSYVLNSNKGKKERIGRLLEMHANSREDVKVALTGDIIALAGLKDTVTGETLCDPEKPIVLERMDFPDPVIKVAIEPKTKADIDKMAVGLIKLAQEDPSFHFSRDEEINQTVIEGMGELHLEIIVDRLKREYKVEANVGAPQVNYRESISKITEVKYVHKKQSGGSGQFADITVRFEPLEAGSGYEFKSEIKGGAVPREYIPGVVKGLEESMSNGVLAGYPVVDVRAVLVDGSYHDVDSSVLAFQLAARGAFREGIRKAGPRMLEPIMKVEVVTPEDHLGDVIGDLNSRRGQIENFGDKPGGLKVVDALVPLAEMFQYVSTLRGMTKGRASYTMQLAKFDVVPQHIQNQLATKEEAVTA

SEQ ID NO: 12406 - protein, 209 aa, Ambrosia trifida
MDFPDPVIKVAIEPKTKADVDKMANGLIKLAQEDPSFHFSRDEEINQTVIEGMGELHLEIIVDRLKREFKVEANVGAPQVNYRESISRMAEVKYVHKKQSGGQGQFADITVRFEPLEAGSGYEFKSEIKGGAVPREYIPGVMKGLEESMSNGVLAGFPVVDLRAVLTDGSYHDVDSSVLAFQLAARGAFREGAREAAPKILEPIMRVEL

SEQ ID NO: 12407 - protein, 681 aa, Plantago ovata
MAHIDAGKTTTTERVLFYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFYRTRDMIISNLGAKPLVLQLPIGAEDTFKGVVDLVRMKAIVWSGEQLGAKFSYEEIPADLQDLAEEYRAQLIETVVEVDDAAMENYLEGIEPDEETMKKLVRQGTIGGNFVPVLCGSAFKNKGVQPLLDAVVDYLPSPLDVPAMKGTDPDDPELIIERKPSDDEPFAGLAFKIMNDPFVGSLTFVRVYAGKLAAGSYVVNANKGKKERIGRLLEMHANSREDIKAALTGDIIAIAGLKDTITGETLSDPDQPIVLERMDFPDPVIKVAIEPKTKADIDKMAIGLIKLAQEDPSFHFSRDEEINQTVIEGMGELHLEIIVDRLKREFKVEANVGAPQVNYRESISKVTEVKYVHKKQSGGSGQFADITVRFEPLEAGTGYEFKSEIKGGAVPREYIPGVMKGLEESMSNGVLGGYPVVDVRAVLVDGSYHDVDSSVLAFQLAARGAFREGIRRAGPQMLEPIMRVEVVTPEEHLGDVIGDLNSRRGQINNFGDKPGGLKVVDALVPLAEMFQYVSNLRGMTKGRASYTMQLAKFDVVPQHIQNQLAKEDAVTA

SEQ ID NO: 12408 - protein, 411 aa, Tragopogon dubius
MIGTDPENPEIEIERRASDNEPFAGLAFKIMNDPFVGSLTFVRIYAGKLAAGSYVINANKGKKERIGRLLEMHANSREDVKVALTGDIVALAGLKDTITGETLCDGENPIVLERMDFPDPVIKVAIEPKTKADVDKMANGLIKLAQEDPSFHFSRDEEVNQTIIEGMGELHLEIIVDRLKREFKVEANVGAPQVNYRESISRVSEVKYVHKKQSGGQGQFADITVRFEPLEAGSGYEFKSEIKGGAVPREYIPGVMKGLEESMSNGVVAGYPVVDLRAVLTDGNYHDVDSSVLAFQLAARGAFREGVRKAAPKILEPIMRVEVVTPEEHLGDVIGDLNSRRGQINSFGDKPGGLKVVDSLVPLAEMFQYVSTLRGMTKGRASYTMQLAKFDVVPQHIQNQLSAAKEEAVTA

SEQ ID NO: 12409 - protein, 682 aa, Sorghum bicolor
MAHIDAGKTTTTERILYYTGRNYKIGEVHEGTATMDWMEQEQERGITITSAATTAFWNKHRINIIDTPGHVDFTLEVERALRVLDGAICLFDSVAGVEPQSETVWRQADKYGVPRICFVNKMDRLGANFFRTRDMIVANLGAKPLVIQLPIGSEDNFQGVIDLVRMKAIVWTGEELGAKFEYKDIPDDLQELAQDYRVQMLETIIELDDEVMENYLEGTEPDEETVKKLIRKGTISASFVPVLCGSAFKNKGVQPLLDAVVDYLPSPLDLPSMKGTDPEDPEIIFERQPSDDEPFSGLAFKIMTDPFVGSLTFVRIYSGKLVAGSYVLNANKDKKERIGRLLEMHANSKEDIPVAVTGDIVALAGLKDTITGETLCDPDKPVVLERMEFPDPVIKVAIEPKTKADADKMANGLIKLAQEDPSFHFSRDEETNQTVIEGMGELHLDIIVDRLKREFKVEANVGAPQVNYRESISKVAEIQYVHKKQSGGSGQFADIIVRFEPLEAGSGYEFKSEIKGGAVPKEYVPGVMKGLEESLPNGVLAGYPVVDFRAVLVDGSYHDVDSSVLAFQIAARGAFREGMRKAGPRLLEPIMRVEVITPEEHLGDVIGDLNSRRGQVNSFGDKPGGLKVVDAFVPLAEMFQYVSTLRGMTKGRASYTMQLAKFDVVPQHIQNQLSTKTEEATA

SEQ ID NO: 12410 - protein, 615 aa, Oryza sativa
MSTSLLRLSVLSGCWMELLCLFASVAGVEPQSETVWRQADKYGVPRICFVNKMDRLGANFFRTRDMIIANLGAKPLVIQLPIGSEDNFQGVIDLVKMKAIVWTGEELGAKFSYQDIPADLQEMADDYKAQMMETIVELDDDVMETYLEGGEIDEETVKRLIRKGTISASFVPVLCGSAFKNKGVQPLLDAVVDYLPSPLDLPPMKGTDPEDPELILERKPSDDEPFSGLAFKIMTDPFVGSLTFVRIYSGKLVAGSYVLNANKDKKERIGRLLEMHANSKEDITVAVAGDIVALAGLKDTITGETLSDPDKPVVLERMEFPDPVIKVAIEPKTKADADKMATGLIKLAQEDPSFHFSRDEETNQTVIEGMGELHLDIIVDRLKREFRVEANVGAPQVNYRESISKISEVQYVHKKQSGGSGQFADIIVRFEPLEAGSGYEFKSEIKGGAVPKEYVPGVMKGIEESLPNGVLAGYPVVDLRAVLVDGSYHDVDSSVLAFQIAARGAFREGLRKAGPRLLEPIMKVEVITPEEHLGDVIGDLNSRRGQVNSFGDKPGGLKVVDAFVPLAEMFQYVSTLRGMTKGRASYTMQLAKFDVVPQHIQNELSAAKQEEASTA

SEQ ID NO: 12411 - protein, 543 aa, Ambrosia trifida
GAKPLVLQLPIGAEDVFKGVIDLVRMKAIVWSGEELGAKFTYEDIPADLQELAEEYRALMLENIVELDDEVMEGYLEGVEPDEATVKRLIRKGTIGGSFVPVLCGSAFKNKGVQPLLDAVVDYLPSPLDLPPMKGTDPENPEIEIERVASDDEAFSGLAFKIMNDPFVGSLTFVRIYSGKLAAGSYVMNANKGKKERIGRLLEMHANSREDVKVALAGDIVALAGLKDTITGETLSDAEKPIVLERMDFPDPVIKVAIEPKTKADVDKMANGLIKLAQEDPSFHFSRDEEINQTVIEGMGELHLEIIVDRLKREFKVEANVGAPQVNYRESISRMAEVKYVHKKQSGGQGQFADITVRFEPLEAGSGYEFKSEIKGGAVPREYIPGVMKGLEESMSNGVLAGFPVVDLRAVLTDGSYHDVDSSVLAFQLAARGAFREGVRKAAPKILEPIMRVEVVTPEEHLGDVIGDLNSRRGQINSFGDKPGGLKVVDSLVPLAEMFQYVSTLRGMTKGRASYTMQLAKFDVVPQHIQNQLSAAKEEAVTA

SEQ ID NO: 12412 - protein, 536 aa, Malus domestica
LQIPVGAEDNFKGVIDLVKMRAILWSGEELGAKFVYEEIPSHLLELAQEYRAEMIETIVELDDQAMEGYLEGVEPDEETIKKLIRKGTIAISFVPVLCGSAFKNKGVQPLLDAVVDYLPSPLDVPPMKGTDADNPEITIERAASDEEPFAGLAFKIMSDPFVGSLTFVRIYAGKLTAGSYVLNANKGKKERIGRLLEMHANSREDVKVALAGDIVALAGLKDTITGETLSDPDHPIVLERMDFPDPVIKVAIEPKTKADVDKMGAGLVKLAQEDPSFHFSRDEEINQTVIEGMGELHLEIIVDRLKREFKVEANVGAPQVNYRESISRTSEVRYVHKKQSGGQGQFADVTVRFEPMEAGGGYEFKSEIKGGAVPREYIPGVMKGLEECMSNGVLAGFPVVDVRAVLVDGSYHDVDSSVLAFQLAARGAFREGIKKAAPKMLEPIMKVEVVTPEEHLGDVIGDLNSRRGQINSFNDKPGGLKVVDSLVPLAEMFQYVSTLRGMTKGRASYTMQLAKFDVVPQHIQNQLAAKEEEVAA

SEQ ID NO: 12413 - protein, 547 aa, Coffea canephora
GTNLGAKPLVIQIPVGAEDNFQGIVDLVKMKAVIWCGEELGAKFSYEDIPADLKEIADDYRAQMIEAVVEMDDGAMEKYLEGVEPDEETIKKLIRKGTISGSFVPVLCGSAFKNKGVQPLLDAVVNYLPSPLDVPAVKGTDPENPEVTIERSADDGEPFAGLAFKIMSDPFVGSLTFVRVYSGKLEAGSYVLNANKGKKERIGRLLEMHANSREDVKAVLTGDIVALAGLKDTITGETLCDPDSPVVLERMDFPDPVIKVAIEPKTKADVDKMANGLIKLAQEDPSFHFSRDEETNQTVIEGMGELHLEIIVDRLKREFKVAANVGAPQVNYRESISKVTETKYVHKKQSGGAGQFADITVRFEPMEPGGGYEFKSEIKGGVVPKEYIPGVMKGLEECMSNGVLAGYPVVDVRAVLVDGSYHDVDSSVLAFQLAARGAFREGMRKAAPRMLEPIMKVEVVTPEEHLGDVIGDLNSRRGQINTFGDKPGGLKVVDALVPLAEMFQYVSTLRGMTKGRASYTMQLAKFDVVPQHIQNQLSQVKEEAVAA

SEQ ID NO: 12414 - protein, 553 aa, Pinus pinaster
MAETLKVSPCFFYSSHNYIGRHKYSGRRSKDGISLNSFNGLKALAGFPLRSPSIQGFRANDLMLCKASDSTSTSVRGRTLIVSMAADGPSRDVPLSEYRNIGIMAHIDAGKTTTTERILYYTGKNYKIGEVHEGTATMDWMEQEQERGITITSAATTCAWNDHRINIIDTPGHVDFTLEVERALRVLDGSICLFDSVAGVEPQSETVWRQADRYGVPRICFVNKMDRLGANFFRTRDMVVTNLGAKPLVLQIPIGAEECFQGLIDLVKMKAVLWSGEELGAKFSYEDIPADLLDLATEYRNQMIETIVELDDDAMEKYLEGEEPDEKTIKRLIRKGTISISFVPVLCGSAFKNKGVQPLLDAVVDYLPSPVDLPPMKGTDVDDPEVTLERRASDDEPFAGLAFKIMTDPFVGSLTFVRVYSGVLTAGSYVLNSNKGKKERIGRLLRMHAISRDDVKIAVTGDIVALAGLKDTITGETLCDPDKPVVLERMDFPEPVIKVAIEPKTKADVDKMSMGLVKLAQEDPSFHFSRDEESNQTVIEGMGSCILKSLLTV

SEQ ID NO: 12415 - protein, 682 aa, Pinus taeda
MAHIDAGKTTTTERILYYTGKNYKIGEVHEGTATMDWMEQEQERGITITSAATTCAWNDHRINIIDTPGHVDFTLEVERALRVLDGSICLFDSVAGVEPQSETVWRQADRYGVPRICFVNKMDRLGANFFRTRDMIVTNLGAKPLVLQIPIGAEERFQGLIDLVKMKAVLWSGEELGAKFSYEDIPADLLDLATEYRNQMIETIVELDDDAMEKYLEGEEPDEKTIKRLIRKGTISISFVPVLCGSAFKNKGVQPLLDAVVDYLPSPVDLPPMKGTDVDDPEVTLERRASDDEPFAGLAFKIMTDPFVGSLTFVRVYSGVLTAGSYVLNSNKGKKERIGRLLRMHAISRDDVKIAVTGDIVALAGLKDTITGESLCDPDKPVVLERMDFPEPVIKVAIEPKTKADVDKMSMGLVKLAQEDPSFHFSRDEESNQTVIEGMGELHLEIIVDRLKREFKVEANVGAPQVNYRESISKIAETKYVHKKQSGGQGQFADVTVRFEPLEAGSGYEFKSEIKGGVVPKEYIPGVMKGLEECMSNGILAGYPVVDVRAVLTNGSYHEVDSSALAFQLAARGAFREGIRKSGPKLLEPIMKVEVVTPEEHLGDVIGDINSRRGQINTFADKPGGLKVIDALVPLAEMFQYVSTLRSMTKGRASYTMQLAKFDVVPQHIQNQLSSKVQEVAA

SEQ ID NO: 12416 - protein, 646 aa, Podocarpus macrophillus
WMEQEQERGITITSAATTAVWNNHRINIIDTPGHVDFTLEVERALRVLDGTICLFDSVAGVEPQSETVWRQADKYGVPRICFVNKMDRLGANFFRTRDMIIKNLGAKPLVIQIPIGAEDRFQGVVDLVKMKAVFWSGEELGAKFSYEDIPADLVELAKEYRNQMIETIVDLDDEAMEKYLEGAELDEQTIRKLIRKGTLSLKFVPVLCGSAFKNKGVQPLLDAVVDYLPSPIDLPPLKGTDAESPELILERHPSDDEPFAGLAFKIMTDPFVGSLTFVRVYSGKVSAGSYVLNSNKGKKERIGRLLQMHANSREDIKVSVTGDIVAFAGLKDTITGETLCDPDKPVVLERMEFPDPVIKVAIEPKTKADVDKMSFGLVKLAQEDPSFHFSRDEETNQTVIEGMGELHLEIIVDRLKREFKVEANVGAPQVNYRESISRTAEVKYVHKKQSGGQGQFADISVRFEPMEAGSGYEFKSEIKGGAVPREYIPGVMKGLEECMGSGILGGYPVVDVRAVLTDGSYHDVDSSVLAFQLAARGAFREGIRKAGPRLLEPVMKVEVVTPEEHLGDVIGDLNSRRGQIISFDDKPGGLKVIDALVPLAEMFQYVSNLRGMTKGRASYIMQLAKFDVVPQHIQNQISTKSQEVAA

SEQ ID NO: 12417 - protein, 799 aa, Sequoia sempervirens
MAETLKLGKCFSRSSLQNNNGIGHNSLQNNSCLGHKQNGSRRITRRGFVVNSLHSLKSLAGFPLPSSSSSVQRPGHNLSRLLQRASVSNVSNRMPIVCMAADGEREVPLSDYRNIGIMAHIDAGKTTTTERILFYTGRNYKIGEVHEGTATMDWMEQEQERGITITSAATTAVWNNHRINIIDTPGHVDFTLEVERALRVLDGTICLFDSVAGVEPQSETVWRQADRYGVPRICFVNKMDRLGANFFRTRDMIITNLGAKPLVLQIPIGAEDSFRGVVDLIKMKAIVWSGEELGAKFSYEDIPADLLDLALEYRNQMLETIVELDDEAMEKYLEGEELDEKTIKKLIRMGTISIKFVPVLCGSAFKNKGVQPLLDAVVDFLPSPLDLPPLKGTDADDPEVILERRPSDDEPFAGLAFKIMADSFVGSLTFVRVYSGKLNSASYVLNSNKGKRERIGRLLQMHANSREEVKVAVAGDIVALAGLKETITGETLCDPDKPIVLERMNFPDPVIKVAIEPKTKADVDKMSMGLIKLAQEDPSFHFSRDEEGNQTVIEGMGELHLEIIVDRLKREFKVEANVGAPQVNYRESISKTAEVKYVHKKQSGGQGQFADISIRFEPIEAGGGYEFKSAIKGGVVPKEYIPGVMKGLEECMNNGVLAGFPVVDVRAVLVDGSYHDVDSSVLAFQLAARGAFREGMRKAGPKLLEPIMKVEVVTPEEHLGDVIGDINSRRGQIHSFGDKPGGLKVVDALVPLAEMFQYVSSLRSMTKGRASYTMQLAKFDVVPQHIQTQLSTKSEEVAA

SEQ ID NO: 12418 - protein, 683 aa, Setaria italica
MAHIDAGKTTTTERILYYTGRNYKIGEVHEGTATMDWMEQEQERGITITSAATTAFWNKHRINIIDTPGHVDFTLEVERALRVLDGAICLFDSVAGVEPQSETVWRQADKYGVPRICFVNKMDRLGANFFRTRDMIVANLGAKPLVIQLPIGSEDSFQGVVDLVRMKAIVWTGEELGAKFEYQDIPANLQEMAEDYRVQMLETIIELDDEVMEKYLEGIEPDEETVKKLIRKGTISASFVPVLCGSAFKNKGVQPLLDAVVDYLPSPLDLPAMKGTDPDDPELVLERNPSDDEPFSGLAFKIMTDPFVGSLTFVRIYSGKLVAGSYVLNANKDKKERIGRLLEMHANSKEDITVAVTGDIVALAGLKDTITGETLCEPDKPVVLERMEFPDPVIKVAIEPKTKADADKMATGLIKLAQEDPSFHFSRDEETNQTVIEGMGELHLDIIVDRLKREFRVEANVGAPQVNYRESISKVAEVQYVHKKQSGGSGQFADIIVRFEPLEAGSGYEFKSEIKGGSVPKEYVPGVMKGLEESLPNGVLAGYPVVDFRAVLVDGSYHDVDSSVLAFQIAARGAFREGMRKAGPRLLEPIMRVEVVTPEDHLGDVIGDLNSRRGQVNSFGDKPGGLKVVDAFVPLAEMFQYVSTLRGMTKGRASYTMQLAKFDVVPQHIQNQLSAAKTEEAAA

SEQ ID NO: 12419 - protein, 678 aa, Pseudotsuga menziesii
MQGKPLLQRGFFTTQAETIKLGEVHEGTATMDWMEQEQERGITITSAATTCAWNNHRINIIDTPGHVDFTLEVERALRVLDGSICLFDSVAGVEPQSETVWRQADRYGVPRICFVNKMDRLGANFFRTRDMIITNLGAKPLVLQIPIGAEDRFQGVVDLVKMKAVLWSGEELGATFSYEDIPADLLDLATEYRNLLIETIVELDDDAMEKYLEGEEPDEKTIKRLIRKGTISISFVPVLCGSAFKNKGVQPLLDAVVDYLPSPLDLPPMKGTDVDDPEVTLERLASDDEPFAGLAFKIMTDPFVGSLTFVRIYSGVLTAGSYVLNSNKGKKERIGRLLQMHAISRDDIKIAVTGDIVALAGLKDTVTGESLCDPDNPIVLERMNFPEPVIKVAIEPKTKADVDKMSMGLVKLAQEDPSFHFSRDEESNQTVIEGMGELHLEIIVDRLKREFKVEANVGAPQVNYRESISKTAETKYVHKKQSGGQGQFADVTVRFEPLEAGSGYEFKSEIKGGVVPKEYIPGVMKGLEECMSNGILAGYPVVDVRAVLTSGSYHEVDSSALAFQLAARGAFREGIRKAGPRLLEPIMKVEVVTPEEHLGDVIGDINSRRGQINTFDDKPGGLKVIDALVPLAEMFQYVSTLRSMTKGRASYTMQLAKFDVVPQHIQNQLSSKVQEVAA

SEQ ID NO: 12420 - protein, 683 aa, Hordeum vulgare
MAHIDAGKTTTTERILYYTGRNYKIGEVHEGTATMDWMEQEQERGITITSAATTAVWDKHRINIIDTPGHVDFTLEVERALRVLDGAICLFDSVAGVEPQSETVWRQADKYGVPRICFVNKMDRLGANFFRTRDMIVANLGAKPLVIQLPIGSEDNFQGVVDLIRMKAIVWTGEELGAEFSYQDIPADLEELAQDYRLQMMETIVELDDEAMEGYLEGNEPDEATVKKLIRKGTIGASFVPILCGSAFKNKGVQPLLDAVVDYLPSPLDLPPMKGTDPDDPEVVLERLPSDDEPFSGLAFKIMTDPYVGSLTFVRIYSGKLIAGSYVLNANKDKKERIGRLLEMHANSKEDITVAVTGDIVALAGLKDTITGETLCDPDNLVVLERMEFPDPVIKVAIEPKTKADADKMANGLIKLAQEDPSFHFSRDEETNQTVIEGMGELHLDIIVDRLKREFKVEANVGAPQVNYRESISKIAETQYVHKKQSGGSGQFADIIVRFEPMEAGSGYEFKSEIKGGAVPKEYVPGVMKGIEESLPNGVLAGYPVVDLRAVLVDGSYHDVDSSVLAFQIAARGAFREGLRKAGPRLLEPIMKVEVITPEEHLGDVIGDLNSRRGQVNSFGDKPGGLKVVDAFVPLAEMFQYVSSLRGMSKGRASYTMQLAKFDVVPQHIQNQLSAAKQEEAAA

SEQ ID NO: 12421 - protein, 648 aa, Distylium racemosum
MDWMEQEQERGITITSAATTAVWNNHRINIIDTPGHVDFTLEVERALRVLDGTICLFDSVAGVEPQSETVWRQADRYGVPRLCFVNKMDRLGANFFRTRDMIVTNLGAKPLVLQIPIGAEDRFQGVVDLITMKAVVWSGEELGAKFSYEDIPADLVDIATEYRNQMIETIVELDDEAMEKYLEGEELDEKNIKKLIRKGTVSIKFVPVLCGSAFKNKGVQPLLDAVVDYLPSPLDLPPIQGTDAENPEISLERCASDDEPFSGLAFKIMTDPFVGSLTFVRIYSGKLNAGTYVLNSNKGKKERIGRLLQMHANSRDDIKVAVAGDIVALAGLKDTITGETLCDQDNPVVLERMEFPDPVIKVAIEPKTKADVDKMSLGLVKLAQEDPSFHFSRDEETNQTVIEGMGELHLEIIVDRLKREFKVAANVGAPQVNYRESISRIAEVKYVHKKQSGGQGQFADVSVRFEPMEAGTGYEFKSEIKGGAVPREYIPGVMKGLEECMSNGVLAGYPVVDVRAVLTDGSYHDVDSSALAFQLAARGAFREGVRKAGPRLLEPVMKVEVVTPDEHLGDVIGDINSRRGQIISFDDKPGGLKVIDSLVPLAEMFQYVSRLRGMTKGRASYTMQVAKFDVVPQHIQNQIATKSQEVAA

SEQ ID NO: 12422 - protein, 591 aa, Flaveria ramosissima
SVAGVEPQSETVWRQADKYGVPRICFVNKMDRLGANFFRTRDMIVTNLGAKPLVLQLPIGAEDVFKGVIDLVRMKAIVWSGEELGAKFSYEDIPSDLQELSEEYRALMLETIVELDDEVMEGYLEGVEPDEQTVKKLVRKGTIGGSFVPVLCGSAFKNKGVQPLLDAVVDYLPSPLDLPPMKGTDPENPEIEIDRVASDDAPFAGLAFKIMNDPFVGSLTFVRIYAGKLAAGSYVMNANKGKKERIGRLLEMHANSREDVKVALAGDIVALAGLKDTITGETLCDPEKPIVLERMDFPDPVIKVAIEPKTKADVDKMANGLIKLAQEDPSFHFSRDEEINQTVIEGMGELHLEIIVDRLKREFKVEANVGAPQVNYRESISKVSEVKYVHKKQSGGQGQFADITVRFEPLEAGSGYEFKSEIKGGAVPREYIPGVMKGLEESMTNGVLAGFPVVDLRAVLTDGSYHDVDSSVLAFQLAARGAFREGVRKAGPKILEPIMRVEVVTPEEHLGDVIGDLNSRRGQINSFGDKPGGLKVVDSLVPLAEMFQYVSTLRGMTKGRASYTMQLAKFDVVPQHIQNQLSAAKEEAVAT

SEQ ID NO: 12423 - protein, 795 aa, Festuca arundinacea
  misc_feature (89)..(89): Xaa can be any naturally occurring amino acid
ARGLTLERRRQQAKAKAKHARTDSTMAAEAVPRAAVPARRPSVAAAASASRLLLGQRPFLAPSASRFAAGRAAVAGPAAGLRPCTRRPXLSVVAMAGNDRQVPLEDYRNIGIMAHIDAGKTTTTERILYYTGRNYKIGEVHEGTATMDWMEQEQERGITITSAATTAVWDKHRINIIDTPGHVDFTLEVERALRVLDGAICLFDSVAGVEPQSETVWRQADKYGVPRICFVNKMDRLGANFYRTRDMIVANLGANPLVIQLPIGSEDNFQGVVDLVRMKAIVWTGEELGAQFSYEDIPADLEEMAQEYRVRMIETIVELDDEAMEGYLEGNEPDEETVKKLIRKGTIGASFVPILCGSAFKNKGVQPLLDAVVDYLPSPLDLPPMKGTDPDDPELVLERLPSDDEPFSGLAFKIMTDPYVGSLTFVRIYSGKLIAGSYVLNANKDRKERIGRLLEMHANSKEDITVAVTGDIVALAGLKDTITGETLCDPDNLVVLERMEFPDPVIKVAIEPKTKADADKMANGLIKLAQEDPSFHFSRDDETNQTVIEGMGELHLDIIVDRLKREFKVEANVGAPQVNYRESISKIAETHYVHKKQSGGSGQFADIIVRFEPMEAGTGYEFKSEIKGGAVPKEYIPGVMKGIEESLPNGVLAGYPVVDLRAVLVDGSYHDVDSSVLAFQIAARGAFREGLRKAGPRLLEPVMRVEVITPEEHLGDVIGDLNSRRGQVNSFGDKPGGLKVVDAFVPLAEMFQYVSTLRGMSKGRASYTMQLAKFDVVPQHIQNQLSAAKQEEAAA

SEQ ID NO: 12424 - protein, 534 aa, Flaveria ramosissima
PIGAEDVFKGVIDLVRMKAIVWSGEELGAKFSYEDIPSDLQELSEEYRALMLETVVELDDEVMEGYLEGVEPDEETVKKLVRKGTIGSSFVPVLCGSAFKNKGVQPLLDAVVDYLPSPLDLPPMKGTDPENPEIEIDRVASDDAPFAGLAFKIMNDPFVGSLTFVRIYAGKLAAGSYVMNANKGKKERIGRLLEMHANSREDVKVALAGDIVALAGLKDTITGETLCDPEKPIVLERMDFPDPVIKVAIEPKTKADVDKMANGLIKLAQEDPSFHFSRDEEINQTVIEGMGELHLEIIVDRLKREFKVEANVGAPQVNYRESISKVSEVKYVHKKQSGGQGQFADITVRFEPLEAGSGYEFKSEIKGGAVPREYIPGVMKGLEESMTNGVLAGFPVVDLRAVLTDGSYHDVDSSVLAFQLAARGAFREGVRKAGPKILEPIMRVEVVTPEEHLGDVIGDLNSRRGQINSFGDKPGGLKVVDSLVPLAEMFQYVSTLRGMTKGRASYTMQLAKFDVVPQHIQNQLSAAKEEAVAT

SEQ ID NO: 12425 - protein, 768 aa, Brachypodium distachyon
MAAEALPRAAAPARRPSVASASASRLLLGHRPFLAPSASRFAAGRAAVAGPPPSLRPRPRRPRLSVVAMAGTDRQVPLGDYRNIGIMAHIDAGKTTTTERILYYTGRNYKIGEVHEGTATMDWMEQEQERGITITSAATTAVWDKHRINIIDTPGHVDFTLEVERALRVLDGAICLFDSVAGVEPQSETVWRQADKYGVPRICFVNKMDRLGANFFRTRDMIVANLGAKPLVIQLPIGSEDNFQGVVDLVRMKAIVWTGEELGAQFSYQDIPADLEEMAQDYRVQMLETIVELDDEAMEGYLEGNEPDEETVKRLIRKGTIGASFVPILCGSAFKNKGVQPLLDAVVDYLPSPLDLPPMKGTDPDDPEVVLERRPSDDEPFSGLAFKIMTDPYVGSLTFVRIYSGKLVAGSYVLNANKDRKERIGRLLEMHANSKEDITVAVTGDIVALAGLKDTITGETLCDPDSLVVLERMEFPDPVIKVAIEPKTKADADKMANGLIKLAQEDPSFHFSRDDETNQTVIEGMGELHLDIIVDRLKREFKVEANVGAPQVNYRESISKIAEVQYVHKKQSGGSGQFADIIVRFEPMEAGSGYEFKSEIKGGAVPKEYVPGVMKGIEESLPNGVLAGYPVVDLRAVLVDGSYHDVDSSVLAFQIAARGAFREGLRKAGPRLLEPVMRVEVITPEEHLGDVIGDLNSRRGQVNSFGDKPGGLKVVDAFVPLAEMFQYVSTLRGMSKGRASYTMQLAKFDVVPQHIQNQLSAAKEEAAA

SEQ ID NO: 12426 - protein, 771 aa, Avena sativa
MAAEALPRAATRTAARRPSVAAASASRLLLGQRPFLAPSASRFAAGRAAVAGPAAGIRPRTRRPRLSVVAMAGNDRQVPLEDYRNIGIMAHIDAGKTTTTERILYYTGRNYKIGEVHEGTATMDWMEQEQERGITITSAATTAVWDKHRINIIDTPGHVDFTLEVERALRVLDGAICLFDSVAGVEPQSETVWRQADKYGVPRICFVNKMDRLGANFYRTRDMIVANLGANPLVIQLPIGSEDNFQGVVDLVRMKAIVWTGEELGAQFSYEDIPADLEEMAQEYRVRMIETIVELDDEAMEGYLEGNEPDEETVKKLIRKGTIGASFVPILCGSAFKNKGVQPLLDAVVDYLPSPLDLPPMKGTDPDDPELVLERLPSDDEPFSGLAFKIMTDPYVGSLTFVRIYSGKLIAGSYVLNSNKDRKERIGRLLEMHANSKEDITVAVTGDIVALAGLKDTITGETLCDPDNLVVLERMEFPDPVIKVAIEPKTKADADKMANGLIKLAQEDPSFHFSRDDETNQTVIEGMGELHLDIIVDRLKREFKVEANVGAPQVNYRESISKIAETHYVHKKQSGGSGQFADIIVRFEPMEAGTGYEFKSEIKGGAVPKEYIPGVMKGIEESLPNGVLAGYPVVDLRAVLVDGSYHDVDSSVLAFQIAARGAFREGLRKAGPRLLEPVMRVEVITPEEHLGDVIGDLNSRRGQVNSFGDKPGGLKVVDAFVPLAEMFQYVSTLRGMSKGRASYTMQLAKFDVVPQHIQNQLSAAKQEEAAA

SEQ ID NO: 12427 - protein, 599 aa, Pteridium aquilinum
MAQFASLIVLLGWSRNLRLYGDKLISMGFQEFASLTRWIGLVLTFFRTRDMIVSNLGAKPLVLQLPIGAEDTFKGVVDLVLMKAIVWSGEELGAKFEYVDIPEDLADLAADYRAQMIEVIVEQDDDAMEQYLEGVEPDIETMKKLIRKGTIALAFVPVLCGSAFKNKGVQPLLDAVVDYLPSPLDLPTMKGSAPDDPDTILERKPSDDEPFSGLAFKIMTDPFVGSLTFVRVYSGVLSGGSYIMNANKNKKERIGRLLEMHANSREDVKTARTGDIVALAGLKDTITGETLCDPDKPVVLERMDFPDPVIKVAIEPKTKADIDKMANGLIKLAQEDPSFHFSRDEESNQTVIEGMGELHLEIIVDRLKREFKVEANVGAPQVNYRESISRPVEIKYVHKKQSGGQGQFAEVVIKFEPLEAGSGYEFKSEIKGGTVPKEYIPGVVKGLEECMSNGVLAGFPVVDVKAILTDGSYHEVDSSVLAFQLAARGAFREGMNKAAPKLLEPIMKVEVVTPEDHLGDVIGDLNSRRGQINSFGDKPGGLKVVDALVPLSEMFQYVSTLRGMTKGRASYTMQLAKFDIVPQHIQNQISAKAQTAAAA

SEQ ID NO: 12428 - protein, 337 aa, Taxus baccata
MAETLKLAKCFSCTSLQNNNGLCHNHKGCTRTSKNRLVANSFHRLKSLAGFPLPSSSTTSIQGSKYNLSQFLHRTSLPKASRRMPIVCMAADGETGREVPLSDYRNIGIMAHIDAGKTTTTERILFYTGKNYKIGEVHEGTATMDWMEQEQERGITITSAATTAVWNKHRINIIDTPGHVDFTLEVERALRVLDGTICLFDSVAGVEPQSETVWRQADKYGVPRICFVNKMDRLGANFYRTRDMIVTNLGAKPLVLQIPIGVEDSFQGLVDLIKMKAVLWSGEELGAKFSYEDIPANLLDLATEYRNQMLETIVELDDEAMEKYLEGEELDEKQSRS

SEQ ID NO: 12429 - protein, 553 aa, Pennisetum glaucum
RTRDMIVANLGAKPLVIQLPIGSEDSFQGVVDLVRMKAIVWTGEELGAKFEYQDIPAELQEMAEDYRVQMLETIIELDDEVMEKYLEGTEPDEETVKKLIRKGTISASFVPVLCGSAFKNKGVQPLLDAVVDYLPSPLDLPAMKGTDPDDPEIVLERNPSDDEPFSGLAFKIMTDPFVGSLTFVRIYSGKLEAGSYVLNANKDKKERIGRLLEMHANSKEDITVAVTGDIVALAGLKDTITGETLCEPDKPVVLERMEFPDPVIKVAIEPKTKADADKMATGLIKLAQEDPSFHFSRDEETNQTVIEGMGELHLDIIVDRLKREFRVEANVGAPQVNYRESISKVAEVQYVHKKQSGGSGQFADIIVRFEPLEAGSGYEFKSEIKGGSVPKEYVPGVMKGLEESLPNGVLAGYPVVDFRAVLVDGSYHDVDSSVLAFQIAARGAFREGMRKAGPRLLEPIMRVEVVTPEDHLGDVIGDLNSRRGQVNSFGDKPGGLKVVDAFVPLAEMFQYVSTLRGMTKGRASYTMQLAKFDVVPQHIQNQLSAAKTEEAAA

SEQ ID NO: 12430 - protein, 274 aa, Arachis hypogaea
MAAGLIKLAQEDPSFHFSRDEEINQTVIEGMGELHLEIIVDRLKREFKVEANVGAPQVNYRESISKVSEVKYVHKKQSGGQGQFADITVRFEPMDPGSGYEFKSEIKGGAVPKEYIPGVIKGLEECMSNGVLAGFPVVDVRAVLVDGSYHDVDSSVLAFQLAARGAFREGMRKAGPRMLEPIMKVEVVTPEEHLGDVIGDLNSRRGQINSFGDKPGGLKIVDALVPLAEMFQYVSTLRGMTKGRASYTMQLAMFDVVPQHIQNQLATKEQEVAA

SEQ ID NO: 12431 - protein, 598 aa, Euonymus alatus
MALYVCLTVLPGVEPQSETVWRQADRYGVPRICFVNKMDRLGANFFRTRDTIVTNLGAKPLVLQLPIGSEATFQGVVDLVKMKAVIWSGEELGAKFSYEDIPADLQELAQDYRAQMIENIVEQDDEAMENYLEGVEPDEQTIKNLIRKGAIGGSFVPVLCGSAFKNKGVQPLLDAVVDYLPSPLDVPAMKGTDPENPEVTIERSADDDEPFAGLAFKIMSDTHVGSLTFVRVYAGKLSASSYVLNANKGKKERIGRLLEMHANSREDVKVALAGDIVAVQGLKDTITGETLCDPEHPIVLERMDFPDPVIKVSIEPKTKADIDKMAIGLIKLAQEDPSFHFSRDEEVNQTVIEGMGELHLEIIVDRLKREFRVEANVGAPQVNYRESISRVTEVKYVHKKQSGGQGQFADITVRFEPMEPGSGYEFKSEIKGGAVPKEYIPGVMKGLEECMSNGVLAGFPVVDVRAVLVDGSYHDVDSSVLAFQLAARGAFREGMRKAAPKMLEPVMKVEVVTPEEHLGDVIGDLNSRRGQINNFGDKPGGLKVVDSLVPLAEMFQYVSTLRGMTKGRASYTMQLAKFDVVPQHIQNQLASKEQEVAA

SEQ ID NO: 12432 - protein, 599 aa, Curcuma longa
LDGAICLFDSVAGVEPQSETVWRQADNYGVPRICFVNKMDRLGANFFRTRDMIISNLGAKPLVLQLPVGAEDRFQGIIDLLKMKAVIWTGEELGAKFTYEDIPADLQDIAQEYRSQMIETVVELDDETMERYLEGVEPDEATLKKLIRKGTVSSNFVPVLCGSAFKNKGVQPLLDAVVDYLPSPLELPPIKGTDADNPEVTIERLPKDDEPFAGLAFKIMNDSFVGSLTFVRVYSGKLAAGSYVLNANKGKKERIGRLLEMHANSREDVKVALTGDIVALAGLKDTITGETLCDPDNPVVLERMDFPDPVIKVAIEPKTKADVDKMATGLIKLAQEDPSFHFSRDEETNQTVIEGMGELHLDIIVDRLKREFKVEANVGAPQVNYRESISRISEVQYIHKKQSGGAGQFADITVRFEPLEPGSGYEFKSEIKGGAVPKEYIPGVMKGLEECMSNGVLAGYPVVDVRAVLVDGTYHDVDSSVLAFQLAARGAFRQGIRKANPRLLEPIMKVEVVTPEEHLGDVIGDLNSRRGQINNFGDKPGGLKVVDALVPLAEMFQYVSTLRGMTKGRASYTMQLANFDVVPQHIQNELSAKEEAATA

SEQ ID NO: 12433 - protein, 614 aa, Flaveria ramosissima
MWTSHLRWNVPLGFLMVPFACSIVLLVLNHSRKLCGDKQISMGCLEFVLLTKWTGLVLTFFRTRDMIVTNLGAKPLVLQLPIGAEDVFKGVIDLVRMKAIVWSGEELGAKFSYEDIPSDLQELSEEYRALMLETIVELDDEVMEGYLEGVEPDEQTVKKLIRKGTIGGSFVPVLCGSAFKNKGVQPLLDAVVDYLPSPLDLPPMKGTDPENPEIEIDRVASDDAPFAGLAFKIMNDPFVGSLTFVRIYAGKLAAGSYVMNANKGKKERIGRLLEMHANSREDVKVALAGDIVALAGLKDTITGETLCDPEKPIVLERMDFPDPVIKVAIEPKTKADVDKMANGLIKLAQEDPSFHFSRDEEINQTVIEGMGELHLEIIVDRLKREFKVEANVGAPQVNYRESISKVSEVKYVHKKQSGGQGQFADITVRFEPLEAGSGYEFKSEIKGGAVPREYIPGVMKGLEESMTNGVLAGFPVVDLRAVLTDGSYHDVDSSVLAFQLAARGAFREGVRKAGPKILEPIMRVEVVTPEEHLGDVIGDLNSRRGQINSFGDKPGGLKVVDSLVPLAEMFQYVSTLRGMTKGRASYTMQLAKFDVVPQHIQNQLSAAKEEAVAT

SEQ ID NO: 12434 - protein, 403 aa, Cynara scolymus
  misc_feature (123)..(123): Xaa can be any naturally occurring amino acid
  misc_feature (378)..(378): Xaa can be any naturally occurring amino acid
  misc_feature (394)..(394): Xaa can be any naturally occurring amino acid
MAAETCSLSSNTAASLCNFSGSNGGSSTMPLLLFLLSPATSLRRHHHQHRSLTSSFFGTQRLAPNKSISHFQKRNLSVFAMAAAPEDGKREVPLKDYRNIGIMAHIDAGKTTTTERVLFYTGXIQIGEVHEGTATMDWMEQEQERGITITSAATTTFWNKHRINIIDTPGHVDFTLEVERALRVLDGAICLFDSVAGVEPQSETVWRQADKYGVPRICFVNKMDRMGANFFRTRDMIISNLGAKPLVLQIPIGAEEVFKGVIDLVRMKAIVWSGEELGAKFSYEDIPSDLQDLAEEYRALMIETIVELDDEVMEGYLEGVEPDEETVKKLIRKGTIGGSFVPVLCGSAFKNKGVQPLLDAVVDYLPSPLDVPPMKGTXPENPEIEIARLPSDEXPFAGLAFRS

SEQ ID NO: 12435 - protein, 682 aa, Physcomitrella patens
MAHIDAGKTTTTERILFYTGKNYKIGEVHEGTATMDWMEQEQERGITITSAATTAKWKDHRINIIDTPGHVDFTLEVERALRVLDGAICLFDSVAGVEPQSETVWRQADKYGVPRICFVNKMDRLGANFFRTRDMIVSNLGAKPLVLQIPIGAEDQFLGIVDLVRMKAVVWNGEQLGAAFEDREIPEDLLELAEEYRALMIETIVDQDDAAMEAYLEGIEPDEETIKMMIRKGTISLSFVPVLCGSAFKNKGVQPLLDAVVAYLPSPLDLPPMKGCDVDNPDIPVDRKPSDDEPFSGLAFKIMNDSFVGSLTFVRIYSGTLAAGTYVLNSNKGKKERIGRLLEMHANSREDLKVARAGDIIALAGLKDTVTGETLCDSDKPVVLERMDFPDPVIKVAIEPKTKADVDRMSVGLIKLAQEDPSFHFSRDEETNQTVIEGMGELHLEIIVDRLKREFKVEANVGAPQVNYRESISKPATVKYTHKKQSGGQGQFAEIEVRFEPLEAGSGYEFKSEIKGGSVPREYVPGVVKGLEDMMNNGVLAGYPVVDVRAVLLDGSYHEVDSSVLAFQLAARGAFKEGISKAGPKLLEPIMKVEVVTPEEHMGDVIGNLNSRRGQIETLGDKPGGMKLITASVPLSEMFNYVSTLRGMTKGRAQYTMQLSKFDVVPTNIQMEITSKKMETTA

SEQ ID NO: 12436 - protein, 786 aa, Ceratodon purpureus
MAASMAQASHLGTSAVVQPCSCRDVEGTSRRSATSSVAAFAGLKNAKSVPLASSLGDSAAQRDALRRSAFGSASVTTGGRKAVVCMAAEEKREFPLQQYRNIGIMAHIDAGKTTTTERILFYTGRNYKIGEVHEGTATMDWMEQEQERGITITSAATTAKWKDHRINIIDTPGHVDFTLEVERALRVLDGAICLFDSVAGVEPQSETVWRQADKYCVPRICFVNKMDRLGANFFRTRDMIISNLGAKPLVLQIPIGAEDSFAGIIDLVRMKAVVWNGEELGAAFEDQDIPENLLELAEEYRATMIELVVEQDDEAMEAYLEGQEPDEATINRLIRKGTIALDFVPVLCGSAFKNKGVQPLLDAVIAYLPSPLDKPPMKGCDYENPDIAVDRKPGDNEPFSGLAFKIMNDSFVGSLTFVRVYSGTLSAGTYVMNSNKNKKERIGRLLEMHANSREDVKIARTGDIIALAGLKDTVTGETLCDPENPVVLERMDFPDPVIKVAIEPKTKADVDKMSMGLIKLAQEDPSFHFSRDEETNQTVIEGMGELHLDIIVDRLKREFKVEAEVGQPQVNYRESISKVSTVKYTHKKQSGGQGQFAEIEVKFEPLEAGSGYEFKSEIKGGSVPREYVPGVVKGLEECMSNGVLAGYPVVDVRAVLLDGSYHEVDSSVLAFQLAARGAFREGIAKAGPKLLEPIMKVEVVTPEDHMGDVIGDLNSRRGMINGFVDKPGGMKVVDALVPLSEMFKYIDTLRSMTKGRAQYTMQLAKFDVVPQNIQNKITAKNTSVAA

SEQ ID NO: 12437 - protein, 653 aa, Vitis vinifera
EGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVTNLGAKPLVIQLPIGAEDNFRGVIDLVKMQAVLWSGEELGAKFAYDDIPSDLLELAQDYRSQMIETIVELDDEAMEGYLEGVEPDEETIKKLIRKGTISASFVPVLCGSAFKNKGVQPLLDAVVDYLPSPLDLPAMKGTDPENPEVTVERAASDEEPFAGLAFKIMSDPFVGSLTFVRVYAGKLAAGSYVLNANKGKKERIGRLLEMHANSREDVKVALAGDIVALAGLKDTITGETLCDPENPIVLERMDFPDPVIKVAIEPKTKADVDKMASGLVKLAQEDPSFHFSRDEEINQTVIEGMGELHLEIIVDRLKREFKVEANVGAPQVNYRESISKVSEVKYVHKKQSGGQGQFADITVRFEPIEAGSGYEFKSEIKGGAVPKEYIPGVMKGLEECMSNGVLAGFPVVDVRAVLVDGSYHDVDSSVLAFQLAARGAFREGMRKAAPKMLEPIMKVEVVTPEEHLGDVIGDLNSRRGQINSFGDKPGGLKVVDALVPLAEMFQYVSTLRGMTKGRASYTMQLAKFEVVPQHIQNELAAKEQAVAA

SEQ ID NO: 12438 - protein, 788 aa, Selaginella moellendorffii
YWASVGISEAVMAMAEAAATLPAAKFPSCSSISSVAGNSQARLCCGARSRAPFVGLRGFPGLRFSGQNGAAKNARACNAARRGIVCMAASDTREFPLEDYRNIGIMAHIDAGKTTTTERILYYTGKNYKIGEVHEGNATMDWMEQERERGITITSAATTAVWKNHRINIIDTPGHVDFTLEVERALRVLDGAICLFDSVAGVEPQSETVWRQADKYGVPRICFVNKMDRMGANFFRTRDMIVSNLGAKPLVLQLPIGAEDTFKGVVDLITMKAILWSGEQLGAKFSYEEIPDNLAKDAKDYRAQLVELVVEQDDEVMEQYLEGVEPDEATIKRLIRQGTISNSFVPVLCGSAFKNKGVQPLLDAVIEFLPSPVELPSIKGTDMDDPEVVLERKPCDKEPFSGLAFKVMTDPFVGALTFMRVYSGVLTAGSYALNANKNKKERIGRLLQMHANSREDVKVAVTGDIVALAGLKDTITGETLCDPEKPVILERMDFPDPVIKVAIEPKTKADVDKMSTGLIKLAQEDPSFHFSRDDETNQTVIEGMGELHLEIIVDRLKREFKVEANVGAPQVNYRESISKPTEVKYVHKKQSGGQGQFAEVVIKFEPLEPGSGYEFKSEIKGGTVPKEYVPGVVKGLEDSISNGILAGYPVVDFRATLVDGSYHDVDSSILAFQLAARGAFREGIPKAGPKLLEPVMKVEVVTPEEHMGDVIGDLNSRRGQINSLGEKPGGLKVVDAFVPLAEMFQYVSNLRGMTKGRASYSMQLSKFEIVPQHVQTQITSKAQTVAAA

SEQ ID NO: 12439 - protein, 566 aa, Flaveria ramosissima
ATTTFWNNHRINIIDTPGHVDFTLEVERALRVLDGAICLFDSVAGVEPQSETVWRQADKYGVPRICFVNKMDRLGANFFRTRDMIVTNLGAKPLVLQLPIGAEDVFKGVIDLVRMKAIVWSGEELGAKFSYEDIPSDLQELSEEYRALMLETIVELDDEVMEGYLEGVEPDEQTVKKLVRKGTIGGSFVPVLCGSAFKNKGVQPLLDAVVDYLPSPLDLPPMKGTDPENPEIEIDRVASDDAPFAGLAFKIMNDPFVGSLTFVRIYAGKLAAGSYVMNANKGKKERIGRLLEMHANSREDVKVALAGDIVALAGLKDTITGETLCDPEKPIVLERMDFPDPVIKVAIEPKTKADVDKMANGLIKLAQEDPSFHFSRDEEINQTVIEGMGELHLEIIVDRLKREFKVEANVGAPQVNYRESISKVSEVKYVHKKQSGGQGQFADITVRFEPLEAGSGYEFKSEIKGGAVPREYIPGVMKGLEESMTNGVLAGFPVVDLRAVLTDGSYHDVDSSVLAFQLAARGAFREGVRKAGPKILEPIMRVEVVTPEEHLGDVIGDLNSRRGQIN

SEQ ID NO: 12440 - protein, 687 aa, Selaginella moellendorffii
NIGIMAHIDAGKTTTTERILYYTGKNYKIGEVHEGNATMDWMEQERERGITITSAATTAVWKNHRINIIDTPGHVDFTLEVERALRVLDGAICLFDSVAGVEPQSETVWRQADKYGVPRICFVNKMDRMGANFFRTRDMIVSNLGAKPLVLQLPIGAEDTFKGVVDLITMKAILWSGEQLGAKFSYEEIPDNLAKDAKDYRAQLVELVVEQDGEVMEQYLEGVEPDEATIKRLIRQGTISNSFVPVLCGSAFKNKGVQPLLDAVIEFLPSPVELPSIKGTDMDDPEVVLERKPCDKEPFSGLAFKVMTDPFVGALTFMRVYSGVLTAGSYALNANKNKKERIGRLLQMHANSREDVKVAVTGDIVALAGLKDTITGETLCDPEKPVILERMDFPDPVIKVAIEPKTKADVDKMSTGLIKLAQEDPSFHFSRDDETNQTVIEGMGELHLEIIVDRLKREFKVEANVGAPQVNYRESISKPTEVKYVHKKQSGGQGQFAEVVIKFEPLEPGSGYEFKSEIKGGTVPKEYVPGVVKGLEDSISNGILAGYPVVDFRATLVDGSYHDVDSSILAFQLAARGAFREGIPKAGPKLLEPVMKVEVVTPEEHMGDVIGDLNSRRGQINSLGEKPGGLKVVDAFVPLAEMFQYVSNLRGMTKGRASYSMQLSKFEIVPQHVQTQITSKAQTVAAA

SEQ ID NO: 12441 - protein, 479 aa, Citrus sinensis
IVELDDEAMESYLEGNEPDEETIKKLIRKGTIAGSFVPVLCGSAFKNKGVQPLLDAVVDYLPSPLDLPAMKGTDPENPEATLERAASDDEPFAGLAFKIMSDPFVGSLTFVRVYAGKLSAGSYVLNANKGKKERIGRLLEMHANSREDVKVALAGDIIALAGLKDTITGETLCDADHPILLERMDFPDPVIKVAIEPKTKADIDKMANGLIKLAQEDPSFHFSRDEEINQTVIEGMGELHLEIIVDRLKREFKVEANVGAPQVNYRESISKVSEVKYVHKKQSGGQGQFADITVRFEPMEAGSGYEFKSEIKGGAVPKEYIPGVMKGLEECMSNGVLAGFPVVDVRAALVDGSYHDVDSSVLAFQLAARGAFREGMRKAGPKMLEPIMKVEVVTPEEHLGDVIGDLNSRRGQINSFGDKPGGLKVVDALVPLAEMFQYVSTLRGMTKGRASYIMQLAKFDVVPQHIQNQLAAKEQEVAA

SEQ ID NO: 12442 - protein, 120 aa, Gossypium hirsutum
MAAKPLTSEAIALTEKKMDMTLDDIIKMSKTSSNKTKKQRRVLNKGQKPFNNAAKAKALKVQQYMDSRSSVRQGFLAQRRSNIPGNQFPLAAEAARRAAVAPVRIKNVNGVRVANLNKPR

SEQ ID NO: 12443 - protein, 120 aa, Gossypium hirsutum
MAAKPLTSEAIALTEKKMDMTLDDIIKMSKTSSNKTKKQRRVLNKGPKPFNNAAKAKALKVRQYMDSRSSVRQGVLAQRRSNIPGNQFPLAAEAARRAAVAPVRIKNVNGVRVANLNKPR

SEQ ID NO: 12444 - protein, 205 aa, Theobroma cacao
MAAKPLTSEAIALTEKKMDMTLDDIIKMSKNSTKAKKQQRAPIKSQKPVNNAAKEKALKVQQYMDSRSSLRQGVLAQRRSNFQGNRFPLAAEAARRAAIAPIRVRAFNGSRVANMNKPRIGAPPVQRRAVNGGFAAKPHQQQQQQQQQQEQQGNVATKQRPQTLDSLFANMKEQRMRVLSRQHNTAQRNGGGRQRMPWGRGRFGN

SEQ ID NO: 12445 - protein, 796 aa, Lotus japonicus
FFLEIFKVETRSHVHETRKQKAESKSHDAEHSPKKAKLETEDGQTNGKSATDVLEEYDEFCKATKEHLTSEQMKEILEANGLDSSGSNIEITRRCQDLMFFGALEKCSVCNGNLEFDGRRYACKGFYSEWCSCTFSTRDPPRKEEPIKLPDSVQNSLVSDLLKKYQDPSQRPQRDLSSVLDKPFTGMMISLMGRLSRTHVRTTCNRATCLVASPAERDRGGTSKLAEAMERGIPVVREGWLTDSMEKQEPQPLEAYDLVSDLSVAGKGIPWDKQDPGEEAIESLSAELKLSGKRGVYKDSKLQDQGGKIFERDGILYNCAFSVCDQGRELNDYCVMQLIMVPENRLHLYFKKGRVGDDPKAEERVEEHENVDNAVKEFVRLFEEITGNEFESWEREKKFQKKPLKFYPIDMDDGVEVRHGALGLRQLGIAATHCKLEPMVANFMKVLCSQGIYKYALMEMGYDSPDLPIGMVTNLHLKRCEEVLLEFIEKVKSLKETGPKAEAVWSDFSQRWFTLMHSTRPFIFRDYQEIADHAAAALESVRDITLASHLIGDMSGSTIDDPLSDTYSKLGCSISPLEKNSDDYEMIVKYLEKTYEPVKVGDCEYGVSVENIFAVEPSAGPSYEDIVKMPNKVLLWCGSRSSNLLRHLHKGFLPAICSLPVPGYMFGKAIVCSDAAAEAARYGFTAVDRPEGFLVLAIASLGNEITELKSPPEDTTPLEEKKLGVKGLGKKKTDESEHFVWKDDIKVPCGRIIPSEHEDSPLEYNEYAVYDPKQVRISYLVGVKYEEKGTVMDTAE

SEQ ID NO: 12446 - protein, 388 aa, Glycine max
MLGTALQFGGVRGDDRFYIPVKTRKSQNQRKQSHRAKNNEPENTDLVSKSKIDISEDNNSNSDSNLNQSLKPTLSPSVESVSNIDRFLESTTPSVPAQYFSKTTMRGWKFCDVEYQSYFALSDLWESFKEWSAYGAGVPLVLDQSDSVVQYYVPYLSAIQLYAHSAEKATAKPRYTGEDSDGDYYRDSCSEGSSDYEYGKRTEFMTQRSSQYLTGVLCKKDFLVMIVKLGILKIYFLSILNKILRIVIQDLARHYPALKSLRSCDLLPVSWVFWARYPIYRIPTGPTLKDLDGCFLTYHTLHTPLTGSGRTHAPTLVYPSEMDGVPKISIPTFAMASYKLKGSIWMKKGVSESQQVSSLLQAADNWLRLVQVNHPDFQFFKSHGTYHR

SEQ ID NO: 12447 - protein, 192 aa, Medicago truncatula
MLHDRRSYEMNFDDYQCACRIPKRKGACFRDLPCARMQNKKVELNPDVKREFLASGNPLVPNYAITFVCGTSPLPFARIWWDKTVPTVVTRAEPHNQKILHPEQDRVLSIRGNARLQGFPDFYKLCGSSKERYIQVGNAVAVPVGRALRYCLGLASQGASADGPLYTLPDQFPREKEEPSIVPSEEVVNNAP

SEQ ID NO: 12448 - protein, 82 aa, Medicago truncatula
KTRSRSNSDEDEVLQARCHYTEAKVDGGVIYKLYDDAHVKGEKDDYHFICKIMEMFEAVDGELYFTAQWYYRSNDTTTRKSH

SEQ ID NO: 12449 - protein, 531 aa, Medicago truncatula
FCYYETGSKQALISLSDKKDLAFVGNGLQELGFTIVSTGGTASALESAGVAVTKVEQLTQFPEMLDGRVKTLHPNIHGGILARRDQKHHIEALSTHGIGTFDVVVVNLYPFYDKVTSTGGIEFEDGIENIDIGGPAMIRAAAKNHKDVLVVVDSEDYPALLEFLKGNEDEQFRLKLAWKAFQHVASYDSAVSEWLWKQSVGDKFPPSLTVPLSLKSSLRYGENPHQKAAFYVDKRLAEVNAGGIATAIQHHGKEMSYNNYLDADAAWNCVCEFRNPTCVVVKHTNPCGVASRDDILEAYRLAVKADPVSAFGGIVAFNVEVDEVLAKEIREFRSPTDGETRMFYEIVVAPSYTEKGLEILRGKSKTLRILEAKKNEAGKLSLRQVGGGWLAQDSDDLTPSDIKFNVVSEKTPQDGELRDAEFAWLCVKHVKSNAIVIAKDNCMLGMGSGQPNRVESLRIAMRKAGADVKGAALASDAFFPFAWKDAVEEACESGIGVIAEPGGSIRDQDAVDCCNKYGVSLLFTNVRHFRH

SEQ ID NO: 12450 - protein, 545 aa, Cajanus cajan
MTEIDTITVSKTASASSSPGTKQALISLSNKKDLAFVGNGLQELGYTIVSTGGTASALESAGVAVTKVEQLTQFPEMLDGRVKTLHPNIHGGILARRDQKHHIEALSTHGIGTFDVVVVNLYPFYDTVTSAGGVEFEDGIENIDIGGPAMIRAAAKNHKDVLVVVDTEDYPALLEFLKGNQEDQKFRLKLAWKAFQHVASYDSAVSEWLWKQSVGDKFPPSLTVPLSLKSSLRYGENPHQKAAFYVDKSLSEVNTGGIATAIQHHGKEMSYNNYLDADAAWNCVCEFRNPTCVVVKHTNPCGVASRDDILEAYRLAVKADPVSAFGGIVAFNVEIDEALAKEIREFRSPTDGETRMFYEIVVAPSYTEKGLEVLRGKSKTLRILEAKKNEAGKLSLRQVGGGWLAQDSDDLTPHDIKFNVVSDKAPQDNELRDAEFAWLCVKHVKSNAIVIAKNNCMLGMGSGQPNRVESLRIAIRKAGDDVKGAALASDAFFPFAWKDAVEEACESGIGVIAEPGGSIRDQDAIDCCNKYGVSLLFTNVRHFRH

SEQ ID NO: 12451 - protein, 544 aa, Glycine max
MAEIDTISVSKSASSSAPGSKQALISLSDKKGLAFVGNGLQELGYSIVSTGGTASALESAGVAVTKVEQLTKFPEMLDGRVKTLHPNIHGGILARRDQKHHIEALSTHGIGTFDVVVVNLYPFYDKVTSAGGIEFEDGIENVDIGGPAMIRAAAKNHKDVLIVVDTEDYPALLEFLKGNQDDIKFRLKLAWKAFQHVASYDSAVSEWLWKQSVGDKFPPSLTVPLSLKSPLRYGENPHQKAAFYVDKSLSEVNAGGIATAIQHHGKEMSYNNYLDADAAWNCVCEFRKPTCVVVKHTNPCGVASRDDILEAYRLAVKADPVSAFGGIVAFNVEIDEALAKEIREFRSPTDGETRMFYEIVVAPSYTEKGLEILCGKSKTLRILEAKKNEAGKLSLRQVGGGWLAQDSDDLTPQDIKFNVVSEKAPQDDELCDAEFAWLCVKHVKSNAIVIAKNNCMLGMGSGQPNRVESLRIAIRKAGDDVKGAALVSDAFFPFAWKDAVEEACESGIGVIAEPGGSIRDQDAIDCCNKYGVSLLFTNVRHFRH

SEQ ID NO: 12452 - protein, 545 aa, Theobroma cacao
MADSQTLAVPKHDPQSSAPGNKQALISLSDKKDLAFLGNGLQELGYTIVSTGGTASALENSGVSVTKVEQLTCFPEMLDGRVKTLHPNIHGGILARRDQKHHMEALNEHGIGTFDVVVVNLYPFYDKVTSTGGIEFDDGIENIDIGGPAMIRAAAKNHKDVLVVVDSQDYPALLEYLKGSQVDQQFRRKLAWKAFEHVASYDSAVSEWLWKQTVGDKFPPNLTVPLSLKSLLRYGENPHQNAAFYIDKSLSEVNAGGIATAIQHHGKEMSYNNYLDADAAWNCVSEFRNPTCVVVKHTNPCGVASRDDILEAYRLAVKADPVSAFGGIVAFNIEVDEALAKEIREFRSPTDGETRMFYEIVVAPKYTEKGLEILRGKSKTLRILEAKKNEKGKLSLRQVGGGWLAQDSDDLTPQDIQFNIVSEKKPQDSELRDAEFAWLCVKHVKSNAIVVAKDNRMLGMGSGQPNRLESLRIALRKAGDEVKGAALASDAFFPFAWKDAVEEACESGIGVIAEPGGSIRDGDAVDCCNKYGVSLVFTNVRHFRH

SEQ ID NO: 12453 - protein, 543 aa, Gossypium hirsutum
MSHPQTLDAPHPQSSAAGNKQALISLSDKKDLALLSNGLHELGYTIVSTGGTASALENAGVSVTKVEQLTCFPEMLDGRVKTLHPNIHGGILARRDQKHHMEALNKHGIGTFDVVVVNLYPFYDKVTSTGGIAFDDGIENIDIGGPAMIRAAAKNHKDVLVVVDSQDYPALLEFLKGSQDDQQFRRNLAWKAFEHVASYDSAVSEWLWKQTGGDKFPPKLTVPLSLKSSLRYGENPHQKAAFYVDKSLSEVNAGGIATAIQHHGKEMSYNNYLDADAAWNCVSEFRNPTCVIVKHTNPCGVASGDDILEAYRLAVKADPVSAFGGIVAFNIEVDDALAKEIREFRSPTDGETRMFYEIVVAPKYTEKGLEILCGKSKTLRILEAKKNEKGKLSLRQVGGGWLAQDSDDLTPQDIQFNVVSEKKPQDNELRDAEFAWLCVKHVKSNAIVIAKDNRMLGMGSGQPNRLESLRIALRKAGDEVKGAALASDAFFPFAWKDAVEEACESGIGVIAEPGGSIRDGDAVDCCNKYGVSLLFTKVRHFRH

SEQ ID NO: 12454 - protein, 617 aa, Ricinus communis
MFGLTATLSTATAAASATNSLPSRTPCTGLHHHRSTSSAVTAAVAGCTQSASIVCVQVHATSLRPSCSAVKAMADSQTLSVSKNQPQSPSSGNKQALISLSDKRDLALLGRGLQNLGYTIVSTGGTASSLESAGVSVTKVEQLTSFPEMLDGRVKTLHPNIHGGILARRDQKHHMEALNEHGIGTFDVVVVNLYPFYDKVTSSGQIDFEDGIENIDIGGPAMIRAAAKNHKDVLVVVDSEDYPALLDYLQGDQDDQQFRRNLAWKAFQHVASYDSAVSEWLWKQTVGDKFPPSLTVPLSLKSSLRYGENPHQKAAFYVDKSISEVNAGGIATAIQHHGKEMSYNNYLDADAAWNCVSEFKNPTCVVVKHTNPCGVASRDDILEAYRLAVKADPVSAFGGIVAFNIEVDEVLAKEIREFRSPTDGETRMFYEIVVAPKYTKKGLEVLRGKSKTLRILEAKKNEQGKLSLRQVGGGWLAQDSDDLTPQDIKFNFMSEKTPQESELNDAQFAWLCVKHVKSNAIVIAKNNCMLGMGSGQPNRLESLRIALKKAGDEVKGAALASDAFFPFAWNDAVEEACEAGVGVIAEPGGSIRDKDAIDCCNKYGVSLIFTNVRHFRH

SEQ ID NO: 12455 - protein, 396 aa, Chelidonium majus
MIRAAAKNHKDVLVVVDSEDYPEILEFLKGNQDDEQFRRKLAWKAFQHCASYDSAVSEWLWKQTVGDKFPPSLTVPLSLKSSLRYGENPHQKAAFYVDKSLSEVKAGGIATAIQHHGKEMSYNNYLDADAAWNCVSEFPNPTCVVVKHTNPCGVASRDDILEAYRLAVKADPVSAFGGIVAFNVEVDEALAKEIREFRSPTDGETRMFYEIVVAPKYSQKGLEILRGKSKTLRILEASKNGKGKLSLRQVGGGWLAQDSDDLTPQDIEFSVVSKKTPKENELHDAEFAWLCVKHVKSNAIVIAKNNCMLGMGSGQPNRLESLRIAFRKAGEEAKGAALASDAFFPFAWKDAVEEACENGIGVIAEPGGSIRDSDAIDCCNKYGVSLLFTNVRHFRH

SEQ ID NO: 12456 - protein, 469 aa, Euphorbia peplus
MLDGRVKTLHPNIHGGILARRDQKHHMEALNEHGIGTFDVVVVNLYPFYDKVTSTGGIEFEDGIENIDIGGPAMIRAAAKNHKDVLVVVDSQDYPELLEYLKGDQDDQQFRRKLAWKAFQHVASYDAAVSEWLWKQTVGDKFPPSLTVPLELKSSLRYGENPHQKAAFYVDKSISEVNAGGIATAIQHHGKEMSYNNYLDADAAWNCVSEFKNPTCVVVKHTNPCGVASGDDILEAYRLAVKADPVSAFGGIVAFNIEVDEVLAKEIREFRSPTDGETRMFYEIVVAPKYTKKGLEILRGKSKTLRILEAKKNEQGKLSLRQVGGGWLAQESDDLTPEDIQFNVMSEKTPLESELHDAEFAWLCVKHVKSNAIVIAKNNCMLGMGSGQPNRVESLRLALKKAGDEVKGAALASDAFFPFAWNDAVEEACQAGIGAIAEPGGSIRDKDAIDCCNKYGVSLLFTNVRHFRH

SEQ ID NO: 12457 - protein, 596 aa, Fragaria vesca
MLLRLSATPPATTTPNTSLFLLFSTNLPITHSSSSSFSPCSLRNSSGLHTSCRPLKAMAAQEAQSSASASGDRQALISLSNKNNLAFLGNGLQSLGYKIVSTGGTASALESAGVSVTKVEELTCFPEMLDGRVKTLHPNIHGGILARRDQKHHMEALSNHGIGIFDVVVVNLYPFYDKVTSTGGIEFEDGIENIDIGGPAMIRAAAKNHKDVLVVVDSEDYPTLLEYLKADKFDQQFRRKLAWKAFQHVASYDSAVSEWLWRQTSEDKFPPSITVPLSLKSPLRYGENPHQKAAFYVDKSLSEVNAGGIATAIQHHGKEMSYNNYLDADAAWNCVSEFRGPTCVVVKHTNPCGVASRDDILEAYRLAVKADPVSAFGGIVAFNIEVDEALAKEIREFRSPTDGETRMFYEIVVAPKYSKKGLEILRGKSKTLRILEASKNEKGKLSLRQVGGGWLAQDSDDLTPQDIQFTVVSKKSPQESELSDAEFAWLCVKHVKSNAIVLAKNNCMLGMGSGQPNRLESLRIALKKAGEEVKGAALASDAFFPFAWKDAVEEACESGVGVIAEPGGSIRDGDAIDCCNKYGVSLVFTNVRHFRH

SEQ ID NO: 12458 - protein, 597 aa, Fragaria vesca
MLLHLSAAPPASTTPNTSLFLLFSTNLLITHSSSSFSPCSLRNSSGLHTSCRPLKAMAAQEAQFSTSASASGDRQALISLSDKNNLAFLGNGLQSLGYKIVSTGGTASALESAGVSVTKVEELTCFPEMLDGRVKTLHPNIHGGILARRDQKHHMEALSNHGIGIFDVVVVNLYPFYDKVTSTGGIEFEDGIENIDIGGPAMIRAAAKNHKDVLVVVDSEDYPTLLEYLKVDKDDQQFRRKLAWKAFQHVASYDSAVSEWLWRQTSEDKFPPSLTVPLSLKSPLRYGENPHQKAAFYVDKSLSEVNAGGIATAIQHHGKEMSYNNYLDADAAWNCVSEFRGPTCVVVKHTNPCGVASRDDILEAYRLAVKADPVSAFGGIVAFNIEVDEALAKEIREFRSPTDGETRMFYEIVVAPKYSKKGLEILRGKSKTLRILEASKNEKGKLSLRQVGGGWLAQDSDDLTPQDIQFNVVSKKSPQESELSDAEFAWLCVKHVKSNAIVLAKNNCMLGMGSGQPNRRESLRIALKKAGEEVKGASLASDAFFPFAWKDAVEEACESGVSVIAEPGGSIRDGDAIDCCNKYGVSLVFTNMRHFRH

SEQ ID NO: 12459 - protein, 467 aa, Catharanthus roseus
MLGFTAAITTSSSASPNAATAFAATPISRAASAALHIYTRTATFSSSVQQYSTAYPGRLICFPIKAMAETEVLSTPKLDSKVSGRKHALISLSDKSDLAFLGKGLQELGYTIVSTGGTASALESVGVPVTKVEELTCFPEMLDGRVKTLHPNIHGGILARRDQEHHMKALNEHGIGTFDIVVVNLYPFYNKVSSSSGISFEDGIENIDIGGPAMIRAAAKNHKDVLVVVDSGDYPGLLEFLRGKEDDLLFRRKLAWKAFHHVASYDSAVSEWLWKQTAGDKFPPGLTVPLSLKSSLRYGENPHQKAAFYVDKSLAEVNAGGIATSIQHHGKEMSYNNYLDADAAWNCVCEFSKPTCVVVKHTNPCGVASRDDIIEAYRLAVKADPVSAFGGIVAFNVEVDEALAKDIREFRSPTDNETRMFYEIVVAPKYTAKGLEVLRGKSKTLRILEAKKNSKGSSHSGKLVEVG

SEQ ID NO: 12460 - protein, 617 aa, Quercus alba
MFGVGAAAPTSTAAPTTTAHTRLHSINATSSSNPFISALIGCGRVQFCSLRLNCGGPIKAMADTNTSTDTISVPNSASHPSASGNKQALISLSDKKDLAFLGKGLQELGYTIVSTGGTASTLESAGVSVTKVEQLTSFPEMLDGRVKTLHPSIHGGILARRDQKHHMDDLNKHGIATFDVVVVNLYPFYNKVTSTGGIEFEDGIENIDIGGPAMIRAAAKNNKDVLVVVDPQDYPLLLEFLKGGGDDQLFRRRLAWKAFQHVASYDSAVAEWLWKQTSGISTSSADDDKFPPSLTVPLERASSLRYGENPHQKAAFYVDKRLAEVNAGGIATAIQHHGKSMSYNNYLDADAAWNCVSEFKNPTCVVVKHTNPCGVASRDDILEAYRLAVKADPVSAFGGIVAFNVEIDEALAKEIREFRSPTDGETRMFYEIVVAPKYTEKGLEILQKKSKSLRILEAQKNEKGKLSLRQVGGGWLAQDSDDLTPQDIQFNLVSEKAPQESELRDAEFAWLCVKHVKSNAIVIAKNNCMLGMGSGQPNRVESLRIALKKAGDEVKGAALASDAFFPFAWKDAVEIACENGVSVIAEPGGSIRDADAIDCCNKYGVSLLFTNVRHFRH

SEQ ID NO: 12461 - protein, 419 aa, Prunus persica
MLGLGLAVGPAAPAATTPNTNLLLLSSNKQIQTNFSSSSFLTSCSVRNAHLLHSSCRTIKAMAAEDTFTVTTHDSKSPASGNGLALISLSDKKDLAFLGNGLQDLGYKIVSTGGTASALESAGLSVTKVEQITSFPEMLDGRVKTLHPNVHGGILARRDQKHHMEALSKHGIGTFDVVVVNLYPFYEKVTSTGGIEFEDGVENIDIGGPAMIRAAAKNHKDVLVVVDSEDYPALLEYLTGDKVDQQFRRKLAWKAFQHVASYDSAVSEWLWKQTTEDKFPPSLTVPILLKSPLRYGENPHQKAAFYVDKSLSEVNAGGIATAIQHHGKEMSYNNYLDADAAWNCVSEFRNPTCVVVKHTNPCGVASRDDILEAYTLAVKADPVSAFGGIVAFNIEVDEALAKEIREFRSPTDGETRDVL

SEQ ID NO: 12462 - protein, 545 aa, Manihot esculenta
MAESHTLSVPNNEPQTSASGNKQALISLSDKKDLAFLGNGLQNLGYTIVSTGGTASALESVGVSVTKVEQLTCFPEMLDGRVKTLHPTIHGGILARRDQKHHMEALNKHGIGTFDVVVVNLYPFYDKVTSTGQIEFDDGIENIDIGGPAMIRAAAKNHKDVLVVVDSQDYAALLDFLKGNQDDQQFRRKLAWKAFQHVASYDSAVSEWLWKHTVGDKFPPSLTVPLSLKSSLRYGENPHQKAAFYVDKSISEVNAGGIATAIQHHGKEMSYNNYLDADAAWNCVSEFKNPTCVIVKHTNPCGVASRDDILEAYRLAVKADPVSAFGGIVAFNIEIDEALAKEIREFRSPTDGETRMFYEIVVAPKYTKKGLEILKGKSKTLRILEAKKNEQGKLSLRQVGGGWLAQDSDDLTPQDIQFSVMSEKTPQENEFCDAKFAWLCVKHVKSNAIVIAKNNCMLGMGSGQPNRLESLRIALKKAGDEVKGAALASDAFFPFAWNDAVEEACEAGIGVIAEPGGSIRDNDAIDCCNKRGVSLLFTNVRHFRH

SEQ ID NO: 12463 - protein, 532 aa, Cucumis sativus
LLLCSSGKKLALISLSDKKNLAFLGNGLQELGYTIVSTGGTASTLESSGVHVTKVEEVTCFPEMLDGRVKTLHPSIHGGILARRDQGHHMDALKKHGIGTFDVVVVNLYPFYEKVTSSQEINFEDGIENIDIGGPAMIRAAAKNHKDVLVVVDTEDYPALLEFLKGSEDDQQFRRKLAWKAFQHVASYDSAVSEWLWKQTVGDKFPPSFTVPLALKSSLRYGENPHQKAAFYVDKSLSEVNAGGIATAVQHHGKEMSYNNYLDADAAWNCVSEFSNPTCVIVKHTNPCGVASRDDILEAYRLAVKADPVSAFGGIVAFNIEVDETLARELREFRSPTDGETRMFYEIVVAPKYTEKGLEILRGKSKTLRILEAGKNEKGKLSLRQVGGGWLAQDSDDLVPQDIKFNVVSGKAPQENELRDAEFAWLCVKHVKSNAIVIAKNNCMLGMGSGQPNRLESLRIALRKAGDEVKGAALASDAFFPFAWNDAVEEACQSGVGIIAEPGGSIRDPDAIDCCNKYGVSLVFTNVRHFRH

SEQ ID NO: 12464 - protein, 148 aa, Vinca minor
SSTPISCAASNSSSLRAYTTGTSTFSSSVHQLSTAAPLRLICFPIKAMAAESEVIATSNLDSNVSGRKQALISLSDKCDLAYLGRGLQELGYTIVSTGGTASALESAGVFVTKVEELTCFPEMLDGRVKTLHPNVHGVFLLGEIKSIT

SEQ ID NO: 12465 - protein, 626 aa, Nicotiana tabacum
TTEWNRKLHIIHTTMLGLTRATTSASASASATAAATSATAIAAATVHLCTPQLRTIRTRTSFCFGQQQSSKTSHRVMVYPVKAMAETAAAPHSAPKSSTSGRKQALISLSDKTDLAKLGNGLQELGYTIVSTGGTSSALEGAGVSVTKVEELTRFPEMLDGRVKTLHPSVHGGILARRDQEHHMEALEKHEIGTFDVVVVNLYPFYAKVSSSSGISFEDGIENIDIGGPAMIRAAAKNHRDVLVVVDSEDYPALLEFLRGDNDDQQFRRKLAWKAFQHVASYDSAVSEWLWKQTVGDKFPPGLTVPLHLKSLLRYGENPHQKAAVYVDKSLSEVNAGGIATVIQHHGKEMSYNNYLDADAAWNCVCEFNKPTCVVVKHTNPCGVASRNDIIEAYRLAVKADPVSAFGGIVAFNVEVDEALAKDIREFRSPTDGETRMFYEIVVAPKYTEKGLEVLRGKSKTLRILEASKNSKGKLSLRQIGGGWLAQDSDDLTPEDIQFNVMSDKTPQENELNDAQFAWLCVKHVKSNAIVIAKNNCMLGMGSGQPNRLESLRIAMRKAGDEVKGAALASDAFFPFAWNDAVEEACQSGVSVIAEPGGSIRDKDAVDCCNKYGVSLVFTNVRHFRH

SEQ ID NO: 12466 - protein, 548 aa, Citrus clementina
MAHSHTVSVPTNQPPSSSSSQANKQALISLSDKKDLASLGIGLQELGYTIVSTGGTATSLENDGVSVTKVEQLTCFPEMLDGRVKTLHPNIHGGILARRDQKHHMDALSEHGIGTFDLVVVNLYPFYDKVTSAGGIDFEDGIENIDIGGPAMIRAAAKNHKDVLVVVDSEDYPALLEFLKGNQDDQQFRRKLAWKAFQHVASYDSAVSEWLWKQTAGEDKFPPSVTVPLELKSSLRYGENPHQKAAFYVDKSLAEVNAGGIATAIQHHGKEMSYNNYLDADAAWNCVSEFKNPTCVIVKHTNPCGVASRDDILEAYKLAVKADPVSAFGGIVAFNVEVDEALATELREYRSPTDGETRMFYEIVVAPSYTEEGLEILRGKSKNLRILETKKNEKGKLSLRQVGGGWLAQDSDDLTPEDIQFKVVSEKKPQESELHDAEFAWLCVKHVKSNAIVIAKNNCMLGMGSGQPNRRESLRIAMKKAGDEVKGAALASDAFFPFAWKDAVEEACENGIGVIAEPGGSIRDGDAIDCCNKYGVALLLTSVRHFRH

SEQ ID NO: 12467 - protein, 534 aa, Cannabis sativa
RIFYGPLSGNKQALISLSDKRDLTLLGDGLQKLGYTIVSTGGTASALETAGVSVTKVEQLTRFPEMLDGRVKTLHPNIHGGILARRDEKHHMEALNEHGIGVFDIVVVNLYPFYDTVTSTKEIEFEDGIENIDIGGPAMIRAAAKNHKDVLVVVDSQDYPALLEFLKGNQDNQQFRRELAWKAFQHVASYDSAVAEWLWKQTNGGKFPPNITVPMTLKSSLRYGENPHQKAAFYADKSLSEVDGGGIATAIQHHGKEMSYNNYLDADAAWNCVAEFKKPTCVVVKHTNPCGVASRDDILEAYRLAVKADPVSAFGGIVAFNIEVDEALAKEIREFRSPTGGETRMFYEIVVAPKYTKKGLEILRGKSKTLRILEARNNKKGKLSLRQVGGGWLAQDTDDLTPEDIQFKVMSEKAPEESELRDAEFAWLCAKHVKSNAIVIAKNNCMLGMGSGQPNRRESLRIALKKAGDEVKGAALASDAFFPFAWKDAVEEACENGIGVIAEPGGSIRDGDAIDCCNKYGVSLVFTNVRHFRH

SEQ ID NO: 12468 - protein, 615 aa, Eucalyptus grandis
MLGSPTAPTSSSAAAAAAAAVAAAFRSSLLHSTTTHRTRTCPSTSHQVPVACVRLQSCSSSRAAPPIKAMAAEAEILSAPDKELRPSAPRSKQALISLSDKTDLAFLGKGLQELGYTVVSTGGTASALENAGLSVSKVEQLTCFPEMLDGRVKTLHPHIHGGILARRDQQHHMEALDKHGIGTFDVVVVNLYPFYDKVTSAADIEFEDGIENVDIGGPAMIRAAAKNHKDVLVVVDSHDYPALLEFLKSNGDDQQFRRKLAWKAFQHVASYDSAVSEWLWRQTTGEKFPPSLTVPLSLKSSLRYGENPHQKAAFYVDKSLAEVNGGGIATAIQHHGKEMSYNNYLDADAAWNCVSEFSDPTCVVVKHTNPCGVASRGDILEAYRLAVKADPVSAFGGIVAFNVEIDENLAREIREFRSPTDGETRMFYEIVVAPKYSKKGLEVLRGKSKTLRILEAKKNEKGKLSLRQVGGGWLAQDSDDLTPADIQFNAVSGTTPQESELEDAKLAWLCVKHVKSNAIVIVKNKCMLGMGSGQPNRLESLRIAMRKSGEEVKGAALASDAFFPFAWNDAVEEACQSGIAVIAEPGGSIRDQDAIECCNKYGISLVFTNVRHFRH

SEQ ID NO: 12469 - protein, 545 aa, Eutrema halophilum
MAESQTAPRNPPHSSSSSGKKQALISLSDKKDLASLGNGLQELGYTIVSTGGTASTLENAGVSVTKVETLTHFPEMLDGRVKTLHPNIHGGILARRDVEHHMEALNEHGIGTFDVVVVNLYPFYSKVTAPGGISFEDGIENIDIGGPAMIRAAAKNHKDVLIVVDSEDYQAVLEYLKGGQSDQQFRRKLAWKAFQHVAAYDSAVSEWLWKQTEGKEKFPPSFTVPLSLKSSLRYGENPHQKAAFYVDKSLAEVNAGGIATAIQHHGKEMSYNNYLDADAAWNCVSEFENPTCVVVKHTNPCGVASRDDILEAYRLAVKADPVSAFGGIVAFNVEVDEVLAREIREFRSPTDGETRMFYEIVVAPKYTAKGLEVLKGKSKTLRILEAKKNDQGKLSLRQVGGGWLAQDSDDITPEDISFSSVSEKTPTESEFADAKFAWLCVKHVKSNAIVIAKNNCMLGMGSGQPNRVESLRIAFRKAGEEAKGAALASDAFFPFAWKDAVEEACEKGIGVIAEPGGSIRDQDAIDCCKKYGVSLLFTNVRHFRH

SEQ ID NO: 12470 - protein, 235 aa, Cirsium arvense
SYSSRLSCYRSKATAEAAESMAGSIASPSGSKQALISLSDKKDLDILGTGLQELGYTIVSTGGTAYALEKAGVPVTKVEELTQFPEMLDGRVKTLHPNIHGGILARRDQSHHLAALDKHNISTFEVVVVNLYPFYAKVTSTDGITFDDGIENIDIGGPTMIRAAAKNHKDVLVVVDSQDYPMLLESSKETRMTNNLEGSWRGKLSNTLLLMILLFLSGCGSRLKEVNFHQALQFH

SEQ ID NO: 12471 - protein, 548 aa, Citrus sinensis
MAHSHTVSVPTNQPQSSSSSQANKQALISLSDKKDLASLGIGLQELGYTIVSTGGTATSLENAGVSVTKVEQLTCFPEMLDGRVKTLHPNIHGGILARRDQKHHMDALSEHGIGTFDLVVVNLYPFYDKVTSAGGIDFEDGIENIDIGGPAMIRAAAKNHKDVLVVVGSEDYPALLEFLKGNQDDQQFRRKLAWKAFQHVASYDSAVSEWLWKQIAEEDKFPPSFTVPLELKSSLRYGENPHQKAAFYVDKSLAEVNAGGIATAIQHHGKEMSYNNYLDADAAWNCVSEFKNPTCVIVKHTNPCGVASRDDILEAYKLAVKADPVSAFGGIVAFNVEVDEALAKELREYRSPTDGETRMFYEIVVAPSYTEEGLEILRGKSKNLRILETKKNKKGKLSLRQVGGGWLAQDSDDLTPEDIQFKVVSEKKPQESELHDAEFAWLCVKHVKSNAIVIAKNNCMLGMGSGQPNRRESLRIAMKKAGDEVKGAALASDAFFPFAWKDAVEEACENGIGVIAEPGGSIRDGDAIDCCNKYGVALLLTSVRHFKH

SEQ ID NO: 12472 - protein, 511 aa, Euphorbia esula
  misc_feature (70)..(70): Xaa can be any naturally occurring amino acid
  misc_feature (187)..(187): Xaa can be any naturally occurring amino acid
  misc_feature (423)..(423): Xaa can be any naturally occurring amino acid
  misc_feature (467)..(467): Xaa can be any naturally occurring amino acid
EILGTGLQKLGYTIVSTGGTASALESQGVSVTKVEQLTSFPEMLDGRVKTLHPNIHGGILARRDQKHHMXALNEHGIGTFDVVVVNLYPFYDKVTSTGGIEFEDGIENIDIGGPAMIRAAAKNHKDVLVVVDSQDYPELLEYLKGDQNDQQFRRKLAWKAFQHVASYDSAVSEWLWKQTVGDKFPPXLTVPLELKSSLRYGENPHQKAAFYVDKSISEVNAGGIATAIQHHGKEMSYNNYLDADAAWNCVSEFKNPTCVVVKHTNPCGVASRDDILEAYRLAVKADPVSAFGGIVAFNIEVDEVLAKEIREFRSPTDGETRMFYEIVVAPKYTKKGLEILRGKSKTLRILEAKKNEQGKLSLRQVGGGWLAQDSDDLTPEDIQFNVMSEKTPLESQLHDAEFAWLCVKHVKSNAIVIAKNNCXLGMGSGQPNRVESLRLALKKAGDEVKGAALASDAFFPFAWNDAXEEACQAGIGAIAEPGGSIRDKDAIDCCNKYGVSLLFTNVRHFRH

SEQ ID NO: 12473 - protein, 605 aa, Ambrosia trifida
MLLRFGAPFTTVTSSTAVTVRTSPAISFHFLSTDSPSNDSVRNNNKFCFHQFISYSSRLNCKATKEVAESMAASTASPSASKQALISLSDKKDLDLLATGLQELGYTIVSTGGTASALEKAGISVTKVEELTKFPEMLDGRVKTLHPSVHGGILAKRDQSHHMEALEKHSISTFELVVVNLYPFYEKVTSTDGVLFDDGIENIDIGGPTMIRAAAKNHKDVLVVVDSQDYPLLLEFLKGNKDDQHFRRKLAWKAFQHVAAYDSAVSEWLWKQTEGDKFPPSFTVPLSLKSSLRYGENPHQKAAFYTDSSLSEVNGGGIATAIQHHGKEMSYNNYLDADAAWNCVCEFENPTCVVVKHTNPCGVASRDDLIEAYRLAVKADPVSAFGGIVAFNKEVDEALARDIREFRSPTDGETRMFYEIVVAPSYSEKGLEILRGKSKTLRILEAKKNSRGKLSLRQVGGGWLAQDADDLTPEEIKFDVVSEKSPQESELNDAKFAWLCVKHVKSNAIVIAKNNCMLGMGSGQPNRVDSLRIALRKAGDEVKGAALASDAFFPFAWKDAVEEACESGIGVIAEPGGSIRDADAIDCCNKYNVSLLFTGVRHFRH

SEQ ID NO: 12474 - protein, 469 aa, Flaveria ramosissima
MLDGRVKTLHPNVHGGILARRDQSHHMEAPEKHNISTFELVVVNLYPFYEKVTSSNGVTFEDGIENIDIGGPTMIRAAAKNHKDVLVVVDSQDYPMLLEFLKGKKDDQQFRRKLAWKAFQHVAAYDSAVSEWLWKQTEGDKFPPSFTVPLSLKSSLRYGENPHQKAAFYTDSSLSEVNGGGIATAIQHHGKEMSYNNYLDADAAWNCVCEFENPTCVVVKHTNPCGVASRDDLIEAYRLAVKADPVSAFGGIVAFNKEVDEALAKDIREFRSPTDGETRMFYEIVVAPSYTEKGLEILRGKSKTLRILEAKKNSRGKLSLRQVGGGWLAQDSDDLTPEEIKFDVVSTKAPEQNELNDAKFAWLCVKHVKSNAIVIAKNNCMLGMGSGQPNRVDSLRIALKKAGDEVKGAALASDAFFPFAWKDAVEEACESGIGVIAEPGGSIRDGDAIDCCNKYNVSLLFTGVRHFRH

SEQ ID NO: 12475 - protein, 616 aa, Eucalyptus grandis
MLGSPAASASASTSSTSSSAAAAASSRSSLLHSTSTHRTRTRLSTSHPVPVVCVRLQSSSSWRAAPPIKAMAAEAEILSAPDKELRPSAPRGKQALISLSDKTDLAFLGKGLQELGYTVVSTGGTASALENAGLSVTKVEQLTCFPEMLDGRVKTLHPHIHGGILARRDQQHHMEALNKHGIGTFDVVVVNLYPFYDKVTSAADIEFEDGIENVDIGGPAMIRAAAKNHKDVLVVVDSHDYPALLEFLKSDGDDQQFRRKLAWKAFEHVASYDSAVSEWLWRQTTGEKFPPSLTVPLSLKSSLRYGENPHQKAAFYVDKSLAEVNGGGIATAIQHHGKEMSYNNYLDADAAWNCVSEFSDPTCVVVKHTNPCGVASRSDILEAYRLAVKADPVSAFGGIVAFNVEIDENLAREIREFRSPTDGETRMFYEIVVAPKYSKKGLEVLRGKSKTLRILEAKENKKGKLSLRQVGGGWLAQDSDDLTPADIQFNAVSGTTPQESELEDAKFAWLCVKHVKSNAIVIAKNKCMLGMGSGQPNRLESLRIAMRKSGEEVKGAALASDAFFPFAWNDAVEEACQSGIAVIAEPGGSIRDQDAIECCNKYGVSLVFTNVRHFRH

SEQ ID NO: 12476 - protein, 545 aa, Arabidopsis thaliana
MAESQTAQRNQPQSSGSSGEKQALISLSDKRDLASLGNGLQELGYTIVSTGGTASTLENAGVSVTKVEKLTHFPEMLDGRVKTLHPNIHGGILARRDVEHHMEALNEHGIGTFDVVVVNLYPFYEKVTAPGGISFEDGIENIDIGGPAMIRAAAKNHKDVLIVVDSGDYQAVLEYLKGGQSDQQFRRKLAWKAFQHVAAYDSAVSEWLWKQTEGKEKFPPSFTVPLVLKSSLRYGENPHQKAAFYVDKSLAEVNAGGIATAIQHHGKEMSYNNYLDADAAWNCVSEFENPTCVVVKHTNPCGVASRDDILEAYRLAVKADPVSAFGGIVAFNVEVDEVLAREIREFRSPTDGETRMFYEIVVAPKYTAKGLEVLKGKSKTLRILEAKKNDQGKLSLRQVGGGWLAQDSDDLTPEDISFNSVSDKTPTESELADAKFAWLCVKHVKSNAIVIAKNNCMLGMGSGQPNRVESLRIAFKKAGEEAKGAALASDAFFPFAWKDAVEEACQMGIGVIAEPGGSIRDQDAIDCCKKYGVSLLFTNVRHFRH

SEQ ID NO: 12477 - protein, 545 aa, Brassica napus
MSESQTALKNQPQSSASSGKKQALISLSDKKDLATLGNGLQELGYTIVSTGGTASTLENAGVSVTKVETLTHFPEMLDGRVKTLHPNIHGGILARRDVEHHMEALNEHGIGTFDVVVVNLYPFYNKVTAPGGISFEDGIENIDIGGPAMIRAAAKNHKDVLIVVDSEDYQAVLEYLKGGQNDQQFRRKLAWKAFQHVAAYDSAVSEWLWKQTEGQEKFPPSFTVPLSLKSSLRYGENPHQKAAFYVDKSLAEVNAGGIATAIQHHGKEMSYNNYLDADAAWNCVSEFENPTCVVVKHTNPCGVASRDDILEAYRLAVKADPVSAFGGIVAFNVEVDEVLARELREFRSPTDGETRMFYEIVVAPKYTAKGLEVLKGKSKTLRILEAKKNDQGKLSLRQVGGGWLAQDSDDITPEDISFKAVSDKTPTESELADAKFAWLCVKHVKSNAIVIAKNNCMLGMGSGQPNRVESLRLAFKKAGEEAKGAALASDAFFPFAWKDAVEEACEKGIGAIAEPGGSIRDQDAIDCCNKYGVSLLFTNVRHFRH

SEQ ID NO: 12478 - protein, 545 aa, Populus trichocarpa
MADSQTISVPKNEQQSPASGKKQALISLSDKKDLAFLGTGLEQLGYTIVSTGGTASALEGAGVSVTKVEQLTLFPEMLDGRVKTLHPHIHGGILARRDQKHHMEALSEHGIGSFDVVVVNLYPFYDKVTSTGGIEFEDGIENIDIGGPAMIRAAAKNHKDVLIVVDNEDYPGLLEFLKGDRDDQQFRRKLAWKAFQHCASYDSAVSEWLWKQTMGDKFPPSFTVPLELKSSLRYGENPHQNAAFYVDKSISEVNAGGIATAIQHHGKEMSYNNYLDADAAWNCVSEFQNPTCVIVKHTNPCGVASRGDILEAYRLAVKGDPVSAFGGIVAFNIEVDEALAKEIREFRSPTDGETRMFYEIVVAPKYTKKGLEILRGKSKTLRILEAKSNEKGKLSLRQVGGGWLAQDSDDLAPQDIQFNVVSDKSPAESELHDAEFAWLCAKHVKSNAIVIAKNNCMLGMGSGQPNRLESLRISIRKAGDEVKGAALASDAFFPFAWNDAVEEACEAGIGVIAEPGGSIRDKDAIECCNKYGVSLLFTNVRHFRH

SEQ ID NO: 12479 - protein, 594 aa, Ambrosia trifida
MLLRFGAPFTTVTSSTAVTTRSSPAITFHFLSTDSVRNNNNFCFHQVVSYSSRLNCKATKEAAESMAASTASPSASKQALISLSDKKDLDLLATGLQELGYTIVSTGGTASALEKAGISVTKVEELTKFPEMLDGRVKTLHPSVHGGILAKRDQSHHMEALEKHSISTFELVVVNLYPFYEKVTSTDGVLFDDGIENIDIGGPTMIRAAAKNHKDVLVVVDSQDYPLLLEFLKGNKDDQHFRRKLAWKAFQHVAAYDSAVSEWLWKQTEGDKFPPSFTVPLSMKSSLRYGENPHQKAAFYTDSSLSEVNGGGIATAIQHHGKEMSYNNYLDADAAWNCVCEFENPTCVVVKHTNPCGVASRDDLIEAYRLAVKADPVSAFGGIVAFNKEVDEALARDIREFRSPTDGETRMFYEIVVAPSYSEKGLEILRGKSKTLRILEAKKNSRGKLSLRQVGGGWLAQDADDLTPEEIKFDVVSEKSPQESELNDAKFAWLCVKHVKSNAIVIAKNNCMLGMGSGQPNRVDSLRIALRKAGDEVKGAALASDAFFPFAWKDAVEEACESGIGVIAEPGGSIRDADAIDCCNKYNVSLLLPA

SEQ ID NO: 12480 - protein, 577 aa, Ambrosia trifida
PTIFSLPSQPILLETITNLVFYQVVSYSSRLNCKATKEAAESMAASTASPSASKQALISLSDKKDLDLLATGLQELGYTIVSTGGTASALEKAGISVTKVEELTKFPEMLDGRVKTLHPSVHGGILAKRDQSHHMEALEKHSISTFELVVVNLYPFYEKVTSTDGVLFDDGIENIDIGGPTMIRAAAKNHKDVLVVVDSQDYPLLLEFLKGNKDDQHFRRKLAWKAFQHVAAYDSAVSEWLWKQTEGDKFPPSFTVPLSLKSSLRYGENPHQKAAFYTDSSLSEVNGGGIATAIQHHGKEMSYNNYLDADAAWNCVCEFENPTCVVVKHTNPCGVASRDDLIEAYRLAVKADPVSAFGGIVAFNKEVDEALARDIREFRSPTDGETRMFYEIVVAPSYSEKGLEILRGKSKTLRILEAKKNSRGKLSLRQVGGGWLAQDADDLTPEEIKFDVVSGKSPEASELNDAKFAWLCVKHVKSNAIVIAKNNCMLGMGSGQPNRVDSLRIALRKAGDEVKGAALASDAFFPFAWKDAVEEACESGIGVIAEPGGSIRDADAIDCCNKYNVSLLFTGVRHFRH

SEQ ID NO: 12481 - protein, 548 aa, Citrus sinensis
  misc_feature (268)..(268): Xaa can be any naturally occurring amino acid
  misc_feature (274)..(275): Xaa can be any naturally occurring amino acid
  misc_feature (279)..(280): Xaa can be any naturally occurring amino acid
  misc_feature (287)..(287): Xaa can be any naturally occurring amino acid
  misc_feature (289)..(289): Xaa can be any naturally occurring amino acid
  misc_feature (372)..(372): Xaa can be any naturally occurring amino acid
  misc_feature (393)..(393): Xaa can be any naturally occurring amino acid
  misc_feature (510)..(510): Xaa can be any naturally occurring amino acid
MAHSHTVSVPTNQPQSSSSSQANKQALISLSDKKDLASLGIGLQELGYTIVSTGGTATSLENAGVSVTKVEQLTCFPEMLDGRVKTLHPNIHGGILARRDQKHHMDALSEHGIGTFDLVVVNLYPFYDKVTSAGGIDFEDGIENIDIGGPAMIRAAAKNHKDVLVVVDSEDYPALLEFLKGNQDDQQFRRKLAWKAFQHVASYDSAVSEWLWKQTAGEDKFPPSFTVPLELKSSLRYGENPHQKAAFYVDKSLAEVNAGGIATAIQHXGKEMSXXNYLXXDAAWNCXSXFKNPTCVIVKHTNPCGVASRDDILEAYKLAVKADPVSAFGGIVAFNVEVDEALAKELREYRSPTDGETRMFYEIVVAPSYTEXGLEILRGKSKNLRILETKKNXKGKLSLRQVGGGWLAQDSDDLTPEDIQFKVVSEKKPQESELHDAEFAWLCVKHVKSNAIVIAKNNCMLGMGSGQPNRRESLRIAMKKAGDEVKGAALASDAFFPFAWKDAVEEACEXGIGVIAEPGGSIRDGDAIDCCNKYGVALLLTSVRHFRH

SEQ ID NO: 12482 - protein, 545 aa, Brassica napus
MSESQTALKNQPQSSASSGKKQALISLSDKKDLATLGNGLQELGYTIVSTGGTASTLENAGVSVTKVETLTHFPEMLDGRVKTLHPNIHGGILARRDVEHHMEALNEHGIGTFDVVVVNLYPFYNKVTAPGGISFEDGIENIDIGGPAMIRAAAKNHKDVLIVVDSEDYQAVLEYLKGGQNDQQFRRKLAWKAFQHVAAYDSAVSEWLWKQTEGQEKFPPSFTVPLSLKSSLRYGENPHQKAAFYVDKSLAEVNAGGIATAIQHHGKEMSYNNYLDADAAWNCVSEFENPTCVVVKHTNPCGVASRDDILEAYRLAVKADPVSAFGGIVAFNVEVDEVLARELREFRSPTDGETRMFYEIVVAPKYTAKGLEVLKGKSKILRILEAKKNDQGKLSLRQVGGGWLAQDSDDITPEDISFKAVSDKTPTESELADAKFAWLCVKHVKSNAIVIAKNNCMLGMGSGQPNRVESLRLAFKKAGEEAKGAALASDAFFPFAWKDAVEEACEKGIGAIAEPGGSIRDQDAIDCCNKYGVSLLFTNVRHFRH

SEQ ID NO: 12483 - protein, 603 aa, Helianthus annuus
MLRFGAPLPTVTSSTAVISRTSPAITFHFRSTDAASLQNSNFCFQQVVSHSSRVNCYRNKATAEAAETMAGSVASPSASKQALISLSDKKDLDLLATGLQELGYTIVSTGGTASALEKAGISVTKVEELTKFPEMLDGRVKTLHPSVHGGILAKRDQSHHMEALEKHSISTFELVVVNLYPFYEKVTSTDGVVFDDGIENIDIGGPTMIRAAAKNHKDVLVVVDSQDYPLLLEFLKGNKDDQHFRRKLAWKAFQHVAAYDSAVSEWLWKQTEGDKFPPSFTVPLSLKSSLRYGENPHQKAAFYTDSSLSEVNGGGIATAIQHHGKEMSYNNYLDADAAWNCVCEFENPTCVVVKHTNPCGVASRDDLIEAYRLAVKADPVSAFGGIVAFNKEVDEALARDIREFRSPTDGETRMFYEIVVAPSYSEKGLEILRGKSKTLRILEAKKNSRGNLSLRQVGGGWLAQDADDLTPEEIKFDLVSEKSPEESALNDAKFAWLCVKHVKSNAIVIAKNNCMLGMGSGQPNRVDSLRIALRKAGEEVKGAALASDAFFPFAWKDAVEEACESGIGVIAEPGGSIRDADAIDCCNKYNVSLLFTGVRHFRH

SEQ ID NO: 12484 - protein, 590 aa, Mimulus guttatus
MAEIPSTPRLESNASLAGKKQALISLSDKRDLVLLGNGLHELGFTIISTGGTASSLESSGVPVTKVEELTHFPEMLDGRVKTLHPNVHGGILARRDQQHHMKALDDHGIGTFDVVVVNLYPFYEKVSSSSGISFEDAIENIDIGGPTMIRAAAKNHKDVLVVVDSNDYPALLEYLKGGQNDQEFRKWLAWKAFDHVASYDSAVSEWLWKQTSKDKFPPSLTVPLSLKSSLRYGENPHQKAAFYVDKSLEEVNGGGCATAIQHHGKEMSYNNYLDADAAWNCVCEFSKPTCVVVKHTNPCGVASRDDIIEAYRLAVKADPVSAFGGIVAFNVEVDEALAKDIREFRSPTDGETRMFYEIVVAPSYTKKGLEILRGKSKTLRILEATKNKRGKLSLRQVGGGWLAQEADDLTPEDIEFNVVSGKSPQENELSDAKFAWLCVKHVKSNAIVIAKNNCMLGMGSGQPNRLESLRIATKKAGDEIKGAALASDAFFPFAWNDAVEEACKSGVGVIAEPGGSIRDADAVDCCNKYGVSLVFTNDCRVRWLEILRVVLILDYIIGLTELDKDCSRRLDQIIEITIRGRGVHVSDPGR

SEQ ID NO: 12485 - protein, 543 aa, Solanum lycopersicum
MAETVATPQSSPKLSTSGRKQALISLSDKTDLAKLGNGLQELGYTIVSTGGTASALEGAGVSVTKVEELTRFPEMLDGRVKTLHPGIHGGILARRDQEHHMEALEKHEIGTFDVVVVNLYPFYAKVSSSSGISFEDGIENIDIGGPAMIRAAAKNHRDVLVVVDSEDYPDLLEFLRGDNDDQQFRRKLAWKAFQHVASYDSAVSEWLWKQTVGDKFPPSLTVPLSLKDQLRYGENPHQKAAVYVDKSLSEVNAGGIATVIQHHGKEMSYNNYLDADAAWNCVCDFNQPTCVVVKHTNPCGVASRNDIIEAYRLAVKADPVSAFGGIVAFNVEVDEALAKDIREFRSPTDGETRMFYEIVVAPKYTEKGLEVLRGKSKTLRILEASKNNKGKLSLRQIGGGWLAQDSDDLTPEDIQFNVMSDKTPQENELIDAQFAWLCVKHVKSNAIVIAKNNCMLGMGSGQPNRLESLRIAMRKAGDEVKGAALASDAFFPFAWNDAVEEACQSGVSVIAEPGGSIRDKDAVECCNKYGVSLVFTNVRHFRH

SEQ ID NO: 12486 - protein, 543 aa, Solanum lycopersicum
MAETVATPQSAPKLSTSGRKQALISLSDKTDLAKLGNGLQELGYTIVSTGGTASALEGAGVSVTKVEELTRFPEMLDGRVKTLHPGIHGGILARRDQEHHMEALEKHEIGTFDVVVVNLYPFYAKVSSSSGISFEDGIENIDIGGPAMIRAAAKNHRDVLVVVDSEDYPDLLEFLRGDNDDQQFRRKLAWKAFQHVASYDSAVSEWLWKQTVGDKFPPSLTVPLSLKDQLRYGENPHQKAAVYVDKSLSEVNAGGIATVIQHHGKEMSYNNYLDADAAWNCVCDFNQPTCVVVKHTNPCGVASRNDIIEAYRLAVKADPVSAFGGIVAFNVEVDEALAKDIREFRSPTDGETRMFYEIVVAPKYTEKGLEVLRGKSKTLRILEASKNNKGKLSLRQIGGGWLAQDSDDLTPEDIQFNVMSDKTPQENELIDAQFAWLCVKHVKSNAIVIAKNNCMLGMGSGQPNRLESLRIAMRKAGDEVKGAALASDAFFPFAWNDAVEEACQSGVSVIAEPGGSIRDKDAVECCNKYGVSLVFTNVRHFRH

SEQ ID NO: 12487 - protein, 591 aa, Artemisia annua
TTAAAVLRRTSPATSSQLPFTSSPLFSTSFSFQQIEGYSVRLNCYRNKAMAETVASSAGSVTSPSGSKNALISLSDKKNLDLLAAGLQELGYTIVSTGGTASALEKAGISVTKVEELTNFPEMLDGRVKTLHPNVHGGILARRDQSHHMEALEKHSIGTFELVIVNLYPFYAKVSSANGVTFDDGIENIDIGGPTMIRAAAKNHKDVLVVVDSEDYPVLLEFLKGNKDDQQFRRKLAWKAFQHCAAYDSAVSEWLWKQTEGDKFSPSFTVPLTLKSSLRYGENPHQKAAFYTDSSLSEVNGGGIATAIQHHGKEMSYNNYLDADAAWNCVCEFEKPTCVVVKHTNPCGVASRDDLIEAYRLAVKADPVSAFGGIVAFNTEVDEALAKDIREFRSPTDGETRMFYEIVVAPSYSEKGLEILRGKSKTLRILEAKKNSRGKLSLRQVGGGWLAQDSDDLTPEEIKFDVKSKKAPEESELSDAKFAWLCVKHVKSNAIVIAKNNCMLGMGSGQPNRVDSLRIAVRKAGDEVKGAALASDAFFPFAWNDAVEEACQSGIGVIAEPGGSIRDNDAIDCCDKYNVSLVFTGVRHFRH

SEQ ID NO: 12488 - protein, 542 aa, Aristolochia fimbriata
MAEAETAVVTNTPSLGKKQALISLSDKQDLAFLGKGLQDLGYSIVSTGGTASALESAGVAVTKVEELTCFPEMLDGRVKTLHPNIHGGILARRDMDHHMEALKEHGIGTFDVVVVNLYPFYDKVSSTSGISFEDGIENIDIGGPAMIRAAAKNHQDVLIVVDPKDYPALLDFLQGKISDGERFRRQLAWKAFQHVASYDSAVSEWLWKQSGGERFPPALTVPLSLRSSLRYGENPHQQAAFYVDKSLAEVNAGGIATAIQHHGKEMSYNNYLDADAAWNCVSEFQKPTCVVVKHTNPCGVASRDDILEAYRLAVKADPVSAFGGIVAFNVEVDEDLAKEIREFRSPTDGETRMFYEIVVAPKYTEKGLEVLRKKSKTLRILEAKKNATGKLSLRQVGGGWLLQDTDDLVPRNIEFNVVSEKSPGESELHDAEFAWLCVKHVKSNAIVLAKNNCMLGMGSGQPNRLESLRIAMKKAGEEAKGTALASDAFFPFAWNDAVEEACKSGVSVIAEPGGSIRDGDAVDCCNKYGVSLLFTNVRHFRH

SEQ ID NO: 12489 - protein, 543 aa, Solanum phureja
MTETVATPQSAPKLSTSGRKQALISLSDKTDLAKLGNGLQELGYTIVSTGGTASALECAGVSVTKVEELTRFPEMLDGRVKTLHPGIHGGILARRDQEHHMEALEKHEIGTFDVVVVNLYPFYAKVSSSSGISFEDGIENIDIGGPAMIRAAAKNHRDVLVVVDSEDYPDLLEFLRGDNDDQQFRRKLAWKAFQHVASYDSAVSEWLWKQTVGDKFPPSLTVPLSLKDQLRYGENPHQKAAVYVDKSLSEVNAGGIATVIQHHGKEMSYNNYLDTDAAWNCVCDFNKPTCVVVKHTNPCGVASRNDIIEAYRLAVKADPVSAFGGIVAFNVEVDEALAKDIREFRSPTDGETRMFYEIVVAPKYTEKGLEVLRGKSKTLRILEASKNNKGKLSLRQIGGGWLAQDSDDLTPEDIPFNVMSDKTPQENELNDAQFAWLCVKHVKSNAIVIAKNNCMLGMGSGQPNRLESLRIAMRKAGDEVKGAALASDAFFPFAWNDAVEEACQSGVSVIAEPGGSIRDKDAVECCNKYGVSLVFTNVRHFRH

SEQ ID NO: 12490 - protein, 545 aa, Tropaeolum majus
MAQSRAVLSSENEQKSFASGKKQVLISLSDKKDLDFLGNGLQGLGYSIISTGGTATALENAGVSVTKVEQLTSFPEMLDGRVKTLHPNIHGGILARRDQKHHIEALDEHGIGTIDIVVVNLYPFYQKVTSGAISFEDGIENIDIGGPAMIRAAAKNHKDVLVVVDSEDYPALLEYLKGNQEDQQFRRKLAWKAFQHVASYDSAVSEWLWKQTAGENNFPPSFTVPLTQKSSLRYGENPHQKAAFYLDKSLSEVNAGGIATSIQHHGKEMSYNNYLDADAAWNCVSEFEDPTCVVVKHTNPCGVASRDNIIDAYRLAVKADPVSAFGGIVAFNVEIDETLAKDIREFRSPTDGETRMFYEIVVAPSYTKKGLEILRGKSKTLRILEAKKNEKGKLSLRQVGGGWLAQDSDDLTPEDIEFNAVSNKTLSDSELCDAKFAWLCVKHVKSNAIVIAKNNCMLGMGSGQPNRLESLRIAMRKAGDEVKGAALASDAFFPFAWKDAVEEACESGISSITEPGGSIRDQDAIDCCNKYGVSLLFTKVRHFKH

SEQ ID NO: 12491 - protein, 600 aa, Amorphophallus konjac
MPQSLLSCPTAATTSATSFVFLYPHRRCCHRASLRRALLLSRVSPRLCPNATGQARAMATSTNTQKVGSPVSSGYKQALISLSDKRDLAFLGNGLQSLGYTIVSTGGTASALETAGVSVVKVEEVTNFPEMLDGRVKTLHPSIHGGILARRDHEHHMEALNRHRIRTFDVVVVNLYPFYEKVSSASDITFEDGIENIDIGGPAMIRAAAKNHKDVLVVVDHKDYPALLEFLQGKQDRQHFRRELAWKAFQHVAAYDSAVSEWLWKQSGEGDKFPPNFTVPLTKLSTLRYGENPHQKAAFYADKSLSIVNAGGIATAIQHHGKEMSYNNYLDADAAWNCVSEFNSPTCVIVKHTNPCGVASRTDILEAYRLAVKADPISAFGGIVAFNTEVDEDLAREIREFRSPADGETRMFYEIVVAPKYTERGLEVLRGKSKTLRILEAKKSEKGMLSLRQVGGGWLAQESDDLVPQDITFKVVSEKVPQENELHDAEFAWLCVKHVKSNAIVIAKNNCILGMGSGQPNRLESLRIAFRKAGEEARGAALASDAFFPFAWKDAVEEACENGIGVIAEPGGSIRDQDAIDCCDKYGVSLLFTNVRHFRH

SEQ ID NO: 12492 - protein, 556 aa, Arabidopsis lyrata
MAESQTAQRNQPQSSGSSGKKQALISLSDKRDLASLGNGLQELGYTIVSTGGTASTLENAGVSVTKVEKLTHFPEMATLPLFFLLLKLDGRVKTLHPNIHGGILARRDVEHHMEALNEHGIGTFDVVVVNLYPFYDKVTAPGGISFEDGIENIDIGGPAMIRAAAKNHKDVLIVVDSEDYQAVLEYLKGGQSDQQFRRKLAWKAFQHVAAYDSAVSEWLWKQTEGKEKFPPSFTVPVELKSSLRYGENPHQKAAFYVDKSLAEVNAGGIATAIQHHGKEMSYNNYLDADAAWNCVSEFENPTCVVVKHTNPCGVASRDDILEAYRLAVKADPVSAFGGIVAFNVEVDEVLAREIREFRSPTDGETRMFYEIVVAPKYTAKGLEVLKGKSKTLRILEAKKNEQGKLSLRQIGGGWLAQESDDLTPKDIRFNCVSDKTPTESELADAKFAWLCVKHVKSNAIVIAKNNCMLGMGSGQPNRVESLRIAFKKAGEEAKGAALASDAFFPFAWKDAVEEACEKGIGVIAEPGGSIRDQDAIDCCKKYGVSLLFTNVRHFRH

SEQ ID NO: 12493 - protein, 545 aa, Brachypodium distachyon
MAAAQPGASTAPQANSSATGVKQALISLSDKTDLAHLGNGLQSLGFSIISTGGTASSLEAAGVTVTKVEQITHFPEMLDGRVKTLHPSIHGGILARRDQEHHLKALNEHGIGTFDVVVVNLYPFYNKVTSGAISFEDGIENIDIGGPTLIRAAAKNHKDVLVVVDHNDYPALLEYLQGKQHDQQFRKMLAWKAFQHVASYDSAVSEWLWKQSNKGDIFPPSLTVPLSLNSTLRYGENPHQKAAFYVDKSLSVFNAGGIATAIQHHGKEMSYNNYLDADAAWNCVSEFENPTCVVVKHTNPCGVASRADVLEAYRLAVKADPVSAFGGIVAFNTTIDEDLAREIREFRSPTDGETRMFYEIVVAPGYTEKGLEVLKGKSKTLRILEAKRSGKGMLSLRQVGGGWLAQESDDLTPEDIAFTKVSERAPTDSELSDAKFAWLCVKHVKSNSIVIAKNNCMLGMGSGQPNRVDSLRIAFRKAGEEAKGAALASDAFFPFAWKDAVEEACEKGIGVIAEPGGSMRDKDAVDCCDKYGVALLFTGVRHFRH

SEQ ID NO: 12494 - protein, 296 aa, Flaveria ramosissima
MAAANASSSASKHALISLSDKKDLDLLAAGLQELGYTIVSTGGTASALEKAGISVTKVEELTKFPEMLDGRVKTLHPNVHGGILARRDQSHHMEALEKHSISTFELVVVNLYPFYEKVTSSNGVAFDDGIENIDIGGPTMIRAAAKNHKDVLVVVDSQDYPMLLEFLKGKKDDQQFRRKLAWKAFQHVAAYDSAVSEWLWKQTEGDKFPPSFTVPLSLKSSLRYGENPHQKAAFYTDSSLSEVNGGGIATAIQHHGKEMSYNNYLDADAAWNCVCEFENPHLCCCKAYKPLWGSFS

SEQ ID NO: 12495 - protein, 254 aa, Brassica napus
QELGYTIVSTGGTASTLENAGVSVTKVETLTHFPEMLDGRVKTLHPNIHGGILARRDVEHHMEALNEHGIGTFDVVVVNLYPFYNKVTAPGGISFEDGIENIDIGGPAMIRAAAKNHKDVLIVSIQRIIKPFWSISKEGRVTNSSAENLRGRPFSMLLLMIPPSQNGYGSRPKEKRSSLPALQFLFHLKAPFATVKILIKRLPFMLIRALLKSTLVVLPQPFSTMERKCHTTTILMLTLRGTVCQNSKTRHVWS

SEQ ID NO: 12496 - protein, 602 aa, Setaria italica
MPLYLVSSPAAAAKLAAGTRAYPRRRRQLLFPARHCLGRRGSLSSLSSSAERSAGRAMDAAEAGTSTAPEASFSATGVKQALISLSDKTDLANLGNGLQRLGFSIISTGGTASSLEAAGVSVTKVEEITHFPEMLDGRVKTLHPSIHGGILARRDQKHHLQALNEHGIGTFDVVVVNLYPFYNKVTSSAISFEDGIENIDIGGPTLIRAAAKNHKDVLVVVDHEDYPALLEYLEGKQDDQDFRRRLAWKAFQHVASYDSAVSEWLWKQSNKGDTFPPSFTVPLTLKSTLRYGENPHQNAAFYGDKSLSLVNAGGIATAIQHHGKEMSYNNYLDADAAWNCVSEFESPTCVVVKHTNPCGVASRQDILEAYRLAVKADPVSAFGGIVAFNTTINEDLAREIREFMSPTDGKTRMFYEIVVAPRYTEKGLEILKGKSKMLRILEAKPSGKGMLSLRQVSGGWLAQESDDLTPEDITFTKMSERAPEDSELSDAKFAWLCVKHVKSNAIVIAKNNRMLGMGSGQPNRLESLRIAFRKAGEEAKGAALASDAFFPFAWNDAVEEACQSGIAVIAEPGGSIRDQDAVDCCNKYGVSLLFTGVRHFRH

SEQ ID NO: 12497 - protein, 600 aa, Oryza sativa
MPLNLASSPAAAAAAKVCAGVRASPRHLLPRALDHQSRRVLSLSSSSSAGRAAGVRAMAAAEAGASTATQAKSSGVKQALISLSDKTDLAYLGNGLQALGFSIISTGGTASSLEAAGVNVTKVEQITNFPEMLDGRVKTLHPSVHGGILARRDQEHHLKALNEHGIGTFDVVVVNLYPFYNKVTSGVISFEDGIENIDIGGPTMIRAAAKNHKDVLVMVDHEDYPALLEYLQGKQDDQQFRKMLAWKAFQHVASYDSAVSEWLWKQSNKGDVFPPNFTVPLSLKSTLRYGENPHQKAAFYGDKSLSVVNAGGIATAIQHHGKEMSYNNYLDADAAWNCVSEFESPTCVVVKHTNPCGVASRQDILEAYRLAVKGDPVSAFGGIVAFNTTIDEDLAKEIREFRSPTDGQTRMFYEIVVAPGYTEKGLEILKGKSKTLRILEAKRSGKGMLSLRQVSGGWLAQESDDLTPEDITFTTVSERAPQDSELSDAKFAWLCVKHVKSNAIVIAKNNCMLGMGSGQPNRLESLRIAFRKAGEEAKGAALASDAFFPFAWNDAVEEACQNGIGVIAEPSGSMRDGDAVDCCNKYGVSLLFTGVRHFRH

SEQ ID NO: 12498 - protein, 543 aa, Triphysaria pusilla
MAETHSTSKLDSKSSHSGKRQALISLSDKKDLTLLANGLQELGFTIVSTGGTASALEKCGVSVTKVEELTHFPEMLDGRVKTLHPNIHGGILARRDQAHHIEALENHGIGTFDVVVVNLYPFYDTVTSSTGVSFEDGVEKIDIGGPAMIRAAAKNHKDVLVVVDSNDYPALLEYLRGGHNDPQFPRTLAWKAFQHVASYDSAVSEWLWKQNGGDKFPPGLTVNLSRKSELRYGENPHQKAAFYADKSLAEVNAGGIATAIQHHGKEMSFNNYLDADAAWNCVCDFSKPTCVVVKHTNPCGVASRNDIIEAYRLAVKADPVSAFGGIVAFNVEVDEVLAKDIREFRSPTDGETRMFYEIVVAPKYTEKGLEVLRGKSKTLRILEATKNSKGKLSLRQVGGGWLAQEADDLTPEDIKFNAVSEKAPQENELHDAEFAWTCVKHVKSNAIVIAKNNCMLGMGSGQPNRLESWRIAMRKAGDEIKGAALASDAFFPFAWNDAVEEICKSGVSVIAEPGGSIRDSDAIDCCNKYGVSLVLTNVRHFKH

SEQ ID NO: 12499 - protein, 566 aa, Flaveria ramosissima
LSCYRFKATTEAAETMAAANASSSASKHALISLSDKKDLDLLAAGLQELGYTIVSTGGTASALEKAGISVTKVEELTKFPEMLDGRVKTLHPNVHGGILARRDQSHHMEALEKHSISTFELVVVNLYPFYEKVTSSNGVTFDDGIENIDIGGPTMIRAAAKNHKDVLVVVDSQDYPMLLEFLKGKKDDQQFRRKLAWKAFQHVAAYDSAVSEWLWKQTEGDKFPPSFTVPLSLKSSLRYGENPHQKAAFYTDSSLSEVNGGGIATAIQHHGKEMSYNNYLDADAAWNCVCEFENPTCVVVKHTNPCGVASRDDLIEAYRLAVKADPVSAFGGIVAFNKEVDEALAKDIREFRSPTDGETRMFYEIVVAPSYTEKGLEILRGKSKTLRILEAKKNSRGKLSLRQVGGGWLAQDSDDLTPEEIKFDVVSTKAPEQNELNDAKFAWLCVKHVKSNAIVIAKNNCMLGMGSGQPNRVDSLRIALKKAGDEVKGAALASDAFFPFAWKDAVEEACESGIGVIAEPGGSIRDGDAIDCCNKYDVSLLFTGVRLFPTLRLAQKLCRVLSNFQV

SEQ ID NO: 12500 - protein, 595 aa, Flaveria ramosissima
TSSTPAIVRTSPATTFNFPSTDYQFADSLKNTKFCFQQNINYTRRLNCYRSKATTEAAETMAAANASPSASKHALISLSDKKDLDLLATGLQELGYTIVSTGGTASALEKAGISVTKVEELTKFPEMLDGRVKTLHPSVHGGILARRDQSHHMEALEKHSISTFELVVVNLYPFYEKVTSSNGVTFDDGIENIDIGGPTMIRAAAKNHKDVLVVVDSQDYPLLLEFLKGNKDDQQFRRKLAWKAFQHVAAYDSAVSEWLWKQTEGDKFPPSFTVPLSLKSSLRYGENPHQKAAFYTDSSLSEVNGGGIATAIQHHGKEMSYNNYLDADAAWNCVCEFENPTCVVVKHTNPCGVASRDDLIEAYRLAVKADPVSAFGGIVAFNKEVDEALAKDIREFRSPTDGETRMFYEIVVAPSYTKKGLEILRGKSKTLRILEAKKNSRGKLSLRQVGGGWLAQDSDDLTPEEIKFDVVSTKAPEQNELDDAKFAWLCVKHVKSNAIVIAKNNCMLGMGSGQPNRVDSLRIALKKAGDEVKGAALASDAFFPFAWKDAVEEACESGIGVIAEPGGSIRDGDAIDCCNKYNVSLLFTGVRHFRH

SEQ ID NO: 12501 - protein, 523 aa, Triticum aestivum
QALISLSDKTDLANLGNGLESLGFSIISTGGTASSLEAAGVNVTKVEQITHFPEMLDGRVKTLHPSIHGGILARRDQEHHLKALNEHGIGTFDVVVVNLYPFYDKVTSGTITFEDGIENIDIGGPTMIRAAAKNHKDVLVVVDHHDYPALLKYLQENQVDPQFRRMLAWKAFQHVASYDSAVSEWLWKQSSGGDIFPPSFTVPLSMKSTLRYGENPHQKAAFYGDRSLSLVNAGGIATSFQHHGKEMSYNNYLDADAAWNCVSEFENPTCVVVKHTNPCGVASRQDVLEAYRLAVKADPVSAFGGIVAFNTTIDEDLAKEIREFRSPTDGETRMFYEIVVAPGYTEKGLEVLKGKSKTLRILEAKRSGKNMLSLRQVSGGWLAQESDDLTPEDITFTTGSERAPTDSELSDAKFAWLCVKHVKSNAIVIAKDNCMLGMGSGQPNRVDSLRIAFRKAGEAAKGAALASDAFFPFAWKDAVEEACENGIGTIAQPGGSMRDKDAVDCCNKYGVSLLFTGVRHFRH

SEQ ID NO: 12502 - protein, 605 aa, Silene vulgaris
MSLASVSCRATSSTSIINRSSLLHSFASRNFASQQSVVPSPVIRVGSLSLNSRSKQCRVTAMSGGSDTIASDSSSSSGLGIKKALLSVSNKTDLVTLATGLESLGYTIVSTGGTATSLEKAGVSVTKVEKLTEFPEMLDGRVKTLHPRIHGGILAKRDLKHHMEALEQHGIGVFDVVVVNLYPFYDKVTSASGVTFEEGIENIDIGGPTMIRAAAKNHNDVLVVVDPQDYTPLLDYLKGQKDDQQFRRKLAWKAFQHVAAYDSAISEWLWNQNGEDKFPPSFTVPLSLKSSLRYGENPHQKAAFYVDKSLAEVNAGGIATAIQHHGKEMSYNNYLDADAAWNCVSEFEDPTCVVVKHTNPCGVASRDDILEAYRLAVKGDPVSAFGGIVAFNVEVDEALAKEIREFRSPTDGETRMFYEIVVAPKYSEKGLEVLRGKSKTLRILEAKKNDKGKLSLRQVGGGWLAQESDDLTPENINFKVVSEKKPTEEELSGAQFAWLCVKHVKSNAIVIAKNKCMLGMGSGQPNRVESLRLAMKKAGEEVKGAALASDAFFPFAWNDAVEEACQSGVSVIAEPGGSIRDKDAVDCCNKYGVSLLFTEVRHFRH

SEQ ID NO: 12503 - protein, 545 aa, Valeriana officinalis
MAESSETLSVLKKSTSSSSGSKQALISLSDKNNLDFLGNELQKLGYKIVSTGGTATFLENSGVSVTKVEEITSFPEMLDGRVKTLHPSIHGGILARRDQKHHIDALDKHGIGTFDVVVVNLYPFVQKVSSTNEITFDDGIENIDIGGPAMIRAAAKNHKDVLVVVDSEDYEELIYFLKENKEDEMFRRKLAWKAFQHVASYDSAVSEWLWKHTSQGKFPPSLSLPVSLKSSLRYGENPHQKAAFYVDKSLSEVNAGGIATAIQHHGKEMSYNNYLDADAAWNCVCEFSKPTCVVVKHTNPCGVASRYDIIEAYRLAVKADPVSAFGGIVAFNIEVDEDLARDIREFRSPTDGETRMFYEIIVAPNYTEKGLEVLRGKSKTLRILKATKNSKGKLSLRQVGGGWLAQDSDDLTPQDIKFNVVSSKSPLENELRDAEFAWLCVKHVKSNAIVIAKNNCMLGMGSGQPNRVESLRIALRKAGDEVKGAALASDAFFPFAWKDAVEEACESGIGVIAEPGGSIRDNDAIDCCNKYGVSLLFTNVRHFRH

SEQ ID NO: 12504 - protein, 954 aa, Setaria italica
MFAGEASELQARLAAAVHALNHDANPAARLAANQWLLALQRSPQGWAVATALLAAPDPPPPADLLFFAAQMLRRKIQSPGPALPGAGLAPQLLDALLHAAQRFSAAPAPRQLLTQICLALSALALRAEGGVDDLFARMPLLPAPAVLELLTVLPEEAAQDQGGDTGVDAAARCRFTREVLAHAPAVIEFLHSQSEKVPADDDGVPLHEHNRRILRCLLSWVRVGCFSETPATTLATHPLLTFAFNSLQVSFSFDVAIEVMTELVSQHQELPEAFLSKMPYIREVLLLPALANRSEKIIAGLACLMCEVGQAAPALVAEGGSQALALADALLRCTLAHFILGIDVKTAKRNAAQELFLPVFSSLLDALLFRAQIDTDERGTDGATCMPDGLAQFRMNLEELLVDICLLLGAPAYINKLFSHGWDFSSQSVPWKEVEVRMYALSMVYKSFGDVIGSYSKWLSSCQSNIKPLLLFCASGISQSVSSNACSLALRKLCEDASSFIHEPQNLEILFWISEGMDKGNLRLEDEEEIVSAITHVLSSVRDKELRKSWLARLLYSSYSAVEKIIDIDRDHSLRQNPATYTQSLDLAVRGLYRMSALFGHLSTAITSGLVDDDIILCLLGIFWPLLEKLFRSSHMENASLSAAVCRSLSSAIHSCGQHFHILLPKVLECLSTNFLLFQRHDCFLRTAANVIEEFGHKEEYGALCVRTFETLSSASSISTLNSSYTCDQEPDLVEAYTYFTSMFIRCCPKEAIVASSSLLELSFQKAAICSTAMHRGAALASMSYISCFLEVVLAAVLESPECIPDGSPGVVLIQILARCGEGLLSNVLYALLGVSALSRVHKSATILQQLAAMCSFCERTTWKAVLSWSSLCGWLQSTVKSLPSEYLKQGEAEMIIPQWLKVLEDAGSDYLHRTGDNIRNHQGYMQGKGGRTLKRIIRDFVESHRNAPTPCPS

SEQ ID NO: 12505 - protein, 643 aa, Zea mays
MASSPPQPLTRTVLAATLLLLLHNAAARADGASPAVNPFTAKAAFIRYWNRKVPNNRPHPAFFVAKLSPLPAADSASFPSALPDIRASLPALCTKAALLCPGPATTDAASLTSGRRGGGPFKGYNNANFSNYGTGGVAGTDSFQKYSPDLNIAADSFRRYGRDSSGRADSFTSYEADGNVVTANFTSYAGGATGGSGSFAAYAAETNVPDSTFTNYDAAANGRGRSFASYSQEANHGENGFSGYGKNGNGVRETFKSYGNESNVLASGFANYGQSANGATDTFTGYGVEGNVPENRFRSYGAGGNAGVDTFKNYRDDGNVGDDRFTSYAKGANGGAAEFQSYGNSANPGSTIFKGYGEGTNPNHHIGFKEYAGENNTFKGYAKSGVDFKGYHNTTVSSSTAAVLTVSAEAAASMHHEHLKWSPEPGKFFRERELVAGNRMPMPDIRDKMPPRAFLPRAIAARIPFEPNAVSEAFGLPLDTALGKAVASTVAECERAPSKGETKRCATSAEDVVDFAVEVLGDDIVVRSTASTAGGGGRVQLGAVAGVDGGRVTRSVSCHQSLFPYLVYYCHSVPKVRVYEADILAADGSGSGEKINRGVAICHLDTSDWSPAHGAFVALGGKPGEVEVCHWIFEGDMTWTVAD

SEQ ID NO: 12506 - protein, 646 aa, Setaria italica
NPHPQISNGFSQSASAASHRPPPPAAAPLPAQCRRRRRVHGGEPVHGEGGLHPVLEPQGAQQPPASGLLRRQALSPPGRRLRLLPLRAARHPRPPPRALLPSRAPLRRAGAASLAAAAGTRGGGPFKGYSNANFSNYGSGGDGGADSFRSYSPDLNIAADSFRRYARDSSDRADRFESYEADGNVVTANFTSYAGGSTGGSGTFASYAAETNVPDSTFTNYDAAANGRGRGFASYAQEANHGENGFSGYGKNGNGVRETFTSYGNESNVMASAFANYGESGNGATDTFSSYGVEGNVPENTFRSYGAGGNAGVDTFKKYRDDANVGDDRFSSYAKGANGGGAEFQSYGNSANPGSTTFKGYGEGTNPNHHIGFKEYAGENNTFKGYAKTGVDFKGYHNTSGSTAALTVSAEAAASMHHQHLKWSPEPGKFFRERELVAGNRMPMPDIRDKMPPRAFLPRDIAAKIPFDPNAVSEVFGVPLDTAMGKAVASTVAECQRAPSKGETKRCATSAEDIVDFAVEMLGNDVVVRSTASTAGSGGDIRLGAVTGVDGGKVTQSVSCHQSLFPYLVYYCHSVPKVRVYEADIMSAAADGGSGEKINHGVAICHLDTSDWSPTHGAFVALGGKPGEVEVCHWIFEGDMTWTVAD

SEQ ID NO: 12507 - protein, 647 aa, Setaria italica
MASPNPPPPPRTVLLLLLLLLFPHNAAAAAASTAVNPFTAKAAFIRYWNRKVPNNRPHPAFFVAKLSPLPAADSASFPSALPDIRARLPALCSRAGLLCAGPASSAGADADAASLAAAAGTRGGGPFKGYSNANFSNYGSGGDGGADSFRSYSPDLNIAADSFRRYARDSSDRADRFESYEADGNVVTANFTSYAGGSTGGSGTFASYAAETNVPDSTFTNYDAAANGRGRGFASYAQEANHGENGFSGYGKNGNGVRETFTSYGNESNVMASAFANYGESGNGATDTFSSYGVEGNVPENTFRSYGAGGNAGVDTFKKYRDDANVGDDRFSSYAKGANGGGAEFQSYGNSANPGSTTFKGYGEGTNPNHHIGFKEYAGENNTFKGYAKTGVDFKGYHNTSGSTAALTVSAEAAASMHHQHLKWSPEPGKFFRERELVAGNRMPMPDIRDKMPPRAFLPRDIAAKIPFDPNAVSEVFGVPLDTAMGKAVASTVAECQRAPSKGETKRCATSAEDIVDFAVEMLGNDVVVRSTASTAGSGGDIRLGAVTGVDGGKVTQSVSCHQSLFPYLVYYCHSVPKVRVYEADIMSAAADGGSGEKINHGVAICHLDTSDWSPTHGAFVALGGKPGEVEVCHWIFEGDMTWTVAD

SEQ ID NO: 12508 - protein, 673 aa, Glycine max
MGTSTVSDEELKEIENLGREDIEEAPIVPEDVSRIAPWIRQITLRGLVASFLIGIIYSVIVMKLNLTTGLVPNLNVSAALLGFVLIRAWTKVLAKAKIVSTPFTRQENTIIQTCAVACYSIAVGGGFGSYLLGLNRRTYEQAGVGTEGNNPGSTKEPGIGWMTAFLFVTSFVGLLALVPIRKIMIIDYKLTYPSGTATAVLINGFHTPKGDVMAKKQVHGFLKFFSASFLWAFFQWFYSGGDNCGFVQFPTFGLKAWKNSFYFDFSMTYVGAGMICSHLVNLSLLLGAVISWGIMWPLIRGLKGEWFPASIPESSMKSLNGYKVFISIALILGDGLYNFVKVLYFTATNIHATVKRKNPETFSDNQKPLPLDDLRRNEVFARESIPIWLACTGYILFSIVSIIVIPLMFPQLKWYYVVFAYLFAPSLGFCNAYGAGLTDMNMAYNYGKVALFVLSALAGKNDGVVAGLVGCGLIKSIVSISSDLMHDFKTGHLTFTSPRSMLLSQAIGTAIGCVVAPLTFFLFYKAFDVGNPDGDYKAPYAIIYRNMAILGVEGFSALPHHCLQLCYGFFTFAIAANLVRDLGPKKIGKWIPLPMAMAVPFLVGGYFAIDMCMGSLVVFLWHTLNRNEAGLMVPAVASGLICGDGLWILPSSILALLKIRPPICMSFLSASAS

SEQ ID NO: 12509 - protein, 661 aa, Cajanus cajan
MGTSAISSEELREIENLSREDIEEAPVVTEDVSRIAPWARQITIRGLVASLLIGIIYSVIVMKLNLTTGLVPNLNVSVALLGFVFIRAWTTVLAKAKIVSTPFTKQENTIIQTCAVACYSIAVGGGFGSYLLGLNRRTYDQAGVDTEGNNPGSTKEPGIGWMTAFLFVTSFVGLLALVPIRKIMIIDYKLSYPSGTATAVLINGFHTPKKDAMAKKQVNGFLKFFSASFLWAFFQWFYTGGDSCGFVQFPTFGLKAWKNSFYFDFSMTYVGAGMICSHLVNLSLLLGAVISWGIMWPLIRGLKGEWFPASIPESSMKSLNGYKVFISIALILGDGLYNFVKVLYFTATNIHATVKKKNINKFSDNQKPLPLDDLRRNEVFARESIPIWLASAGYILFSIISIIVIPLMFHQLKWYYVVFAYLFAPSLGFCNAYGAGLTDMNMAYNYGKVALFVLAALAGKSDGVVAGLVGCGLIKSIVSISSDLMHDFKTGHLTFTSPRSMLISQAIGTAIGCVVAPLTFFLFYKAFDVGNPNGDYKAPYAIIYRNMAILGVEGFSALPQHCLQLCYGFFAFAIAANLVRDLAPQKVGKWIPLPMAMAVPFLVGGYFAIDMCMGSLVVFIWHTLNTNEARLMVPAVASGLICGDGLWILPSSILALLKIRP

SEQ ID NO: 12510 - protein, 667 aa, Medicago truncatula
MDTRSNEEEREIENHHIEEGQVAMDEELNRIAPWRKQITVRGLIASLIIGIIYSVIVMKLNLTTGLVPNLNVSAALLGFVFIRSWTKILSKANIVSAPFTRQENTIIQTCAVACYSIAVGGGFGSYLLGLNRRTYEQAGIDTPGNTPGSTKEPAIGWMTAFLFVTSFVGLLALVPIRKIMIIDYKLTYPSGTATAVLINGFHTPKGDVMAKKQVHGFVKFFSASFVWAFFQWFFTGGDNCGFVQFPTFGLQAWKNSFYFDFSMTYVGAGMICSHLVNLSLLLGAVVSWGIMWPLIKGLKGEWFPASIPESSMRSLNGYKVFISIALILGDGLYNFIKVLYFTGTNIHANMKKRDLNTFSSNQKPLPLDDLRRNEMFARENIPIWLACTGYVLFSIVSIVVIPLMFPQVKWYFVLFAYIFAPSLGFCNAYGAGLTDMNMAYNYGKVALFVLAALAGKSDGVVAGLVGCGLIKSIVSISSDLMHDLKTGHLTLTSPRSMLVSQAIGTAIGCVVAPVTFFLFYKAFDVGNPDGIYKAPYAIIYRNMAILGVEGFSALPDHCLQLCCGFFAFAIVANLVRDLGPQQVGKWIPLPMAMAVPFLVGGYFAIDMCVGSLVVFAWHMLNKKEAGLMVPAVASGLICGDGLWILPSSILALLKVRPPICMSFFPSR

SEQ ID NO: 12511 - protein, 669 aa, Prunus persica
MGSTNNDENGEIETFEREDGVEENGGEPEDLNRIIPWTRQITIRGLVASIVIGTIYSVIVMKLNLTTGLVPNLNVSAALLAFVFIRTWTKLLQKAGIVSTPFTRQENTIIQTCAVACYSIAVGGGFGSYLLGLNRKTYEQAGVDTEGNTPRSTKEPQIGWMTGFLFVSSFVGLLALVPLRKIMIIDYKLSYPSGTATAVLINGFHTPKGDKMAKKQVHGFMKFFSMSFLWSFFQWFYSGGDQCGFAQFPTFGLAAWKNSFYFDFSMTYIGAGMICSHLVNLSLLLGAVLSWGIMWPLIRGLKGEWFPATLSESSMKSLNGYKVFISIALILGDGLYNFLKILYFTGSSIHTKMNNKNPKTVSNNQNQALDDLRRNEVFIRDSIPIWIACLGYTLFSIISIIIIPLMFPQLKWYYVVVAYIIAPSLSFCNAYGAGLTDMNMAYNYGKVALFVLAAVAGKNDGVVAGLVGCGLIKSIVSISSDLMHDLKTGHLTLTSPRSMLLSQAIGTAIGCVVAPLTFFLFYKAFNVGDPDGEYKAPYAIIYRNMAILGVQGFSALPQHCLQLCYGFFAFAVAANLLRDLAPKKIGKWVPLPMAMAVPFLVGAYFAIDMCVGSLAVFVWHKLKNNEAGLMVPAVASGLICGDGLWILPSSILALAKIRPPICMNFLTTK

SEQ ID NO: 12512 - protein, 668 aa, Theobroma cacao
MGTTNMEEMKEIERVEREDLEEKNTETEDLKRIAPWMRQITIRGLIASFLIGIIYSVIVMKLNLTTGLVPNLNVSAALLAFVLVRSWTKLLQKAGFVATPFTRQENTIIQTCAVACYSIAVGGGFGSYLLGLNRKTYEQAGVDSAGNNPGSIKEPGIGWMIGFLFVSSFVGLLALVPLRKIMIIDYKLTYPSGTATAVLINGFHTPKGDKIAKKQVHGFLKFFSLSFLWAFFQWFYAGGDRCGFAQFPTFGLKAWKNSFYFDFSMTYIGAGMICSHLVNLSLLLGAVLSWGVMWPLIGGLKGEWFTATLPESSMKSLNGYKVFISIALILGDGLYNFLKILFFTARSIHVRVKNNNSKTFSDSQKQHVDVLQRNELFVRESIPMWVACLGYTLFSIISIIVIPLMFPELKWYYVVVAYILAPSLSFCNAYGAGLTDINMAYNYGKVALFVLAALSGKENGVVAGLVGCGLIKSIVSISSDLMHDFKTGHLTLTSPRSMLLSQAIGTAIGCVVAPLTFFLFYKAFDVGNPDSEYKAPYALIYRNMAILGVQGFSALPQHCLQLCYGFFSFAIAANLLRDFTPKNIGKWAPLPMAMAVPFLVGAYFAIDMCVGSLVVFAWHKLNGKKAGLMIPAVASGLICGDGLWLLPSSILALFKVRPPICMNFLATT

SEQ ID NO: 12513 - protein, 668 aa, Gossypium hirsutum
MGNMNMEEMKEIERVERDDLEERIDEQEELKRIAPWTKQITIRGLIASLLIGIIYSVIVMKLNLTTGLVPNLNVSAALLAFVLVRSWTKLLQKVGFVSTPFTRQENTIIQTSAVACYSIAVGGGFGSYLLGLNRKTYEQAGVDAVGNNPGSIKEPGIGWMTGFLFVSCFVGLLALVPLRKIMIIDYKLAYPSGTATAVLINGFHTPKGDKNAKKQVHGFLKFFSFSFLWAFFQWFYAGGDSCGFSQFPTFGLKAWKNSFYFDFSMTYIGAGMICPHLVNLSLLLGAVLSWGVMWPLIGGLKGEWFPATLPESSMKSLNGYKVFISIALILGDGLYNFLKILFFTARNIHAKVKNSNRKTSPDNQKQLPDDLHRNELFNRESIPIWVACAGYTFFSVISVIVIPQMFPELKWYYVVVAYILAPSLSFCNAYGAGLTDMNMAYNYGKVALFVLAALSGKENGVVAGLVGCGLIKSIVSISSDLMHDFKTGHLTLTSPRSMLLSQAIGTAIGCIVAPLTFFLFYKAFDLGNPDGEYKAPYALIYRNMAILGVQGFSALPQYCLQLCYGFFSFAIAANLLRDFTPKNIGKWIPLPMAMAVPFLVGAYFAIDMCVGSLAVFAWHKLNRKKASLMVPAVASGLICGDGLWLLPSSILALFKVRPPICMTFLATT

SEQ ID NO: 12514 - protein, 664 aa, Manihot esculenta
MNNLMGTVHMEETKGIEKENSEEMGDEPEYTSRIAPWNKQITVRGVVASLVIGIIYSVIVMKLNLTTGLVPNLNVSAALLAFVFIRTWTKLLQKAGIVTNPFTRQENTIIQTCAVACYSIAVGGGFGSYLLALNRKTYEQAGVDTEGNAPGSIKEPGIGWMTGFLFVSSFVGLLALVPLRKIMIIDYKLTYPSGTATAVLINGFHTSKGDKLARKQVHGFMKFFSISFIWAFFQWFYSGGERCGFSQFPTFGLKAWKNSFFFDFSSTYVGAGMICSHLVNLSLLLGAVLSWGIMWPLIGGNKGDWFPATLPESNMKSLNGYKVFISIALILGDGLYNFVKILYFTANSIRARAKTNNSRTDESKQAPDDLRRNEFFIRETIPMWVACLGYTAFSIISIIVIPLMFPELKWYYVVVAYILAPSLSFCNAYGAGLTDMNMAYNYGKVALFILAAISGGNNGVVAGLVGCGLIKSIVSYSSDLMHDFKTGHLTLTSPRSMLLSQVIGTAIGCVVAPLTFFLFYKAFDVGNPDGEYKAPYGLIYRNMAILGVEGFSALPQHCLQLCYGFFAFAIAANLVRDLFPKNIGKWIPLPMAMAVPFLVGANFAIDMCVGSLVVFAWHKLNSRRAGLMIPAVASGLICGDGLWILPSSILALAKIHPPICMSFK

SEQ ID NO: 12515 - protein, 160 aa, Gossypium hirsutum
MEEMKEIEGVERQDSEEMNNEQEELKRIAPWMKQITIRGLVASLLIGIIYSVIVMKLNLTTGLVPNLNVSAALLAFVFIRSWTKLLQKAGIVSTPFTRQENTIIQTCAVACYSIAVGGGFGSYLLGLNRKTYEQAGIGTEGNNPWSIKEPGIGWMVGFSL

SEQ ID NO: 12516 - protein, 667 aa, Manihot esculenta
MNNIMGNVNEEEMREIEKFEMENLEEMRNEPEDMSRIAPWTKQITIRGLIASLAIGIIYSVIAMKLNLTTGLVPNLNVSAALLAFVFIRTWTKLLQKAGIVTSPFTRQENTIIQTCAVACYSIAVAGGFASYLLGLNRKTYEQAGVDTKGNTPGSTKEPGIGWMTGFLFVTSFVGLLALVPLRKIMILDYKLTYPSGTATAVLINGFHTSKGDKIARKQVHGFIKFFSISFLWAFFQWFYTGGGNCGFAQFPTFGLKAWKNSFYFDFSMTYVGAGMICSHLVNLSLLLGAILSWGIMWPLIAGLKGDWFPATLPESSMRSVNGYKVFISIALILGDGLYNFLKILYFTASSIRTRAKTGDLKTLSDKQNQDDLRRNEVFVRETIPIWVACLGYTAFSIISIIVIPIMFPELKWYYVVVAYILAPSLSFCNAYGAGLTDMNMAYNYGKVALFVLAALTGGDNGVVAGLVGCGLIKSIVSISSDLMHDFKTGHLTLTSPRSMLLSQAIGTAIGCVVAPLTFFLFYKAFDVGNPNGEYKAPYALIYRNMAILGVQGFSALPQHCLQLCYGFFAFAIFANLVRDLSHKKFGKWIPLPMAMAVPFLVGAYFAIDMCMGSLIVFAWHKLNSKKAGLMVPAVASGLICGDGLWILPSSILALAKIHPPICMSFS

SEQ ID NO: 12517 - protein, 350 aa, Citrus sinensis
MVYKVFVSIALILGDGLYNFLRILYFTATNIHARAKKSNLKTDSDNQDQALDNRQRNEIFIKESIPMWTACVGYTVFSIISIIVIPLMFPKLKWYYVVVAYILAPSLSFCNAYGAGLTDMNMAYNYGKVALFVLAALSGKENGVVAGLVGCGLIKSIVSISSDLMHDFKTGHLTLTSPRSMLVSQAIGTAIGCVVAPLTFFLFYKAFDVGNPDGEYKAPYAIVYRNMAILGVEGFSALPQHCLQLCYGFFAFAIAANLLRDLSPKKIAKWIPLPMAMAVPFLVGAYFAIDMCLGSLVVFAWHKLNSKNADLMIPAVASGLICGDGLWILPSSILALANVRPPICMKFLAS

SEQ ID NO: 12518 - protein, 671 aa, Malus domestica
MGNTNGENGEIETFETENGHGIEENGCEPQEDLNRIVPWRRQITVRGLVASVIIGVIYSVIVMKLNLTTGLVPNLNVSAALLAFVFIRSWTKLLQKAGVVSTPFTRQENTIIQTCAVACYSIAVGGGFSSYLLGLNRKTYEQVGVNTEGNTPGSTKEPAIGWMTGFLFVSSFVGLLALVPLRKIMIIDYKLAYPSGTATAVLINGFHTPKGDKMAKQQVHMFMKFFSASFLWGFFQWFYSGGEQCGFAQFPTFGLTAWRNSFYFDFSMTYIGAGMICSHLVNLSLLLGAILSWGVMWPLIRGLKGEWFPATLSESSMKSLNGYKVFISISLILGDGLYNFLKILYFTGSNIHMKMMNKNLKTASNNKNATVDDLRRNEVFIRDNIPVWVACVGYTLFSVISIIIIPLMFPQLKWYYVVVAYLIAPSLSFCNAYGAGLTDMNMAYNYGKVALFVLAAVAGKNDGVVAGLVGCGLIKSIVSISSDLMHDLKTAHLTLTSPRSMILSQAIGTAIGCVVAPLTFFLFYKAFNIGDPEGEYKAPYAIIYRNMAILGVEGFSALPQHCLQLCYGFFSFAIATNLLRDLAPKKIGKYVPLPMAMAVPFLVGAYFAIDMCMGSLVVFVWHKLNNNKASSMVPAVASGLICGDGLWILPSSILALAKIQPPICMNFLANK

SEQ ID NO: 12519 - protein, 673 aa, Citrus clementina
MESRYGEEELKEIENVNHHVKEELDLEEIKDQTEDVKRIPPWTNHITIRGLIASVAIGIIYSVIVMKLNLTTGLVPNLNVSAALLAFVFVRTWTKLLHKAGITATPFTRQENTVIQTCAVACYSIAVGGGFGSYLLGLNRRTYQQSGVDTPGNNPDSTKEPEIGWMIGFLFVTSFVGLLALVPLRKIMIIDYKLSYPSGTATAVLINGFHTPKGDKRAKKQVHGFTKFFSLSFLWAFFQWFYAGGEHCGFVQFPTFGLKAWKNSFYFDFSMTYIGAGMICSHLVNLSLLLGAVLSWGIMWPLITGLKGDWFPKTLPESSMKSLNGYKVFVSIALILGDGLYNFLRILYFTATNIHARAKKSNLKTDSDNQDQALDNRQRNEIFIKESIPMWTACVGYTVFSIISIIVIPLMFPKLKWYYVVVAYILAPSLSFCNAYGAGLTDMNMAYNYGKVALFVLAALSGKENGVVAGLVGCGLIKSIVSISSDLMHDFKTGHLTLTSPRSMLVSQAIGTAIGCVVAPLTFFLFYKAFDVGNPDGEYKAPYAIVYRNMAILGVEGFSALPQHCLQLCYGFFAFAIAANLLRDLSPKKIAKWIPLPMAMAVPFLVGAYFAIDMCLGSLVVFAWHKLNSKNADLMIPAVASGLICGDGLWILPSSILALANVRPPICMKFLAS

SEQ ID NO: 12520 - protein, 663 aa, Populus trichocarpa
MNMEEMKEIERVGGEGMEEVRDEPEDIKRIAPWTKQITVRGIVASIAIGIIYSVIVMKLNLTTGLVPNLNVSAALLAFVFLRTWTKLLSKAGIVTSPFTRQENTIVQTCAVACYSIAVGGGFGSYLLGLNRKTYEQAGVDAEGNTPGSTKEPGIGWMTGFLFVSSFVGLLALVPLRKIMIIDYKLSYPSGTATAVLINGFHTPTGDKMARKQVHGFMKFFSLSFLWAFFQWFYSGGEKCGFSQFPALGLKAWKNSFYFDFSMTYIGAGMICSHLVNLSLLLGAVLSWGLMWPLIGGLKGEWFPSTLSESSMKSLNGYKVFISISLILGDGLYNFLKILYFTARSMRARAKANKLKTEDKNQALDDLQRNEIFLREGIPLWVACLGYITFSIIAIIAIPFMFPELKWYYVVVAYILAPSLSFCNAYGAGLTDMNMAYNYGKVALFLLAALAGKNNGVVAGLVGCGLIKSIVSISSDLMHDFKTGHLTLTSPRSMLLSQAIGTVIGCVVAPVTFFLFYKAFDVGNPDGEYKAPYAIIYRNMAILGVEGFSALPQHCLQLCYGFFAFAILANLSRDLSPNNIGKYVPLPMAMAVPFLVGAYFAIDMCVGSLVVFAWHKLNSRKASLMVPAVASGLICGDGLWILPSSILALAKIRPPICMSFLATN

SEQ ID NO: 12521 - protein, 673 aa, Citrus sinensis
MESRFGEEELKEIENVSHHEKEELDLEEIKDQTEDVKRIPPWTNHITIRGLIASVAIGIIYSVIVMKLNLTTGLVPNLNVSAALLAFVFVRTWTKLLHKAGITATPFTRQENTVIQTCAVACYSIAVGGGFGSYLLGLNRRTYQQSGVDTPGNNPDSTKEPEIGWMIGFLFVTSFVGLLALVPLRKIMIIDYKLSYPSGTATAVLINGFHTPKGDKRAKKQVHGFTKFFSLSFLWAFFQWFYAGGEHCGFVQFPTFGLKAWKNSFVLNMSMTYIGAGMICSHLVNLSLLLGAVLSWGIMWPLITGLKGDWFPKTLPESSMKSLNGYKVFISIALILGDGLYNFLRILYFTATNIHARAKKSNLKTDSDNQDQALDNRQRNEIFIKESIPMWTACVGYTVFSIISIIVIPLMFPKLKWYYVVVAYILAPSLSFCNAYGAGLTDMNMAYNYGKVALFVLAALSGKENGVVAGLVGCGLIKSIVSISSDLMHDFKTGHLTLTSPRSMLVSQAIGTAIGCVVAPLTFFLFYKAFDVGNPDGEYKAPYAIVYRNMAILGVEGFSALPQHCLQLCYGFFAFAIAANLLRDLSPKKIAKWIPLPMAMAVPFLVGAYFAIDMCLGSLVVFAWHKLNSKNADLMIPAVASGLICGDGLWILPSSILALANVRPPICMKFLAS

SEQ ID NO: 12522 - protein, 671 aa, Ricinus communis
MNNQTGNMNIEGIKETEKREKDLEELKNEAEDVIGIAPWSKQITIRGVIASLVIGIIYSVIVMKLNLTTGLVPNLNVSAALLAFVFIRTWTKLLQKAGIVTSQFTRQENTIIQTCAVACYSIAVGGGFGSYLLGLNKKTYEQAGVDSQGNTPKSTKEPGVAWMTGFLFVSSFVGLLALVPLRKIMIIDYKLQYPSGTATAVLINGFHTPKGDKIARKQVHGFMKFFSISFFWAFFQWFFSGGEKCGFVQFPTFGLQAWKNSFYFDFSMTYVGAGMICSHIVNLSLLLGAVLSWGVMWPLIGELKGDWFPATLPQSSMKSLNGYKVFISIALILGDGLYNFLKILYFTATNFSARAKKNNIRTLSDKQNQAPDDLQRNEIFIRETIPMWVACLGYIIFSVISIIVIPIMFPELKWYFVVVAYILAPSLSFCNAYGAGLTDMNMAYNYGKVALFVLAALAGNNNGVVAGLVGCGLIKSIVSISSDLMHDFKTGHLTLTSPRSMLLSQAIGTAIGCVVAPLTFFLFYKAFDVGNPDGEYKAPYAIIYRNMAILGVEGFSALPQHCLQLCYGFFSFAILANLLRDLSPKNIGRWIPLPMAMAVPFLVGAYFAIDMSVGSLIVFVWHKLNNRKAGLMLPAVASGLICGDGLWILPSSILALAKIHPPICMNFLATK

SEQ ID NO: 12523 - protein, 674 aa, Cannabis sativa
MENGTKHMEGSSSSSSEIEKFEREDMEEVGHEPEDLNRIAPWTEQITLRGLVASIVIGIIYSVIVMKLNLTTGLVPNLNVSAALLAFVFIRTWTKLLSKAGIMSSPFTRQENTIIQTCAVACYSIAVGGGFGSYLLGLNQKTYEQAGIDTVGNTPGSTKEPGIGWMTGFLFVTCFVGLLALVPLRKIMIIDYKLSYPSGTATAVLINGFHTPKGDKKAKKQVHGFMRFFSISFLWGFFQWFYSGGDQCGFNQFPIFGFKAWKNSFYFDFSATYVGAGMICSHLVNLSLLLGAVLSWGVMWPLIRGLKGEWFPQTLSESSMKSLNGYKVFISIALILGDGLYNFLKILFFTATSIHTKMKNKTLKTSSNKQDETLDDLKRNELFVRDSIPLWIAFVGYGFFALISIIIIPIMFPELKWYYVVVAYVLAPSLSFCNAYGAGLTDMNMAYNYGKVALFVLASLAGKENGVVAGLVGCGLIKSIVSISSDLMHDFKTGHLTLTSPRSMLVSQAIGTAIGCVAAPVTFFLFYKAFDVGNPDGEYKAPYAIIYRNMAILGVQGFSALPQHCLQLCYGFFAFAIGANLVRDLSPKHISKWVPLPMAMAVPFLVGAYFAIDMCVGSLVVFVWHKMNDKNAALMIPAVASGLICGDGLWILPSSILALAKVRPPICMRFLTSN

SEQ ID NO: 12524 - protein, 380 aa, Lotus japonicus
MALKLVNLGFHPFTLTPPCSSSKPRQCSFVFRCSQVEQISIAESEYSLIEAILGTQGRGRSSSPNQLNAIERAIQVLERLGGVPDPTNSNLIEGRWQLVFTTRPGTASPIQRTFVGVDFFSVFQEISLRTNDPRVGNIVSFSDAIGELKVEAAASIEDGKRILFRFDRAAFSFKFLPFKVPYPVPFKLLGDEAKGWLDTTYLSHSGNLRISKGNKGTTFVLQKQTEPRQRLLTAISSGKGVKEAIDELISLKKNTGEEPELEEGEWQMIWNSQSVTDSWLENAANGLMGKQIIGKNGQIKFLVDILLGLKFSMTGNFVKIGSDMYEVTMDDAAIIGGAFGLPLHMDNKFVLELLFSDQKVRISRGYNEVLFVHIRSDSLR

SEQ ID NO: 12525 - protein, 443 aa, Glycine max
MALKLVNLGFHSSIPCSPRPLKDRFVVRCSKVEQISFTESENSLIEALLGIQGRGRSSSPQQLNAVERAVQVLERLGGVPDPTNSNLIEGRWQLIFTTRPGTASPIQFLTFVGVVFLVYFKRFIFEQMIHAYAILCHFLMLLVSSKWSQCRTGVFSNSFYTSSMMVEVPFMFALIHTENLISYLCTYILSSLFFHLSKIWFVRSIYPTPYSWIKAAASIEDGKRILFRFDRAAFSFKFLPFKVPYPVPFRLLGDEAKGWLDTTYLSSSGNLHISKGNKGTTFVLQKQTEPRQRLLTAISSGKGIKEAIDELISLKQNIGQEPELEDGEWQMMWNSQTVTDSWIENAVNGLMGKQIIRKNGGIKFLVDILLGLKFSMSGNFVKTGSGVYDVTMDDAAIIGGPFGYPLELKNNFILELLYSDEKLRVSRGINNVIFVHVRTDALR

SEQ ID NO: 12526 - protein, 939 aa, Solanum phureja
MSGKSRNFRRRGGDDGDDDETSAKTTNGTAAKPTTTASATKPKKKSLLSFADDEDSDDTPFVRPSSKPSSASSRITKPSSSSSAHKLTSGKDRITPKPPSFTSNVQPQAGTYTKEALLELQKNTRTLVGSRSAQPKPEPRPGPVEPVIVLKGLVKPPFSVTAQTQQNGQESEDDEMDVDQFGGTVNRLGSMALEKDSRKKDDVGSVIPDKMTIDAIRAKRERLRQARPAAQDFIALDEGGNHGEAEGLSDEEPEFQQRIGFYGEKIGSGRRGVFEDFEDKAMQKDGGFRSDDDEEDEEEKMWEEEQVRKGLGKRLDDGSNRGVMSSVVSSAAAVQNVQKANFGSSAVGASVYSSVQSIDVSDGPTIGGGVVGGLPSLDALSISKKAEVAKKALYESMGRLKESHGRTVTSLHKTEENLSASLSKVTTLENSLSAAGEKYMFMQKLRDFVSVICALLQDKGPYIEELEDQMQKLHEERAAAILERRAADNDDEMKELEAAVSAARQVLSRGGSNAATIEAATAAAQTSTAAMRKGGDLPIELDEFGRDKNLQKRMDTTRRAEARKRRRVKNDVKRMSAIKCDSSYQKIEGESSTDESDSESTAYQSNRDQLLQVSEQIFGDAHEEYSQLSVVVEKFDRWKKDYASSYRDAYMSLSIPVIFSPYVRLELLKWDPLHENTDFMDMNWHNSLFSYGIPPEGEAEISVDDTDVNLIPQLVEKLAIPILHNQLANCWDMLSTSETVCAVSAMRLVLRYGPFSGSALSNLIAVLRDRLADAVANLKVPTWDTLVMRAVPDAARVAAYRFGMSIRLIRNICLFHEIFAMPVLEELVLDQLLSGKILPHLRSIQSNIHDAVTRTERVVTSLHGVWAGPKATGDFSPKLRPLVDYLLSLARVLEKKHSSSSGEIDTSKFARRLKKMLVELNQYDYARDISRTFNIKEAL

SEQ ID NO: 12527 - protein, 300 aa, Setaria italica
GNVADVVLGFDDLEPYMKGMAPYFGCIVGRVANRIKDGKFTLNGAEYSLPINNGPNSLHGGLTGFDKVMWDVVEHKDGECPSVTFQYHSKDGEEGYPGDVTVRATYSLPEATTLRLDMEAIPHDKATPINLAQHTYWNLAGHNSGDILNHTIQIWGKHITPVDENTIPTGEIMPVEGTPFDFTTEHKIGERINDVPGGYDHNYVLDCGDEKNGVKRAAKLRDPSSSRTLNLWTDAPGMQFYTANYVTGITGKGGAVYEKHAGVCLETQGFPNAINQPNFPSVVVQPGEKYKHTMLFEFSA

SEQ ID NO: 12528 - protein, 333 aa, Amorphophallus konjac
MAAELFELSNGGITLKVSDWGATITSLLVPDAQGNLADVVLGFDTLEPYLKGASPYFGCIVGRVANRIKDGKFTLNGIEYSLPINKPPNSLHGGNKGFDKVLWKVVEHNKGEKPAITFEYHSRDGEEGYPGDVVVTATYSLPSRTTLRLDMEAVPTKATPISLAQHTYWNLAGHNSGDVLDHSVQIWASHVTPVDENTIPTGEVMPVNGTPFDFTSEEKIGSRIHEVPGGYDHNYVLGMGEEKLGLKHAAKVKDPKSSRVLDVWTNAPGVQFYTGNYVNGIVGKGGAAYGKHAGLCLETQGFPNAINQPNFPSVVVQPGETHKHTMLFEFSAE

SEQ ID NO: 12529 - protein, 208 aa, Lippia dulcis
RRIRVGCYFHCNLHATSKTTLRLDMEGIPENKPTPISLAQHTYWNLAGHNSGTILDHTIQIWANHITPVDENVTPTGEIKPVKDTPFDFTAENKIGSRINEVGIGYDHNYVLDCGDEKSGLKHAAKLKDPSSSRTLDLWTNAPGLQFYTANYVNGIVGKGGAVYNKHSACCLETQGFPNAVNQSNFPSVVVRPGEKYKHSMLYEFSAE

SEQ ID NO: 12530 - protein, 340 aa, Eucalyptus grandis
MADQARQAELFELDNGTMRVKIANLGCTIASLSVPGKDGKLADVVLGFDSVEPYLKGAAPFFGCIVGRVANRIKEGKFTLDGVEHSLPINKPPNSLHGGHKGFDKVIWEVADYKKGENPSITFKYHSHDGEEGYPGDVAVTATYTLTSSTTMRLDMEAVPENKATPISLAQHTYWNLAGHDSGNILNHSIQIWANHITPVDQNTIPTGEIMPVKGTAFDFTTEKKIGTSIHEVPGLGYDHNYVLDCGEEKSGLKHAAKLKDPSSSRVLDLWTNAPGMQFYTGNYVNGVVGKGDAAYGKHSGVCLETQGFPNAINQPNFPSVIVRPGEKYKHSMLFEFSLE

SEQ ID NO: 12531 - protein, 109 aa, Eutrema parvulum
MFGRGPSKKSDNTKFYEILGVPKTAAPEDLKKAYKKAAIKNHPDKGGDPEKFKELAQAYEVLSDPEKREIYDQYGEDALKEGMGGGGGGHDPFDIFSSFFGGSPFGGEW

SEQ ID NO: 12532 - protein, 373 aa, Cleome spinosa
KFKELAQAYEVLSDPEKREIYDQYGEDALKEGMGGPGGGHDPFDIFSSFFGGGPFGGGSSRGRRQRRGEDVVHPLKVSLEDLYLGTTKKLSLTRNALCSKCNGKGSKSGASMKCAGCQGTGMKVTIRQLGPGMIQQMQHACNECKGTGETISDRDRCPQCKGDKVIPEKKVLEVHVEKGMQHSQKITFSGQADEAPDTVTGDIVFVLQQKEHPRFKRKGDDLFVEHTLSLTEALCGFQFAQTHLDGRQLLIRSNPGEVVKPDSYKAINDEGMPIYQRPFMKGKLYIHFSVEFPESLSPDQAKAIEAVLPGRPSSSKKQLTEMEIDECEETTLHDVSNMEEEMRRKQQAQREAYDDDDDDDGPHGAQRVQCAQQ

SEQ ID NO: 12533 - protein, 349 aa, Brassica napus
MERMHSRREWVVEAVGMTPLISSRPSFGGGGGSPFGGGSSRGRRQRRGEDVVHPLKVSLEDLYLGTTKKLSLSRNALCSKCNGKGSKSGASSTCSGCQGSGMKVSIRQLGPGMIQQMQHPCHDCKGTGETINDRDRCPQCKGDKVVSEKKVLEVAVEKGMQHSQKITFSGQADEAPDTVTGDIVFVIQQKEHPKFKRKGDDLFVEHTLSLTEALCGFQFVLTHLDKRQLLIKSSPGEVVKPDSYRAITDEGMPMHQRPFMKGKLYIHFTVDFPDSLSPDQTKAIEAVLPKPKADLSDMEIDECEETTLHEVNIEDEMRRKAQAQREAYDDDDDDEEGPGGAQRVQCAQQ

SEQ ID NO: 12534 - protein, 269 aa, Brassica juncea
RGNGKGSKSGASMTCGGCQGSGMKVSIRQLGPGMIQQMQHPCHDCKGTGETINDRDRCPQCKGEKVVSEKKVLEVAVEKGMQHSQKITFRGQADEAPDTVTGDIVFVIQQKEHPKFTRKGDDLFVEHTLSLTEALCGFQFVLTHLDKRQLLIKSSPGEVVKPDSYRAISDEGMPIYQRPFMKGKLYIHFTVEFPESLSPDQTKAIEAVLPKPRAALSDMEIDECEETTLHDVNMEDEMRRKAQAQREAYDDDDDEEGPGGAQRVQCAQQ

SEQ ID NO: 12535 - protein, 259 aa, Brassica rapa
SLKCGGCQGKGMKVSIRQIGPGMIQQMQHVCQDCKGTGQTTNDRDRCPQCKGDKVIPEKKVLDVAVEKGMQNSQKITFRGQADEAPDTVTGDIVFVIQQKEHPKFKRKGDDLFVEHTLSLTEALCGFQFVLTHLDARQLLIKSSPGEVVKPDSYKAISDEGMPIHQRPFMKGKLYIHFTVEFPESLSRDQTKAFEAVLPKPAKSAMSDMEIDECEETTLHEVNIEAEMKRKAQAKREAYDDDDDEEGPGGGHGVQCAQQ

SEQ ID NO: 12536 - protein, 225 aa, Raphanus sativus
GTGETINDRDRCPQCKGDKVVPEKKVLEVNVEKGMLHSQKITFEGQADEAPDTVTGDIVFVIQQKEHPKFKRKGEDLFVEHTLSLTEALCGFSFVLTHLDGRNLLIKSNPGEVVKPDSYKAISDKGMPIYQRPFMKGKLYIHFTVEFPDSLSPDQTKALESVLPKPSTTQLSDMEIDECEETTLHDVNIEDEMRRKAQAQREAYDDEDDDDDHPGGAQRVQCAQQ

SEQ ID NO: 12537 - protein, 311 aa, Amaranthus tuberculatus
GSSRGRRQRRGEDVIHPLKVSLEDLYSGTTKKLSLSRNVICSKCIGKGSKSGASMKCGGCQGTGMKVSIRQLGPGMIQQMQHPCNECKGTGETINDKDRCPQCKGEKVVQEKKVLEVVVEKGMQHGQKITFPGEADEAPDTVTGDIVFVLQLKEHPRFKRKGEDLFYEYTLSLTEALCGFRFVLNHLDGRQLLIKSNPGEVIKPDQFKAIDDEGMPIYQRPFMKGKLYIHFTVEFPDSLNPDQVKALEAILPPKPSMTLTDMELDECEETTLHDVNIEEEMKRKQTQAQHEAYDEDDDEPSGAQRVQCAQQ

SEQ ID NO: 12538 - protein, 349 aa, Plantago ovata
YGEDALKEGMGGGGGGMHDPFDIFSSFFGGSPFGGGGSSRGRRQRRGEDVVHPLKVSLEDLYLGSTKKLSLSRNVLCSKCSGKGSKSGASLKCSGCQGTGMKVTIRQLGPGMIQQMQHACNECRGTGETINDRDRCPQCKGEKVVQEKKVLEVNVEKGMQNGQKITFPGEADEAPDTVTGDIVFVLQQKEHPKFKRKNGEDLFVEHTLSLTEALCGFQFILTHLDGRQLLIKSEAGEVVKPNSYKAVNDEGMPNYQRPFMKGKLYIHFNVEFPDSLGKDQVEALAKILPAKPQSKLTDMEVDECEETTLHDVNIEDEMRRKAQQQQEAYDEDDEDDMHGGAQRVQCAQQ

SEQ ID NO: 12539 - protein, 309 aa, Raphanus sativus
  misc_feature (113)..(113): Xaa can be any naturally occurring amino acid
  misc_feature (128)..(128): Xaa can be any naturally occurring amino acid
GRRQRRGEDVVHPLKVSLEDLYLGTTKKLSLSRNALCSKCNGKGSKSGASMKCGGCQGTGMKVTMRQLGPGMIQQMQHACNECKGTGETINDRDRCPQCKGDKVVPEKKVLEXNVEKGMLHSQKITFXGQADEAPDTVTGDIVFVIQQKEHPKFKRKGEDLFVEHTLSLTEALCGFSFVLTHLDGRNLLIKSNPGEVVKPDSYKAISDEGMPIYQRPFMKGKLYIHFTVEFPDSLSPDQTKALESVLPKPSTTQLSDMEIDECEETTLHDVNIEDEMRRKAQAQREAYDDEDDDDDHPGGAQRVQCAQQ

SEQ ID NO: 12540 - protein, 152 aa, Gossypium hirsutum
MFGRAPKKSNNTRYYEILGVSKNASQDDLKKAYKKAAIKNHPDKGGDPEKFKELAQAYEVLSDPEKREIYDQYGEDALKEGMGGGAGAHDPFDIFSSFFGGSPFGGGSSRGRRQRRGEDVVHPLKVSLEDLYLGTSKKLSLSRNVICSKCNG

SEQ ID NO: 12541 - protein, 230 aa, Cajanus cajan
MLAMNVRVLEKLSMIETAAHSARERRLCRRRKFLRFMWRRECENGQKITFPGEADEAPDTITGDIVFVLQQKEHPKFRRKSEDLFVEHTLSLTEALCGFQFVLTHLDGRQLLIKSNPGEVVKPDAYKAINDEGMPMYQRPFMKGKLYIHFTVEFPDFLNADQVKALEAVLPPKPSSQLTDMELDECEETTLHDVNMEEETRRKQQQAAQEAYDEDDDMPGGAQRVQCAQQ

SEQ ID NO: 12542 - protein, 367 aa, Vinca minor
FKELAHAYEVLSDPEKREIYDQYGEDALKEGMGSGGGMHDPFDIFQSFFGGSGFGGGSSRGRRQRRGEDVVHPLKVSLEDLFNGATKKLSLSRNVICSKCSGKGSKSGASHKCSGCQGTGMKVSIRQLGPGMIQQMQHPCNDCKGTGETISDKDRCPQCKGEKVVPEKKVLEVVVDKGMHNSQKITFPGEADEAPDTVTGDIVFVLQQKEHPKFKRKHDDLFVEHTLSLTEALCGFQFILTHLDGRQLLIKSKPGEVIKPDQYKAIDDEGMPVYQRPFMRGKLYIHFTVEFPDSLSPDQVKALEGILPASAQSQLTDMELDECEETTLHDVNIEEEMRRKQAQAQQEAYDEDEDMPGGAQRVQCAQQ

SEQ ID NO: 12543 - protein, 355 aa, Tragopogon dubius
LRDPEKREIYDQYGEDALKEGMGGGGGGHDPFDIFQSFFGGGGGGSSRGRRQRRGEDVIHPLKVSLEDLYNGTSKKLSLSRNVICSKCKGKGSKSGASMKCAGCQGSGMKVSIRHLGPSMIQQMQHPCNECKGTGETINDKDRCPQCKGDKVVQEKKVLEVHVEKGMQNSQKITFPGEADEAPDTVTGDIVFVLQQKEHPKFKRKGDDLFVEHTLSLTEALCGFQFILTHLDSRQLLIKSQPGEVVKPDQFKAINDEGMPMYQRPFMRGKLYIHFTVEFPESLSPEQCKALEGVLPAKPAMQMTDMELDECEETTLHDVNIEEEMRRKQQQAQQEAYDEDDDMPGGAQRVQCAQQ

SEQ ID NO: 12544 - protein, 374 aa, Eschscholzia californica
GDPEKFKELAQAYEVLSDPEKREIYDQYGEDALKEGMGGGGGGHDPFDIFQSFFGGSPFGGGGGSSRGRRQMRGEDVVHSLKVSLEDLYSGTSKKLSLSRNVICSKCSGKGSKSGASMKCSGCQGSGMKVSIRQLGPSMIQQMQHPCNECKGTGETINDKDRCPQCKGDKVVQEKKVLEVHVEKGMQNGQKITFPGEADEAPDTVTGDIVFVLSQKDHPKFKRKGEDLFVEHTLSLTEALCGFQFVLTHLDGRQLLIKTNPGEVVKPDSFKAINDEGMPIYQRHFMRGKLYIHFTVDFPDSLTPEQCKALEAVLPARTATELTDMEVDECEETTLHDVNIEEEMKRKQAQAAQEAYDEDEDMHGGGQRVQCAQQ

SEQ ID NO: 12545 - protein, 268 aa, Fagopyrum esculentum
GKGSKSGASMTCPGCQGSGMKVSIRQLGPSMIQQMQHPCNDCKGTGETINDRDRCPQCKGEKVMQEKKVLEVFVEKGMQNGQKVTFPGEADEAPDTVTGDIVFVLQQKEHPKFKRKGDDLFYEHTLSLTESLCGFQFALTHLDGRQLLIKSHPGEVIKPDSFKGINDEGMPMYQKPFMKGKLYIHFTVEFPDTLSLEQCKALEAALPPRIPTQLTDMELDECEETTLHDVNIEEEMRRKQAQAQQEAYDEDDDDMHGGGPQRVQCAQQ

SEQ ID NO: 12546 - protein, 319 aa, Ocimum basilicum
TSGNPFGGGGSSRGTRQRRGEDVVHPLKVSLEDLYNGTSKKLSLSRNVLCHKCKGKGSKSGASMKCSGCQGSGMKVSIRHLGPSMIQQMQHPCNECKGTGETINDKDRCPQCKGEKVVQEKKVLEVIVEKGMQHGQKITFPGEADEAPDTVTGDIVFVLQQKEHPKFKRKGEDLFVEHTLTLTEALCGFQFILTHLDGRQLLIKSERGEVIKPDQSKAINDEGMPMYQRSFMKGKLYIQFNVEFPDSLSPDQCKALEAVLPPRPTTKVTDMELDECEETTLHDVNMEEEMRRKQQQAQEAYDEDDDMPGGAQRVQCAQQ

SEQ ID NO: 12547 - protein, 384 aa, Cucurbita pepo
LKKAAIKNHPDKGGDPEKFKELAQAYEVLSDPEKREIYDQYGEDALKEGMGGGGGHDPFDIFQSFFGGSPFGGGSSRGRRQRRGEDVVHPLKVSLEDLYLGTSKKLSLSRNVICSKCNGKGSKSGASMSCSSCQGTGMKVTIRHLGPSMIQQMQHPCNECKGTGETISDKDRCSQCKGEKVVQEKKVLEVIVEKGMQNGQKITFPGEADEAPDTVTGDIVFVLQQKEHPRFKRKGEDLFVEHTLSLTEALCGFQFALTHLDGRQLLIKTNPGEVVKPDSFKAINDEGMPMYQRPFMKGKLYIHFSVDFPDSLSPEQIKALVAVLPPKPSSQLTDMELDECEETTMYDVNIEEEMRRKQQQAQAEAYEDDDDMPGGAQRVQCAQQ

SEQ ID NO: 12548 - protein, 315 aa, Fagopyrum esculentum
GAGSSRGRRQRRGEDVIHPLKVSLEDLYNGTSKKLSLSRNVLCSKCKGKGSKSGASMTCPGCQGSGMKVSIRQLGPSMIQQMQHPCNECKGTGETINDRDRCPQCKGEKVMQEKKVLEVFVEKGMQNGQKVTFPGEADEAPDTVTGDIVFVLQQKEHPKFKRKGDDLFYEHTLSLTESLCGFQFALTHLDGRQLLIKSHPGEVIKPDSFKGINDEGMPMYQKPFMKGKLYIHFTVDFPDTLSLEQCKALESALPARTPTQLTDMELDECEETTLHDVNIEEEMRRKQAQAQQEAYDEDDDDMHGGGPQRVQCAQQ

SEQ ID NO: 12549 - protein, 314 aa, Phalaenopsis aphrodite
LEVAGGSRGRRQRRGEDVVHPLKVTLEDLYNGTSRNFLFPGMSLLEMQGKGSKSGASMKCSGCQGTGMKVSIRQLGPSMIQQMQHPCNECKGTGETINDKDRCPQCKGEKVTQEKKVLDVLVEKGMQNGQKITFPGEADEAPDCITGDIVFVLQQKDHSKFKRKGDDLFVEHTLSLTEALCGFQFILTHLDGRQLLIKSNPGEVVKPDQFKAINDEGMPMYQRPFMRGKIYIHFTVEFPDSLSLDQCKALEAILPSRGRTQLTDMELDECEETTLHDVNIEEEMRRKQQSQAQEAYDEDEDMPGGAQRVQCAQQ

SEQ ID NO: 12550 - protein, 95 aa, Fraxinus spp
YGEDALKEGMGGGGGMHDPFDIFSSFFGGSPFGGGGSSRGRRQRRGEDVVHPLKVSLEDLYVGTTKKLSLSRNVLCSKCNGKGSKIWSFNEVLRV

SEQ ID NO: 12551 - protein, 406 aa, Cucumis sativus
MKSDNTKYYEILGVSKNASQDDLKKLSEINIDLFEKFPFMIQFKELAQAYEVLSDPEKREIYDQYGEDALKEGMGGGGGHDPFDIFQSFFGGSPFGGGGSSRGRRQRRGEDVIHPLKVSLEDLYNGTSKKLSLSRNVICSKCKGKGSKSGASMKCPGCQGSGMKVSIRHLGPSMIQQMQHPCNECKGTGETINDKDRCSQCKGEKVVQEKKVLEVIVEKGMQNAQKITFPGEADEAPDTVTGDIVFVLQQKEHPKFKRKGDDLFVEHTLSLVESLCGFQFILTHLDGRQLLIKSLPGEVVKPDQFKAINDEGMPMYQRPFMKGKLYIHFSVEFPDSLNPEQCKALEGVLPPRTSVQLSDMELDECEETTLHDVNIEEEMRRKQAQEAYDEDEDMHGGAQRVQCAQQ

SEQ ID NO: 12552 - protein, 238 aa, Brassica juncea
GMIQQMQHPCHDCKGTGETINDRDRCPQCKGDKVVSEKKVLEVAVEKGMQHSQKITFSGQADEAPDTVTGDIVFVIQQKEHPKFKRKGDDLFVEHTLSLTEALCGFQFVLTYLDKRQLLIKSSPGEVVKPDSYRAITDEGMPMHQRPFMKGKLYIHFTVDFPDSLSPDQTKAIEAVLPKPKADLSDMEIDECEETTLHEVNIEDEMRRKAQAQREAYDDDDDDEEGPGGAQRVQCAQQ

SEQ ID NO: 12553 - protein, 301 aa, Cleome spinosa
GEDVVHPLKVSLEDLYLSTTKKLSLSRNVLCSKCKGKGSKSGASMKCSGCQGSGMKVTIRQLGPSMIQQMQHVCNDCKGTGEMISDKDRCSQCKGEKVSPEKKVLEVFVEKGMQNGQKITFPGEADEAPDTITGDIVFILQQKEHPKFKRKGDDLFYEHTLCLTEALCGFQFVLTHLDGRQLLIKSNPGEVVKPDSFKAINDEGMPMYQRPFMKGKLYIHFTVEFPETLKPDQVKALEKVLPPKPSTQMSEMELDECEETTLHDVNIEEEMRRKQQSQQQEAYDEDDDEPHGAQRVQCAQQ

SEQ ID NO: 12554 - protein, 300 aa, Flaveria ramosissima
GEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGDDLFVEHTLSLTEALCGFQFILTHLDNRQLLIKSQPGEVVKPDQFKAINDEGMPMYQRPFMRGKLYLHFTVEFPDSLSPEQCKALEAVLPPKPSMQMTDMELDECEETTLHDVNIEEEMRRKQQAAQEAYDEDEDMHGGAQRVQCAQQ

SEQ ID NO: 12555 - protein, 336 aa, Platanus occidentalis
MGGGAGGHDPFDIFQSFFGGSPFGGGGSSRGRRQRRGEDVIHPLKVSLEDLYSGTSKKLSLSRNVICSKCNGKGSKSGASMKCSGCQGSGMKVSIRHLGPSMIQQMQHPCNECKGTGETINDKDRCPQCKGEKVVQEKKVLDVIVEKGMQNGQKITFPGEADESPDTITGDIVFVLQQKEHPKFKRKMDDLFVEHTLSLTEALCGFQFILTHLDNRQLLIKSNPGEVVKPDQYKAINDEGMPIYQRPFMKGKLYIHFTVEFPDSLSMEQCKALEAVLPPRTSMQLTDMELDECEETTLHDVNIEEEMRRKQAQAQEAYEEDEDSHGGGQRVQCAQQ

SEQ ID NO: 12556 - protein, 260 aa, Ocimum basilicum
SGASMKCSGCQGTGMKVSIRQLGPGMIQQMQHACNECKGTGETISDKDRCSQCKGEKVVQEKKVLEVHVEKGMQNGQKITFPGEADEAPDTVTGDIVFVLQQKEHPRFKRKGDDLFTEHSLSLAEALCGFQFVLTHLDGRQLLIKSQPGEVVKPNSYKAINDEGMPMYQRPFMKGKLYLHFNVDFPESLSPDQVAALEKILPPRPQSQLTDMEIDECEETTLHDVNMEEEMRRKAAQQQEAYEDDDDMHAGGQRVQCAQQ

SEQ ID NO: 12557 - protein, 257 aa, Helianthus annuus
MKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGDDLFFEHTLSLTEALCGFQFVLTHLDNRKLLIKSKPGEVVKPDQFKAINDEGMPMYQRPFMKGKLYIHFTVAFPDSLSPEQCKALEAVLPPKPSMDMTDMELDECEETTLHDVNIEEEMRRKQQQHAQEAYDEDEDMPGGAQRVQCAQQ

SEQ ID NO: 12558 - protein, 282 aa, Ambrosia trifida
DIFQSFFGGSPFGGGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGDDIFVEHTLSLTEALCGFQFILTHLDNRQLLIKSQPGEVVKPDSFKAINDEGMPMYQRPFMRGKLYIHFTVEFPESLSPEQCKALEAVAATQAFNADDRHGTGRM

SEQ ID NO: 12559 - protein, 303 aa, Helianthus annuus
RRGEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGDDIFVEHTLSLTEALCGFQFILTHLDNRQLLIKSQPGEVVKPDSFKAINDEGMPMYQRPFMRGKLYIHFTVEFPESLSPEQCKALEAVLPPKPSMQMTDMELDECEETTLHDVNIEEEMRRKQQQAAQEAYDEDEDMHGGAQRVQCAQQ

SEQ ID NO: 12560 - protein, 293 aa, Arnica chamissonis
GGGGGSSRGRRQRRGEDVVHPLKVSLEDLYNGTSKKLSLSRNVICSKCKGKGSKSGASMKCAGCQGSGMKVSIRHLGPSMIQQMQHACNECKGTGETIKDKDRCAQCKGEKVVQEKKVLEVHVEKGMQNGQKITFPGEADEAPDTVTGDIVFVLQQKEHPKFKRKGDDIFVEHTLSLTEALCGFQFILTHLDNRQLLIKSQPGEVVKPDQFKAINDEGMPMYQRPFMRGKLYIHFTVEFPDSISPEQCKALEAVLPPKPSMEMTDMELDECEETTLHDVNIEEEMRRKQQASS

SEQ ID NO: 12561 - protein, 290 aa, Cucurbita pepo
KVSLEDLYNGSSKKLSLSRNVICSKCKGKGSKSGASMKCPGYQGSGMKVSIRHLGPSMIQQMQHPCNECKGTGETINDKDRCSQCKGEKVVQEKKVLEVIVEKGMQNGQKITFPGEADEAPDTVTGDIVFVLQQKEHPKFKRKGDDLFVEHTLSLVESLCGFQFILTHLDGRQLLIKSHPGEVVKPDQFKAINDEGMPMYQRPFMKGKLYIHFSVDFPDSLNPEQCKALEGVLPPRSSVQLSDMELDECEETTLHDVNIEEEMRRKQVQEAYDEDEDMHGGAQRVQCAQQ

SEQ ID NO: 12562 - protein, 260 aa, Centaurea maculosa
SGASMKCAGCQGSGMKVSIRHLGPSMIQQMQHPCNECKGTGETINDKDRCPQCKGEKVVQEKKVLEVHVEKGMQNGQKITFPGEADEAPDTVTGDIVFVLQQKEHPKFKRKGDDLFVEHTLTLTEALCGFQFILTHMDTRQLLIKSQPGEVVKPDQFKAINDEGMPMYQRPFMRGKLYIHFTVEFPDSLSPEQCKALEGVLPARPSMQMTDMELDECEETTLHDVNIEEEMRRKQQAAQEAYDEDEDMHGGAQRVQCAQQ

SEQ ID NO: 12563 - protein, 188 aa, Cichorium intybus
MQNSQKITFPGEADEAPDTVTGDIVFVLQQKEHPKFKRKGDDLFVEHTLSLTEALCGFQFILTHLDNRQLLIKSQPGEVVKPDQFKAINDEGMPMYQRPFMRGKLYIHFTVEFPESLSPEQCKALEGVLPARPSMQMTDMELDECEETTLHDVNIEEEMRRKQQQAQEAYDEDEDMHGGAQRVQCAQQ

SEQ ID NO: 12564 - protein, 283 aa, Zingiber officinale
HEGTSKKLSLSRNAICQKCNGKGSKSGASMKCSGCQGSGMKVSIRQLGPGMIQQMQHPCNECKGTGETINEKDRCSKCKGEKVVQEKKVLEVVVEKGMQNGQKITFPGEADEAPDTVTGDIVFVLQEKEHPKFKRKGDDLFFEHTLSLTEALCGFHFVLTHLDNRQLLIKSHPGEVVKPDQFKAINDEGMPMYQRPFMKGKLYIHFTVEFPDSLTPDQCKALEAVLPPKPVSKMTDMELDECEETTLHDVNIDEEMRRKQTQEAYDEDEDAHGGAQRVQCAQQ

SEQ ID NO: 12565 - protein, 143 aa, Brassica napus
MSLASPIQCIRIINPSSSSSSSLTTWSSLRFSTSKPCVFIIRCSQAEGPLRRPSAPPTLREPTPPQKPVTPTPSSSPPPPQKAVAVDGKSVVTTVEFQRQKAKELQDYFKQKKLEAAGQGPFGSPKTRSPMEGGLCLVLRWGC

SEQ ID NO: 12566 - protein, 89 aa, Brassica juncea
MSLASPIQCIRIINPSSSSSSSYLTTRSSLRFSTSKPCVFIIRCSQAEGPLRRPSAPPTLREPSPPQKPVPPTPSSSPPPPPPLQKAVA

SEQ ID NO: 12567 - protein, 116 aa, Brassica juncea
MSLASPIQCIRILNPSSSSSTTSSSFRFSTIKPCVFVIRCSQAEGPLRRPSAPPTLREPSPPQKPVPPVPSSSPPPSPPLQKTVAVDGKGVVTVEFQRQKAKELQEYFKQKKLEAA

SEQ ID NO: 12568 - protein, 145 aa, Arabidopsis thaliana
MSVASPIQCIRILNPSSSSSSSTASSSFRFSTTTKPCVFIIRCSQTEGPLRRPSAPPTLREPQKPVPPSQPSSSPPPSPPPQKAVAVDGKSVTTVEFQRQKAKELQEYFKQKKLEAAGQGPFFGFQPKNEISNGRYLSYDLNSCI

SEQ ID NO: 12569 - protein, 91 aa, Brassica rapa
PASVFSSWVLIKTNAKMTKKRKLRKLVSINEFLKPAEGENYYRGGGRGGGRGRGRGGRDRGVVSGGGFDGYRSEAAPAIGDTAQFPSLGGK

SEQ ID NO: 12570 - protein, 100 aa, Brassica napus
MQQLSNKKSNDEIFIKLGSDKDKRKDDKEEKAKKAVSINEFLKPAEGENHYRGGGSGGGRGRGRGGRDRGGVSGGVFDGYRSEAAPAIGDTDQFPSLGGK

SEQ ID NO: 12571 - protein, 134 aa, Raphanus sativus
MTLDEYEKILEEKRKALQSQTTSERKVDTKVFESMQQLSNKKKSNDEIFIKLGSDKDKRKDDKEEKAKKAVSINEFLKPAEGENYYRGGGRGGRGRGRGGRDRGGASGGGFDGYRIEAAPSIGDTAQFPSLGGK

SEQ ID NO: 12572 - protein, 126 aa, Brassica juncea
KILEEKKKSLQSQTTSERKVDTKVFESMQQLSNKKKSNDEIFIKLGSDKDKRKDDKEEKAKKAVSINEFLKPAEGENYYRGGRGGGRGRGGRDRGGRVSSGGYGGSRSEAAPAIADTAQFPSLGGK

SEQ ID NO: 12573 - protein, 85 aa, Brassica nigra
FIKLGSDKDKRKDDKEEKAKKAVSINEFLKPAEGENYYRGGRGGGRGRGGRDRGGRVSSGGYGGSRSEAAPAIADTAQFPSLGGK

SEQ ID NO: 12574 - protein, 247 aa, Brassica napus
MVSRLKHDNLIQLVGYCVDEDLRVLAYEFATMGSLHDVLHGRKGVQGAQPGPTLDWITRVKIAVEAARGLEYLHEKVQPPVIHRDVRSSNVLLFEDYQAKIADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKPPAPAAPVPEP

SEQ ID NO: 12575 - protein, 255 aa, Brassica napus
MRRWICCGRISGDSDLSNDEQHLKTQWQQQQQPDAANQKLKPQPATKPDVPKEALPIEVPPLSVEEVKEKTDNFGSKSLIGEGSYGRVYYATLNDGKAVALKKLDVAPEAETNAEFLSQVSMVSRLKHDNLIQLVGYCVDEDLRVLAYEFATMGSLHDVLHGRKGVQGAQPGPTLDWITRVKIAVEAARGLEYLHEKVQPPVIHRDVRSSNVLLFETIRPKSLILISRIRLLITLLVFTLLECWEPLAITLQNML

SEQ ID NO: 12576 - protein, 206 aa, Brassica juncea
GRKGVQGAQPGPTLDWITRVKIAVEAARGLEYLHEKVQPPVIHRDVRSSNVLLFEDYQAKVADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKTPAPVPVTES

SEQ ID NO: 12577 - protein, 215 aa, Brassica napus
MGSLHDVLHGRKGVQGAQPGPTLDWITRVKIAVEAARGLEYLHEKVQPPVIHRDVRSSNVLLFEDYQAKVADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKTPAPVPVTEP

SEQ ID NO: 12578 - protein, 178 aa, Brassica rapa
GLEYLHEKVQPPVIHRDVRSSNVLLFEDYQAKVADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKTPAPVPVTEP

SEQ ID NO: 12579 - protein, 114 aa, Thellungiella halophila
HGRKGVQGAQPGPTLDWITRVKIAVEAARGLEYLHEKVQPPVIHRDIRSSNVLLFEDYQAKVADFNLPNQAPDNAARLHSTRVLGTFGYHAPEYAMTGQLTQNSDVYSFGVVLL

SEQ ID NO: 12580 - protein, 111 aa, Sarracenia psittacina
MTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKPPAPAPPEA

SEQ ID NO: 12581 - protein, 363 aa, Chelidonium majus
MRRWLCCNCEVEESRNPHEDEPLKSPGDHADGYLRKPPASANTDMKVPPPIEVPALPLDEVKEKTDNFGSKSLIGEGSYGRVYFATLDSGSAVAIKKLDVASEPESNVEFLTQVSMVSKLKHDNLVELLGYCVEGSLRVLAYEFATMGSLHDILHGRKGVQGAQPGPVLDWMQRVRIAVDAARGLEFLHEKLQPSIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYESEFRPNMSIVVKALQPLLTQKPPAPAPAPEI

SEQ ID NO: 12582 - protein, 364 aa, Euonymus alatus
MRKWLCCTCQVEESYPSNENEHLKSPNNRTDGYPKGSKVSAPVKPEVQKAVPPIEVPALSLEELKEKTENFGSKALIGEGSYGRVYYANLNNGKAVAVKKLDVASEPESNVEFLTQVSMVSRFKHDNLVELLGYCVEGNLRMLAYEFATMGSLHDILHGRKGVQGAQPGPTLDWMQRVRIAVDAAKGLEYLHEKVQPSVIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPRGVAKLAAVAALCVQYEAEFRPNMSIVVKALQPLLKPPAPAPAPET

SEQ ID NO: 12583 - protein, 366 aa, Tripterygium wilfordii
MRKWLCCTCQVEESYPSNENEHLKSPNNHTDGYPKGSKVSAPVKPEVQKAVPIIEVPALSLEELKEKTENFGSKALIGEGSYGRVYYANLDNGKAVAVKKLDVSSEPESNVEFLTQVSMVSRLKNDNIVELLGYCVEGNLRVLAYEFARMGSLHDILHGRKGVQGAQPGPTLDWMHRVRIAVDAARGLEYLHEKAQPPVIHRDIRSSNVLLFEDFKGKIADFNLSNQTPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKPPAPAPTPAPET

SEQ ID NO: 12584 - protein, 244 aa, Cleome spinosa
MVSRLKHENLIQLLGYCVDVNLRVLAYEFATMGSLHDILHGRKGVQGAQPGPTLDWITRVRIAVEAARGLEYLHEKAQSPVIHRDIRSSNILLFEDFKAKIADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYEAEFRPNMSIVVKALQPLLKPPAPSPES

SEQ ID NO: 12585 - protein, 363 aa, Cucumis melo
MRRWLCCTCQVEEAYPSAESEHLKSPRSYGDGHVQRKEAAPVKPEAPKTPPPIEVPALSLEELKEKTDNFGSKALIGEGSYGRVYYASLNDGKAVAVKKLDVSSEPDSSVDFLTQVSTVSRLKHENFVELHGYCVEGNLRVLAYEFATMGSLHDILHGRKGVQGAQPGPVLDWMQRVRIAVDAARGLEYLHEKVQPSIIHRDVRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALQPLLKPPAPAPVVEP

SEQ ID NO: 12586 - protein, 365 aa, Tropaeolum majus
MRKWLCCTCHVEESYPPIENEHLKSPRRQAEDGRPRDSKVVAPVKSEVQKAPPPIEVPPLSLDELKQYTDNFGSKALIGEGSYGRVYYANFNNEKAMAVKKLDVSAEPESNHEFLTQVSIVSKMKHANLVELLGYCVEGNLRVLAYEFATMGSLHDILHGRKGVQGAQPGPTLDWMQRVRIAVDAARGLEYLHEKVQPPIIHRDVRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKSPAPAVAPES

SEQ ID NO: 12587 - protein, 171 aa, Cajanus cajan
EKVQPAIIHRDIRSSNVLIFEDYKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKSPAAPAPES

SEQ ID NO: 12588 - protein, 217 aa, Cucurbita pepo
MGSLHDVLHGRKGVQGAQPGPVLDWLQRVRIAVDAAKGLEYLHEKVQPAIIHRDIRSSNVLLFEDFKAKVADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYESEFRPNMSIVVKALQPLLKPPAPTGPPAPES

SEQ ID NO: 12589 - protein, 245 aa, Cannabis sativa
MVSRLKQENLVELLGYCVEGNLRVLAYEFATMGSLHDILHGRKGVQGAQPGPTLDWMQRVRIAVDAARGLEYLHEKVQPSIIHRDIRSSNVLLFEDFKAKVADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKPPAPAPDAS

SEQ ID NO: 12590 - protein, 105 aa, Brassica napus
QVSMVSRLKHENFIQLVGYCVDENLRVLAYEFATMGSLHDVLHGRKGVQGAQPGPTLDWITRVKIAVEAARGLEYLHEKVQPPVIHRDVRSSNVLLFVRLSSKSC

SEQ ID NO: 12591 - protein, 364 aa, Euonymus alatus
MRKWLCCTSQVEESYPKNENQHLRSRNNHTDGYPKGSKVPAPVKPEVQKAVPLIEVPALSLEELKEKTENFGSKALIGEGSYGRVYYANLNNGKAVAVKKLDVSSEPESNVEFLSQVSMVSRLKHDNLVELLGYCVEGNLRMLAYEFARMGSLHDILHGRKGVQGAQPGPTLDWIQRVRIAVDAARGLEYLHEKVQPLVIHRDIRSSNVLVFEDFKAKIADFNLSNQAPDMASRLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKPPALAPPPAP

SEQ ID NO: 12592 - protein, 190 aa, Euonymus alatus
MQRVRIAVDAAKGLEYLHEKVQPSVIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPRGVAKLAAVAALCVQYEAEFRPNMSIVVKALQPLLKSPAPAPAPET

SEQ ID NO: 12593 - protein, 363 aa, Flaveria ramosissima
MRWFCCTCQVEEPNPSNDNEPVKNPSDYLDVHQKGPKGPPIKSEVQKAVPPIEVPALSLDELKEKTDDFGSTALIGEGSYGRVYFATLENGKTVAVKKLDVSTEVESNDEFLTQVSMFSNLKHENLIELLGYCVEGDVRVLAYEFATMGSLHDILHGRKGVQGAQPGPVLDWTQRVKIAVDAARGLEYLHEKVQPSIIHRDIRSSNVLLFEDLKAKIADFNLSNQSPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLKASAPPPPPEEE

SEQ ID NO: 12594 - protein, 213 aa, Sarracenia psittacina
NVEFLTQVSMVSRLKHENVIELLGYCVEGNIRVLAYKYATMGSLHDILHGRKGVEGAQPGPVLNWMQRVRIAVDTARGLEYLHEKVQPSIIHRDIRSSNVLLFENYAAKIADFNLSNQAPDMAARLHSTRVLGTFGYHAPEYAMTGQLTQKSDVYSFGVVLLELLTGRKPVDHTMPRGQQSLVTWATPRLGEDKVKQCVDPKAQGRVSSQRSR

SEQ ID NO: 12595 - protein, 362 aa, Trigonella foenum-graecum
MRRWLCCTCQVEESYPSHENEHLKSPRSFGDGNPKGSRVAAPIKPETQKAPPPIEVPALSLDELKEKTDNFGSKALIGEGSYGRVYYATLNNGKAVAVKKLDVSSEPESNNEFLTQVSMVSRLKNENFVELHGYCVEGNLRVLAYEFATMGSLHDILHGRKGVQGAQPGPTLNWMQRVRIAVDAARGLEFLHEKVQPSIIHRDIRSSNVLIFEDYRAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKAPAPAPET

SEQ ID NO: 12596 - protein, 365 aa, Citrullus lanatus
MRRWLCCTCQVEEAYPSAESEHLKSPRSYGDGHHQRSSKEATPVKSEPPKTPPPIEVPALSLEELKEKTDNFGSKALIGEGSYGRVYYASLNDGKAVAVKKLDVSSEPDSSVDFLTQVSTVSRLKHENFVELHGYCVEGNFRVLAYEFATMGSLHDILHGRKGVQGAQPGPVLDWMQRVRIAVDAARGLEYLHEKVQPSIIHRDVRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALQPLLKPPAPAPAAEP

SEQ ID NO: 12597 - protein, 366 aa, Theobroma cacao
MRRWLCCSCQVEENYQSHENELLKSPKHHTDGHQKNSKVAAPAKLEVQKSAPPIEVPALSLEELKEKTDNFGSKALIGEGSYGRVYYANLNNGKAVAVKKLDVSSEPESNVEFLTQVSMVSRLKHDNLVELQGYCVEGNLRVLAYEFATMGSLHDILHGRKGVQGAQPGPVLDWMQRVRIAVDAARGLEYLHEKVQPSVIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKAPAPAPAPAPET

SEQ ID NO: 12598 - protein, 279 aa, Manihot esculenta
NLDNGKAVAVKKLDVASEQESNIEFLTQVSMVSKLKNENVVELLGYCVEGNLRVLAYEFATMGSLHDILHGRKGVQGAQPGPTLDWMQRVRIAVDAARGLEYLHEKVQPAIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKAPAPAPAPPPPES

SEQ ID NO: 12599 - protein, 368 aa, Ricinus communis
MRRWLCCTCQVEESYPSRENDHLRSPKHYADGNPVKGSKVSAPVRSEVQKEAPPIEVPALSLEELKEKTDNFGSKALIGEGSYGRVYYANLDNGKAVAVKKLDVASEQESNVEFLTQVSMVSRLKHDNVVELLGYCVEGNLRVLAYEFATMGSLHDILHGRKGVQGAQPGPTLDWMQRVKIAVDAARGLEYLHEKVQPAIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYEAEFRPNMSIVVKALQPLLKAPAPAPAPPLPET

SEQ ID NO: 12600 - protein, 362 aa, Castanea mollissima
MRRWLCCTCQAEEAYQSTENERLKSPKNYADGHLKASRVAAPVKPEVQKPAPPIEVPALSLDELKEKTDNFGSKALIGEGSYGRVYFANLSNGKAVAVKKLDVSSEPDTDSDFLTQVSVVSRLKHDNLVELLGYCVEGNLRVLAYEFATMGSLHDILHGRKGVQGAQPGPTLDWMQRVRIAVDAARGLEYLHEKVQPSIIHRDIRSSNVLLFEDFKAKVADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKPIAPAPET

SEQ ID NO: 12601 - protein, 363 aa, Cucumis sativus
MRRWLCCTCQIEEAYPSAESEHLKSPRSYGDGHVQRKEAATFKSEAPKTPPPIEVPALSLEELKEKTDNFGSKALIGEGSYGRVYYASLNDGKAVAVKKLDVSSEPDSSVDFLTQVSTVSRLKHENFVELHGYCVEGNLRVLAYEFATMGSLHDILHGRKGVQGAQPGPVLDWMQRVRIAVDAARGLEYLHEKVQPSIIHRDVRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALQPLLKPPAPAPAVEP

SEQ ID NO: 12602 - protein, 362 aa, Actinidia deliciosa
MRRWLCCTCQVEESYPSTDHEPFKSPRNHGDGHYKGSKASAPVKAEAQKTVPPIDVPALPLDELKEKTDNFGSKALIGEGSYGRVYYANLNNGKAVAVKKMDVSAEPESNVDFLTQVSMVSKLKHENLVELLSYCVEGNFRVLAYEFATMGSLHDILHGRKGVQGAQPGPVLDWIQRVRIAVDAARGLEYLHEKVQPSVIHRDIRSSNVLLFEDFKAKVADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKAPAPAPEI

SEQ ID NO: 12603 - protein, 362 aa, Quercus alba
MRRWLCCTCQSEEAYQSTENERLKSPKNYADGHLKASRVAAPVKPEVQKPAPTIEVPALSLDELKEKTDNFGSKALIGEGSYGRVYFANLSNGKAVAVKKLDVSSEPDTDSDFLTQVSVVSRLKHENLVELLGYCVEGNLRVLAYEFATMGSLHDILHGRKGVQGAQPGPTLDWMQRVRIAVDAARGLEYLHEKVQPSIIHRDIRSSNVLLFEDFKAKVADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKPIAPAPET

SEQ ID NO: 12604 - protein, 172 aa, Arachis hypogaea
MRRWLCCTCQVEESYPSHESEHLKSPRNYGDGNQKGSKASAPVKSEPHKAPPPIEVPALSLEELKEKTENFGSKALIGEGSYGRVYYATLNDGKTVAVEKLDVSSEPETNNELLTQVSMVSRLKNDNFVELQGYCVEGNLRLLAYEYATMGSLHDILHGRKGGSRGTTRANS

SEQ ID NO: 12605 - protein, 366 aa, Citrullus lanatus
MRKWLCCFFQVEETNQSTENEHLKGPSNFGDGHLNDSKAPAPVKAEAQKAALPIEVPALSLEELKEKTDNFGSKALIGEGSYGRVYYATLNNGKNVAVKKLDVSSEPDSNVEFLTQVSTVSRLKHENLVELLGYCVEGNLRVLAYEYATMGSLHDVLHGRKGVQGAQPGPVLDWMQRVRIAVDSAKGLEYLHEKVQPAIIHRDIRSSNVLLFEDFKAKVADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALQPLLKPPAPTGPPAPES

SEQ ID NO: 12606 - protein, 257 aa, Persea americana
EFLTQVSIVSRLKHENLVELLGYCVEGNERVLGYEFATMGSLHDILHGRKGVQGAQPGPTLDWMQRVRIAVDGAKGLEYLHEKVQPSVIHRDVRSSNVLLFEDFRAKIADFNISNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYESEFRPNMSIVVKALQPLLTQKPPAPKPDPAPET

SEQ ID NO: 12607 - protein, 366 aa, Cucumis melo
MRKWLCCFCQVEETNQSTENEHLKNPSNFGDGHLRDSKVPALVKAEAQKAALPIEVPTLSLEELKEKTDNFGSKALIGEGSYGRVYYATLNNGKNVAVKKLDVSSEPDSNVEFLTQVSTVSRLKHENLVELLGYCVEGNLRVLAYEYATMGSLHDVLHGRKGVQGAQPGPVLDWMQRVRIAVDSAKGLEYLHEKVQPAIIHRDIRSSNVLLFEDFKAKVADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALQPLLKPPAPTGPPAPES

SEQ ID NO: 12608 - protein, 363 aa, Unknown
  Sequence found in Organisms: Citrus sinensis, Citrus clementina
MRRWLCCTCQVEESYPSHENERLKSPKNYPDGHHKKVPAPVKPEVQKAAPPIEVPALPLDELKEKTDNFGSKALIGEGSYGRVYYANLENGKAVAVKKLDVSSEPESNVEFLTQVSVVSRLKHENLVELLGYCVEGNLRVLAYEFATMGSLHDILHGRKGVQGAQPGPVLDWMTRVRIAVDAARGLEYLHEKVQPSIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKSPPPAAPVSET

SEQ ID NO: 12609 - protein, 229 aa, Linum usitatissimum
AGNLRVLAYEFATMGSLHDILHGRKGVQGAQPGPVLDWMQRVRIAVDAARGLEYLHEKVQPSIIHRDVRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYESEFRPNMSIVVKALQPLLKSQVPAAAAPES

SEQ ID NO: 12610 - protein, 259 aa, Citrus sinensis
ICFCPAILYQVSVVSRLKHENLVELLGYCVEGNLRVLAYEFATMGSLHDILHGRKGVQGAQPGPVLDWMTRVRIAVDAARGLEYLHEKVQPSIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKSPPPAAPVSET

SEQ ID NO: 12611 - protein, 336 aa, Ambrosia trifida
MIMLMDSKRTEYNRKKNLMQQKEVPTIEVPALSLDELKEKTENFGSKALIGEGSYGRVYFANLDNGKSVAVKKLDVSTEAESDNEFLTQVSMVSKLKHENFVELCGYCVEGNTRVLAYEFATMGSLHDILHGRKGVQGAQPGPVLDWMQRVRIAVDAAKGLDYLHEKVQPSIIHRDIRSSNVLLFEDLRAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKAVAKLAAVAALCVQYESEFRPNMSIVVKALQPLLRAPAPAAPEV

SEQ ID NO: 12612 - protein, 362 aa, Ambrosia trifida
MRRWFCCTCQVEESYPSNDNGLVKNHNDHVNGQQKDRVQPKEKFDAQKEVPTIEVPALSLDELKEKTENFGSKALIGEGSYGRVYFANLDNGKSVAVKKLDVSTEAESDNEFLTQVSMVSILKHENFVELCGYCVEGNTRVLAYEFATMGSLHDILHGRKGVQGAQPGPVLDWMQRVRIAVDAAKGLDYLHEKVQPSIIHRDIRSSNVLLFEDLRAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKAVAKLAAVAALCVQYESEFRPNMSIVVKALQPLLRAPAPAAPEV

SEQ ID NO: 12613 - protein, 365 aa, Ambrosia trifida
MGWFCCTCLVEESNPTNDNEPVKDQPDYLDGHQKGPKEPPVKSAVQKAVLPMEVPALSLEELKEKTDDFGSKALIGEGSYGRVYFATLDNGKSVAVKKLDVSTEVESNDEFLTQVSMFSNLKHENLIELLGYYVEGDIRVLAYEFATMGSLHDILHGRKGVQGAQPGPVLDWTQRVKIAVDAARGLEYLHEKVQPSIIHRDIRSSNVLLFEDLKAKIADFNLSNQSPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLKTSAPPPPPPPEEE

SEQ ID NO: 12614 - protein, 362 aa, Flaveria ramosissima
MRWFCCTCQVEEPNPSNDNEPVKNPPDYLDGHQKGPKGPPIKSEVQKAVPPIEVPALSLDELKEKTDDFGSSALIGEGSYGRVYFATLDNGKTVAVKKLDVSTEVESNDEFLTQVSMFSNLKHENLIELLGYCVEGDVRVLAYEFATMGSLHDILHGRKGVQGAQPGPVLDWTQRVKIAVDAARGLEYLHEKVQPSIIHRDIRSSNVLLFEDLKAKIADFNLSNQSPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLKASAPPPPEEE

SEQ ID NO: 12615 - protein, 363 aa, Flaveria ramosissima
GGLLYLSSRRRLTRTNRQYEPVEESLRLLGCAPKGSKRNLPIKSEVQKAVPPIEVPALSLDELKEKTDDFGSTALIGEGSYGRVYFATLENGKTVAVKKLDVSTEVESNDEFLTQVSMFSNLKHENLIELLGYCVEGDVRVLAYEFATMGSLHDILHGRKGVQGAQPGPVLDWTQRVKIAVDAARGLEYLHEKVQPSIIHRDIRSSNVLLFEDLKAKIADFNLSNQSPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLKASAPPPPEEE

SEQ ID NO: 12616 - protein, 244 aa, Utricularia gibba
MVSRLRHENLVELLGYCVDGNIRVLAYEFATMGSLHDILHGRKGVQGAQPGPVLDWMQRVRIAVDAARGLEYLHEKVQPSIIHRDIRSSNVLLFEDYKAKVADFNISNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPRGVAKLAAVAALCVQYESEFRPNMSIVVKALQPLLRPTAPAPEA

SEQ ID NO: 12617 - protein, 368 aa, Manihot esculenta
MRRWLCCTCQAEEAYPSHENEHLRSPKNHTEGNNPMKGSKVSAPVRAEVQKEAPPIDVPALSLDELKEKTDNFGSKALIGEGSYGRVYYANLDNGKAVAVKKLDVASEQESNVEFLTQVSMVSRLKHEHVVELLGYCVDGNIRVLTYEFATMGSLHDILHGRKGVQGAQPGPTLDWMQRVRIAVDAARGLEYLHEKVQPPIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKAPAAAPPPPAES

SEQ ID NO: 12618 - protein, 364 aa, Gossypium hirsutum
MRRWLCCSCQAEESYQAHENEHLKAPKDHTDGNHRNSRVAAPVKPEVQKSPPPIEVPALSLEELKEKTDNFGSKALIGEGSYGRVYYASLNNGKAVAVKKLDVSTESESNVEFLTQVSMVSRLKHDNFVELQGYCVEGNLRVLAYEFATMGSLHDILHGRKGVQGAQPGPVLDWMQRVRIAVDAARGLEYLHEKVQPSIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLKAPVPVPALET

SEQ ID NO: 12619 - protein, 362 aa, Vitis vinifera
MRRWLCCTCHVEEPYQSNESELLKSPRNHTDGNPKGSKVSAPVRSEVQKTAPPIEVPELSLEELKEKTDNFGSKALIGEGSYGRVYYASLNNGKAVAVKKLDVSSEPETPVEFLTQVSMVSRLKHENLVELLGYCVDGNLRVLAYEFATMGSLHDILHGRKGVQGAQPGPVLDWMQRVRIAVDAARGLEYLHEKVQPSIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKAAAPAPEV

SEQ ID NO: 12620 - protein, 137 aa, Ipomoea nil
PDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMTIVVKALQPLLKSSAPAPESPEI

SEQ ID NO: 12621 - protein, 363 aa, Populus trichocarpa
MRRWLCCTCQVEESYPPYESERLRSPRNYGDGYPKGSKVAAPVKAELQKEAPPIEVPALSLEELKEKTDNFGSKALIGEGSYGRVYYASLENGKAVAVKKLDVASEPETNFEFLTQVSMVSRLKNENVVELLGYCVEGNLRVLAYEFATMGSLHDILHGRKGVQGAQPGPVLDWIQRVKIAVDAARGLEYLHEKLQPAIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKMAAVAALCVQYESEFRPNMSIVVKALQPLLKSVAPAAPET

SEQ ID NO: 12622 - protein, 136 aa, Senecio madagascariensis
GSPGLQATRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMTIVVKALQPLLKASAPAVPVDAEV

SEQ ID NO: 12623 - protein, 365 aa, Helianthus annuus
MLRWCCCTCEVQESNPSNENEPIKDSTDYLDGHQQDLKGPPIKAGAPKAVPPIQVPALSLEELKEKTDDFGSTALIGEGSYGRVYFATLNNGKSVAVKKLDVSTEVESNDEFLTQVSMFSNLKHENLIELLGYYVEGDVRVLAYEFATMGSLHDILHGRKGVQGAQPGPVLDWTQRVKIAVDAARGLEYLHEKVQPSIIHRDIRSSNVLLFEDLKAKIADFNLSNQSPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLKTSAPPPPPPEEE

SEQ ID NO: 12624 - protein, 362 aa, Helianthus annuus
MRRWLCCTCQVEESYPSNDNGVVKSHNDHVDGQQKDRSQPKEKFDAQKEVPTIEVPALSLDELKEKTENFGSKALIGEGSYGRVYFAELNNGKSVAVKKLDVSTEAESNNEFLSQVSMVSKLKHENFVELCGYCVEGNTRVLAYEFATMGSLHDILHGRKGVQGAQPGPVLDWMQRVRIAVDAAKGLDYLHEKVQPSIIHRDIRSSNVLLFEDLRAKIADFNISNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKAVAKLAAVAALCVQYESEFRPNMSIVVKALQPLLRAPAPAAPEV

SEQ ID NO: 12625 - protein, 250 aa, Ambrosia trifida
MFSNLKHENLIELLGYYVEGDIRVLAYEFATMGSLHDILHGRKGVQGAQPGPVLDWTQRVKIAVDAARGLEYLHEKVQPSIIHRDIRSSNVLLFEDLKAKIADFNLSNQSPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLKTSAPPPPPPPPEEE

SEQ ID NO: 12626 - protein, 199 aa, Linum usitatissimum
GPVLDWIQRVRIAVDAARGLEYLHEKVQPSIIHRDVRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYESEFRPNMSIVVKALQPLLKSQVPSAVAAAPES

SEQ ID NO: 12627 - protein, 187 aa, Linum usitatissimum
AVDAARGLEYLHEKVQPSIIHRDVRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYESEFRPNMSIVVKALQPLLKSQVPSAVAAAPES

SEQ ID NO: 12628 - protein, 367 aa, Tropaeolum majus
MRKWFCCTCQVEESYPSIENEHLKSPRNHADGYQRGSKVAAPLKPEAPKTPPPIEVPALSLDELKEKTDNFGSKALIGEGSYGRVYYANLNDDKAVAVKKLDVAAEPETNVEFLTQVSMVSRLKHDNLVELLGYCVEGNLRVLAYEFATMGSLHDILHGRKGVQGAQPGPTLDWMQRVRIAVDAARGLEYLHEKVQSPIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKAPAQAPVVAAPET

SEQ ID NO: 12629 - protein, 312 aa, Cucumis sativus
MRKWLCCFCQVEETNQSTENEHLKSPSNFGDGHLRASKVPAVVKAEAQKAALPIEVPTLSLEELKEKTDNFGSKALIGEGSYGRVYYATLNNGKNVAVKKLDVSSEPDSNVEFLTQVSTVSRLKHENLVELLGYCVEGNIRVLAYEYATMGSLHDVLHGRKGVQGAQPGPVLDWMQRVRIAVDSAKGLEYLHEKVQPAIIHRDIRSSNVLLFEDFKAKVADFNLSNQAPDMAARLHSTRVLGTFGYHAPEYAMTGQLTQKSDVYSFGVVLLELLTGRETCRSHDASRTAKFSHLGYSKAKRGQSKAMCRSKT

SEQ ID NO: 12630 - protein, 362 aa, Ambrosia trifida
MRRWLCCTCQVEESHPSNDNGLMKSHSDHVDGHQKDKVPPPAKFDAQKPVPTIEVPSLSLDELKEKTENFGSKALIGEGSYGRVYFATLNNGKSVAVKKLDVSTEAESDNEFLTQVAMVSTLKHENLVELCGYCVDGNTRVLAYEFATMGSLHDILHGRKGVQGAQPGPVLDWMQRVKIAVDAAKGLDYLHEKVQPSIIHRDVRSSNVLLFEDLRAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKAVAKLAAVAALCVQYEAEFRPNMSIVVKALQPLLRAPAPAAPEV

SEQ ID NO: 12631 - protein, 76 aa, Ambrosia trifida
IAHCLSVFSPISKQIPKHTTQAYLLPFGYFIRLGKPRADDGLILRKRDRMRRWLCCTCQVEESYPSNDNGLVKNPQ

SEQ ID NO: 12632 - protein, 362 aa, Arnica chamissonis
MRRWLCCTCQVEESYHTNDNGLVKSHSDNVDGQQKDKVPPPVKFDSQKAVPTIEVPALSLDELKEKTENFGSKSLIGEGSYGRVYFADLNNGKSVAVKKLDVSTEAESNNEFLTQVSMVSNLKHENFVELCGYCVEGNTRVLAYEFATMGSLHDILHGRKGVQGAQPGPVLDWMQRVRIAVDAAKGLDYLHEKVQPSIIHRDIRSSNVLLFEDLRAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKAVAKLAAVAALCVQYESEFRPNMSIVVKALQPLLRAPAPTTPEV

SEQ ID NO: 12633 - protein, 362 aa, Arnica chamissonis
MRRWLCCTCQVEESYPSNENGLIKSHSDHGDGQQKDKVPPPVKFDAQKAVPTIEVPALSLDELKEKTENFGSKALIGEGSYGRVYFANLNNGKSVAVKKLDVSTEAESDNEFLTQVSMVSTLKHDNFVELCGYCVEGNTRVLAYEFATMGSLHDILHGRKGVQGAQPGPVLDWMQRVKIAVDAAKGLDYLHEKVQPSIIHRDIRSSNVLLFEDLRAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKAVAKLAAVAALCVQYESEFRPNMSIVVKALQPLLRAPAPTAPEV

SEQ ID NO: 12634 - protein, 366 aa, Cirsium arvense
MRRWLCCTCQVEESAPSNDNEFVKNSSDHGDGHQKGSKGSPIKSEVQKAVPPMEVPALPLEELKEKTDDFGSKALIGEGSYGRVYFATLNNGKNVAVKKLDVSTEAESDNEFLTQVSMFSTLKHENLIELFGYCVEGNVRVLAYEFATMGSLHDILHGRKGVQGAQPGPVLDWMQRVKIAVDAARGLEYLHEKAQPSIIHRDIRSSNVLLFEDLKAKIADFNLSNQSPDMAARLHSTRVLGTFGYHAPEYAMTGQLTQKSDVYSFGVVLLELLTGRKPVDHTMPRGQQSLVTWATPRLSEDKVKQCVDPKLKGEYPSKAVAKLAAVAALCVQYESEFRPNMSIVVKALQPLLKASSAPAPASAEVV

SEQ ID NO: 12635 - protein, 362 aa, Flaveria ramosissima
MRRWLCCTCQVEESYPSNDNGFVKSHNDHIDGHQKDKVPPPAKFDTQKAVPTIEVPALSLDELKEKTENFGSKALIGEGSYGRVYFANLDNGKSVAVKKLDVSTEAESDNEFLTQVSMVSKLKHENFVELCGYCVEGNTRVLAYEFATMGSLHDILHGRKGVQGAQPGPVLDWMQRVRIAVDAAKGLEYLHEKFQPSIIHRDIRSSNVLLFEDLRAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKAVAKLAAVAALCVQYESEFRPNMSIVVKALQPLLRAPAPTAPEV

SEQ ID NO: 12636 - protein, 74 aa, Flaveria ramosissima
MRRWLCCTCQVEESYPSNGNGFVKSHNDHIDGHQKDKVPPPAKFDTQKAVPTIEVPALSLDELKEKPRILDQRH

SEQ ID NO: 12637 - protein, 363 aa, Lippia dulcis
MRRWLCCTCQVEESYQPHENEHLKSPRNQAEGIQRGSKASAPVKPEVQQKAVPPIEVPSLSLEELKEKTDNFGSKALIGEGSYGRVYFAQLNSGDEVAVKKLDVSSEPDSNVEFLTQVSMVSRLKHENLVELLGYCVDGNLRVLAYEFATMGSLHDILHGRKGVQGAQPGPVLDWMQRVRIAVDAARGLEYLHEKVQPSIIHRDIRSSNVLLFEDYKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKSTVPAPEN

SEQ ID NO: 12638 - protein, 173 aa, Scabiosa columbaria
HEKVQPSIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKVYPPKAVAKMAAVAALCVQYESEFRPNMSIVVKALQPLLKAPAPPPPEAEA

SEQ ID NO: 12639 - protein, 157 aa, Thalictrum flavum
MCFGLNDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCVDPKLKGDYPPKGVAKLAAVAALCVQYESEFRPNMSIVVKALQPLLNQKPPAPAPET

SEQ ID NO: 12640 - protein, 363 aa, Aquilegia formosa
MRRWLCCTCHVEESYHPAEDEPLKSPRNHADAYQKGSKLTPVNAEAHKVPPTVEVPDLPLDELKEKTDNFGSKSLIGEGSYGRVYYANLDSGKAVAIKKLDVSSETDSNYEFLSQVSMVSRLKHDNLVELLGYCVEGNIRVLAYEFATMGSLHDILHGRKGVQGAQPGPVLDWMQRVRIAVEAARGLEYLHERIQPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCVDPKLKGDYPPKGVAKLAAVAALCVQYESEFRPNMSIVVKALQPLLNQKPPAPAPET

SEQ ID NO: 12641 - protein, 364 aa, Artemisia annua
MRRWLCCTCQVEESYPSNDNGLVKSHSGGHADGLHNTKVQPSVKVDPNKAVPTIEVPALSLDELKEKTENFGSKALIGEGSYGRVYFANLNNGKSVAVKKLDVSTEAESNNEFLTQVAMVSTLKHDNLVELCGYCVEGNTRVLAYEFATMGSLHDILHGRKGVQGAQPGPVLDWMQRVKIAVDAAKGLDYLHEKVQPSIIHRDIRSSNVLLFEDLRAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKAVAKLAAVAALCVQYEAEFRPNMSIVVKALQPLLRAPAPAAAPEV

SEQ ID NO: 12642 - protein, 317 aa, Artemisia annua
GVPALSLEELKEKTEDFGSKALIGEGSYGRVYFATLNNGKTVAVKKLDVSTEAESNNEFLTQVSMFSNLKNDNLIELLGYCVEGDVRVLAYEFATMGSLHDILHGRKGVQGAQPGPVLDWMQRVRIAVDAARGLEYLHEKAQPSIIHRDIRSSNVLLFEDLKAKIADFNLSNQSPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLKATVPVPAPAEAEVEAEI

SEQ ID NO: 12643 - protein, 366 aa, Tragopogon dubius
MRRWLCCTCQVEESYPSNRNEPVKNPTDYTDGHQKGSKGSPIKPEVQKAAPPIEVPELSLEELKEKTDDFGSKALIGEGSYGRVYFATLNNGKTVAVKKLDVSTEAESNNDFLSQVSMFSTLKNDNLIELLGYCVEGNVRVLAYEFATMGSLHDILHGRKGVQGAQPGPVLDWMQRVKIAVDAARGLEYLHEKTQPSIIHRDIRSSNVLLFEDLKAKIADFNLSNQSPDMAARLHSTRVLGTFGYHAPEYAVTGQLTQKSDVYSFGVVLLELLTGRKPVDHTMPRGQQSLVTWATPRLSEDKVKQCIDPKLKGEYPPKAVAKLAAVAALCVQYESEFRPNMSIVVKALQPLLKASAPAAAPEVLTE

SEQ ID NO: 12644 - protein, 368 aa, Populus trichocarpa
MRRWLCCTCQVEESYQEHENERIRSTGNFGDGYPKGSKVSAPAKAEVQKEAPPVEVPVLSLEELKEKTDNFGSKALIGEGSYGRVYYANLENGKAVAIKKLDVASEPETNVEFLTQVSMVSRLKHENFVELLGYCVEGNLRVLAYEFATMGSLHDILHGRKGVQGAQPGPVLDWMQRVRIAVDAARGMEYLHEKVQPAVIHRDVRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKAPAVAVAPAPAPET

SEQ ID NO: 12645 - protein, 76 aa, Cucurbita pepo
MRRWLCCACQVEEPYPSAESEHLKSPGSYGDGGHQKVSKEPASHKSEAPKAPPPIDVPALSLEELKERLTTSGPRH

SEQ ID NO: 12646 - protein, 140 aa, Cucurbita pepo
QAPDMAARLHSTRVLGTFGYHAPEYAMSGQLTQKSDVYSFGVVLLELLTGRKPVDHTMPRGQQSLVTWATPRLSEDKVKQCVDPRLKGEYPPKGIAKLAAVAALCVQYESEFRPNMSIVVKALQPLLKPPAPTGPPAPVS

SEQ ID NO: 12647 - protein, 308 aa, Momordica charantia
VSGCNLKEMTDNFGSKALIGEGSYGRVYYANLNNGKNVTVKKLDVSSEPDSNIEFLTQVSTVSRLKHENLVELLGYCVEGNLRVLAYEFATMGSLHDVLHGRKGVQGAQPGPVLDWIQRVRIAVDAARGLEYLHEKVQPPIIHRDIRSSNVLLFEDFKAKVADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALQPLLKPVTPAGPPAPQS

SEQ ID NO: 12648 - protein, 368 aa, Gossypium hirsutum
MRRWLCCSCLVEDTYQSHENEHLRSPNYNTEGNQKNSKAAAPPKAEVQKSAPPIEVPALSLEELKEKTDNFGSKALIGEGSYGRVYYANLDNGKAVAVKKLDSSDAESNVEFLTQVSMVSGLKHDNFVELQGYCVEGNLRVLAYEFATMGSLHDVLHGRKGVQGAQPGPVLDWMQRVRIAVDAARGLEYLHEKVQPSIIHRDIRSSNVLLFEDFKAKIADFNLSNQSPDMAARLHSTRVLGTFGYHAPEYAMTGQLTQKSDVYSFGVVLLELLTGRKPVDHTMPRGQQSLVTWATPRLSEDKVKECVDPNLKGEYPPKGVAKLAAVAALCVQYEAEFRPNMGIVVKALQPLLKARSSTSTSTRVLKLR

SEQ ID NO: 12649 - protein, 363 aa, Prunus persica
MRKWLCCTCHVEESYPSNENEHLKSPKHYTDGNQKGNKVSAPVKSDVQKAPPPIEVPPLSLEELKEKTDNFGSKSLIGEGSYGRVYYASLNDGKAVAVKKLDVASEPESNGEFLTQVSMVSRLKHENLVELLGYCVDGSLRVLAYEFATMGSLHDILHGRKGVQGAQPGPTLDWLQRVRIAVDAARGLEYLHEKVQPAIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGDYPAKGVAKLAAVAALCVQYEAEFRPNMSIVVKALQPLLKLPPPQAPEP

SEQ ID NO: 12650 - protein, 362 aa, Ambrosia trifida
MRRWLCCSCQVEESYPSNDNGLTKSHSDHVDGHQRDKVPPPAKFDAQKPVPTIEVPALSLDELKEKTENFGSKALIGEGSYGRVYFATLNNGKSVAVKKLDVSTEAESDNEFLTQVAMVSTLKHENLVELCGYCVDGNTRVLAYEFATMGSLHDILHGRKGVQGAQPGPVLDWMQRVKIAVDAARGLDYLHEKVQPSIIHRDVRSSNVLLFEDLRAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKAVAKLAAVAALCVQYEAEFRPNMSIVVKALQPLLRAPAPVAPEV

SEQ ID NO: 12651 - protein, 136 aa, Brassica napus
MAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLRSATPAAAPSQEI

SEQ ID NO: 12652 - protein, 252 aa, Distylium racemosum
MRRWLCCTCSVDAAPEQPDTQYLNTMKAPANGNQGDSKATDGAKSGAPQKVPPIEASALLLEELKEATDNFGPKALIGEGSYGRVYYATLSNGSAAAIKKLDVSSQPEANSEFLAQVSMVSRLKHENVVELVGYCVEGNIRVLAYEFATMGSLHDILHGRKGVQGAQPGPILDWMQRVKIAVGAAKGLEYLHEKAQPHIIHRDIRSSNVYFLMTLKQKLLISIFLIKLLIWLLAFIQHVCWEHLAIMHQSML

SEQ ID NO: 12653 - protein, 372 aa, Euphorbia peplus
MRKWLCCTCQVEETYPTRENEHLRSPKHYTDGNPTKSSKFQAPVRTEVQKEAPPIEVAALSVEELKEKTDNFGSKALIGEGSYGRVYYANLDNGRAVAVKKLDVASEPETNVEFLTQVSMVSRLKNENVVELLGYCVEGNLRVLAYEFATMGSLHDILHGRKGVQGAQPGPTLDWMQRVRIAVDAARGLEYLHEKVQPAIIHRDIRSSNVLLFEEFKAKVADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKPPSNAAAAAAAAAASET

SEQ ID NO: 12654 - protein, 361 aa, Silene vulgaris
MRKWLCCTCNVEESYPSNEEPFQSPRNNIERTSKNTKVAAPVKEEVQKTAPTIEVPALSLDELKEKTDNFGSKSLIGEGSYGRVYYATMESGKAVAVKKLDVSQEPAESNVEFLTQVSKVSTLKHENFVELQGYCVEGNMRVLAYEFATMGSLHDILHGRKGVQGAQPGPVLDWMQRVRIAVDAAKGLEYLHEKVQPPIIHRDIRSSNVLLFEDFRAKIADFNLSNQAPDMAARLHSTRVLGTFGYHAPEYAMTGQLMQKSDVYSFGVVLLELLTGRKPVDHTMPRGQQSLVTWATPRLSEDKVKQCVDPRLKDYPAKGVAKLAAVAALCVQYESEFRPNMSIVVKALQPLLKTPAPAPES

SEQ ID NO: 12655 - protein, 365 aa, Eutrema halophilum
MRRWLCCACHVEEPYHSSENEHLRSPKHHNDYGLNKKPQVAVKPDALKEPPSIDVPALSLDELKEKTDNFGSKALIGEGSYGRAYYATLKDGKAVAVKKLDNSAEPESNVEFLTQVSRVSKLKHDNFVELFGYCVEGSFRILAYEFATMGSLHDILHGRKGVQGAQPGPTLDWIQRVRIAVDAARGLEYLHEKAQPGVIHRDIRSSNVLLFEDFKAKIADFNLSNQSPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLRSSTAAAVPSQET

SEQ ID NO: 12656 - protein, 365 aa, Eutrema parvulum
MRRWLCCACHVEEPYHSSENEHLRSPKRHNDYGHNKKPQVAVKPDALKEPPSIDVPALSLDELKEKTDNFGSKALIGEGSYGRAYYATLKDGKAVAVKKLDNSAEPESNVEFLTQVSRVSKLQHDNFIQLLGYCVEGNLRILAYEFATMGSLHDILHGRKGVQGAQPGPTLDWIQRVRIAVDAARGLEYLHEKVQPAVIHRDIRSSNVLLFEDFKAKIADFNLSNQSPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLRSSTPAALPSQET

SEQ ID NO: 12657 - protein, 364 aa, Valeriana officinalis
MRKWLCCTCQVEESYPLHGTELLKSPRNKIDGNHKGSKGSAPIRPDVQRAPPPIEVPSILLDELKEKTENFGSKALIGEGSYGRVYYATLSNEKAVAVKKLDVASEPESNFDFLSQVSTVSRLKHGNLVELLGYCVEGNLRVLAYEFATMGSLHDILHGRKGVQGAQPGPVLDWMQRVRIAVDAARGLEYLHEKVQPPVIHRDIRSSNVLLFEDFKAKIADFNVSNQAPDMAARLHSTRVLGTFGYHAPEYAMTGQLTQKSDVYSFGVVLLELLTGRKPVDHTMPRGQQSLVTWATPRLSEDKVKQCVDTKLKLYPPKAVAKMAAVAALCVQYESEFRPNMSIVVKALQPLLKAPAPPPEPETL

SEQ ID NO: 12658 - protein, 366 aa, Arabidopsis lyrata
MRRWLCCACHVEEPYHSSENEHLRSPKHHNDFGHHTRKPQAAVKPDALKEPPSIDVPALSLDELKEKTDNFGSKALIGEGSYGRAYYATLKDGKAVAVKKLDNSAEPESNVEFLTQVSRVSKLKHDNFVELFGYCVEGNFRILAYEFATMGSLHDILHGRKGVQGAQPGPTLDWIQRVRIAVDAARGLEYLHEKVQPAVIHRDIRSSNVLLFEDFKAKIADFNLSNQSPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLRSSTAAAVPVQET

SEQ ID NO: 12659 - protein, 366 aa, Arabidopsis thaliana
MRRWLCCACHVEEPYHSSENEHLRSPKHHNDFGHHTRKPQAAVKPDALKEPPSIDVPALSLDELKEKTDNFGSKSLIGEGSYGRAYYATLKDGKAVAVKKLDNAAEPESNVEFLTQVSRVSKLKHDNFVELFGYCVEGNFRILAYEFATMGSLHDILHGRKGVQGAQPGPTLDWIQRVRIAVDAARGLEYLHEKVQPAVIHRDIRSSNVLLFEDFKAKIADFNLSNQSPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLRSSTAAAVPVQEA

SEQ ID NO: 12660 - protein, 184 aa, Brassica juncea
VEAARGLEYLHEKSQPAVIHRDIRSSNVLLFEDYKAKIADFNLSNQAPDNAARLHSTRVLGTFGYHAPEYAMTGQLTQKSDVYSFGVVLLELLTGRKPVDHTMPRGQQSLVTWATPRLSEDKVKQCIDPKLKADYPPKAVAKLAAVAALCVQYESEFRPNMSIVVKALQPLLKLAAPAPSPPES

SEQ ID NO: 12661 - protein, 216 aa, Brassica juncea
GSLHDVLHGRKGVQGAQPGPALDWIQRVRIAVDAAKGLEYLHEKVQPAVIHRDVRSSNVLLFEEFKAKIADFNLSNQSPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLRSATPAAAPSQEI

SEQ ID NO: 12662 - protein, 363 aa, Brassica napus
MRRWLCCVCHVEEPYHSPENEHLRSPKDYNDKDKKPQAAVKPDVLKEPPAIDVPALSLDELKEKTDNFGSKVLIGEGSYGRAYYATLEDGKAVAIKKLDNAAEPESNFEFLTQVSRVSKLRNENFVQLFGYCVEGNLRILAYEFATMGSLHDVLHGRKGVQGAQPGPALDWIQRVRIAVDAAKGLEYLHEKVQPAVIHRDVRSSNVLLFEEFKAKIADFNLSNQSPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLRSATPAAAPSQEI

SEQ ID NO: 12663 - protein, 362 aa, Cichorium intybus
MRRWLCCTCQVEESYPSNENGFVKNHNDHTDGQHKDSKLPPPVKHEAQKTVPTIEVPSLSLDELKEKTENFGSKALIGEGSYGRVYFANLNNGKSVAVKKLDVSPEAESNTEFLTQVSMVSTLKHDNFVELCGYCVEGNNRVLAYEFATMGSLHDILHGRKGVQGAQPGPVLDWMQRVRIAVDAAKGLEYLHEKVQPSIIHRDIRSSNVLLFEDLRAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKAVAKLAAVAALCVQYESEFRPNMSIVVKALQPLLRAPPPAAEG

SEQ ID NO: 12664 - protein, 143 aa, Cycas rumphii
GSKDQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYEADFRPNMSIVVKALQPLLNPKPALASETQT

SEQ ID NO: 12665 - protein, 368 aa, Lactuca sativa
MRRWLCCTCQVEESYSSNHNDPIKNPTDYTDGHQKGQKESPIKPEVQKTAPPIEVPELSLEELKEKTDDFGSKALIGEGSYGRVYFATLNNGKTVAVKKLDVSTEAESNNEFLSQVSMFSMLKHENLIELLGYCVEGNVRVLAYEFATMGSLHDILHGRKGVQGAQPGPVIDWMQRVKIAVDAAKGLEYLHEKAQPCIIHRDIRSSNVLLFEDLKAKIADFYLSNQSPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALPPLLKASPPTAPENFTEMKS

SEQ ID NO: 12666 - protein, 366 aa, Sciadopitys verticillata
MRRWLCCTCSVDSSPEQHENQYLNATKAPTNGNQGDYKTSEGAKSGAPQKVAPIEAPSLSLEELKEVTDNFGPKALIGEGSYGRVYYATLNNGSAAAIKKLDVSSQPEANSEFLAQVSMVSRLKHDHVVELVGYCVEGNIRVLAYEFATMGSLHDILHGRKGVQGAQPGPVLDWMQRVKIAVGAAKGLEYLHEKAQPHIIHRDIRSSNVLLFDDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYEADFRPNMSIVVKALQPLLNPKPAAPPPEAQN

SEQ ID NO: 12667 - protein, 248 aa, Sequoia sempervirens
MVSRLKHEHVVELVGYCVEGNIRVLAYEFATMGSLHDILHGRKGVQGAQPGPVLDWMQRVKIAVGAAKGLEYLHEKAQPHIIHRDIRSSNVLLFDDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPSKSVAKLAAVAALCVQYEADFRPNMSIVVKALQPLLNPRPAAPAPEAQN

SEQ ID NO: 12668 - protein, 364 aa, Triphysaria pusilla
MRRWLCCTCQVEESYNANENEHLKSPTNHADGHQRGSKASVPVKNEVQKTVPPIEVPSLSLEELKEKTDNFGSKSLIGEGSYGRVYFAQLNDGSEVAVKKLDVSSEPDSNIEFLTQVSMVSKLKNDNFVELLGYCVDGNLRVLAYEFATMGSLHDILHGRKGVQGAQPGPVLDWMQRVRIAVDAARGLEYLHEKFQPSIIHRDIRSSNVLLFEDYKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLRSTVPAAAPEI

SEQ ID NO: 12669 - protein, 367 aa, Cirsium arvense
MRRWLCCTCQVEESVPSNDNEFVKNSTDHGDGHQKGSKGSPIKSEVQKAVPPMEVPALPLEELKEKTDDFGSKALIGEGSYGRVYFATLNNEKTVAVKKLDVSTEAESNNEFLTQVSMFSRLKHDNLIELLGYCVEGNVRVLAYEFATMGSLHDILHGRKGVQGAQPGPVLDWMQRVRIAVDAARGLEYLHEKAQPSIIHRDIRSSNVLLFEDMKAKIADFNLSNQSPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLKASSAPPPPPPADEV

SEQ ID NO: 12670 - protein, 366 aa, Cirsium arvense
MRRWLCCTCQVEEHYPPNDNGFVKNHSDHSDGQQKDSKATPPVKFDVHKAVPTIEVPALSLEELKEKTENFGSKALIGEGSYGRVYFATLDNGKTVAVKKLDISTEAESNNEFLTQVSMVSTLKHDNLVELCGYCVEGSTRVLAYEFATMGSLHDILHGRKGVQGAQPGPVLDWMQRVRIAVDAARGLDYLHEKVQPSIIHRDIRSSNVLLFEDLRAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKAVAKLAAVAALCVQYEAEFRPNMSIVVKALQPLLRAPAPPPAAAPEV

SEQ ID NO: 12671 - protein, 75 aa, Plantago ovata
MRRWLCCTCQVEESYHPSENEHLRSPHNHGDGNFKGSKVPAPVKHEAQKAVPPIEVPALSLEELKERPITLDQRH

SEQ ID NO: 12672 - protein, 110 aa, Cucurbita pepo
VQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALQPLLRPPAPAHAPEP

SEQ ID NO: 12673 - protein, 361 aa, Flaveria ramosissima
MRRWLCCTCQVEESYPSNEHGLIKSHSGHVDGHHKEKVPPPVKFDAPKAVPTIEVPALSLDELKEKTENFGSKALIGEGSYGRVYFANLNNGKSVAVKKLDVSTEAESDNEFLTQVSMVSTLKHDNLVELCGYCVEGNTRVLAYEFATMGSLHDILHGRKGVQGAQPGPVLDWMQRVRIAVDAAKGLDYLHEKVQPSIIHRDVRSSNVLLFEDLRAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKAVAKLAAVAALCVQYEAEFRPNMSIVVKALQPLLRAPAPAAAE

SEQ ID NO: 12674 - protein, 109 aa, Flaveria ramosissima
LHDILHGRKGVQGAQPGPVLDWTQRVKIAVDAARGLEYLHEKVQPSIIHRDIRSSNVLLFEVLKSQDCSFLIFQISHRTWLLVCILLVFWHLWLSCTRICNDGTVNTEE

SEQ ID NO: 12675 - protein, 116 aa, Lippia dulcis
VDGNLRVLAYEFATMGSLHDILHGRECKGHNPVLHLTGCNGLESLLMLPGVWSICMRRSSHQLFIEISDPAMYFFLKTTRPRLLTLTFQIKLLTWLPGFIQLEFWEPLVIMLQSMQ

SEQ ID NO: 12676 - protein, 359 aa, Silene vulgaris
MRKWLCCTSHVEESYPSKEELLKSPNNNAERPPNAKVAPPVKEEVQKTAPAIEVPALSLEELKEKTDNFGSKALIGEGSYGRVYYATLECGKAVAVKKLDISQEPESNVEFLTQVSRVSTLKHENFVELHGYCVEGNMRVLAYEFATMGSLHDILHGRKGVQGAQPGPVLDWMQRVRIAIDAARGLEYLHEKVQPPIIHRDIRSSNVLLFEDFKAKIADFNLSNQAPDMAARLHSTRVLGTFGYHAPEYAMTGQLMQKSDVYSFGVVLLELLTGRKPVDHTMPRGQQSLVTWATPRLSEDKVKQCVDPRLKDYPAKGVAKLAAVAALCVQYESEFRPNMSIVVKALQPLLKLPAPTPES

SEQ ID NO: 12677 - protein, 367 aa, Arabidopsis lyrata
MRRWLCCSCRVQESYPTAEHNRLKTPPTRHYDYGRNNKKAPAPVKPPVLKEPPPIDVPAMSLVELKEKTQNFGSKALIGEGSYGRVYYANFNDGKAVAVKKLDNSSEPETNVEFLTQVSKVSRLKSDNFVQLLGYCVEGNLRVLAYEFATMGSLHDILHGRKGVQGAQPGPTLEWMQRVRVAVDAAKGLEYLHEKVQPPVIHRDIRSSNVLIFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYEAEFRPNMSIVVKALQPLLRSATAVAPPTHQA

SEQ ID NO: 12678 - protein, 204 aa, Ocimum basilicum
GRKGVQGAQPGPTLDWMQRVRIAVDAARGLEYLHEKTQPSIIHRDIRSSNVLLFEDYKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKEYPPKGVAKLAAVAALCVQYEAEFRPNMSIVVKALQPLLKSTMPPPEAS

SEQ ID NO: 12679 - protein, 367 aa, Centaurea maculosa
MRRWLCCTCQVEERYPPNDNGLVKNHSDHSDGQQKDSKATPPVKFDVHKAVPKIEVPALSLDELKDKTENFGSKALIGEGSYGRVYFATLDNGKTVAVKKLDVSTEAESNNEFLTQVSMVSTLKHDNLVELCGYCVEGNTRVLAYEFATMGSLHDILHGRKGVQGAQPGPVLDWMQRVKIAVDAAKGLDYLHEKVQPSIIHRDIRSSNVLLFEDLRAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKAVAKLAAVAALCVQYEAEFRPNMSIVVKALQPLLRAPAAAPAAPAPEV

SEQ ID NO: 12680 - protein, 366 aa, Eucalyptus grandis
MRRWLCCTCQVEESYPSRDDELLKSPRHHADGYPKGSKASVPIKPEVQKAPPPIEVPALSLDELKEKTDNFGSKALIGEGSYGRVYYASLDSGKVVAVKKLDVSSEQESNIEFLTQVSVVSRLKHENFVELLGYCVEGNLRVLAYEFATMGSLHDVLHGRKGVQGAQPGPTLDWMQRVRIAVDAARGLEYLHEKVQPSIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGDYPPKAVAKLAAVAALCVQYEAEFRPNMSIVVKALQPLLKTAVPPAAPPSET

SEQ ID NO: 12681 - protein, 366 aa, Podocarpus macrophillus
MRRWLCCACAVDPAPEQPENQYLNATKPPANGNQGDFRASEGAKGGAPQKVPPIETPALSLDELKEATDNFGPKALIGEGSYGRVYYATLSDGSAAAIKKLDVSSQPEANSEFLAQVSMVSRLKHEHVVELVGYCVEGNLRVLAYEFATMGSLHDILHGRKGVQGAQPGPVLDWIQRVKIAVGAAKGLEYLHEKAQPHIIHRDIRSSNVLLFDDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPAKAVAKLAAVAALCVQYEADFRPNMSIVVKALQPLLNPKPAAPAPENQS

SEQ ID NO: 12682 - protein, 223 aa, Raphanus sativus
YEFATMGSLHDVLHGRKGVQGAQPGPTLEWMQRVRVAVDAAKGLEYLHEKVQPAVIHRDIRSSNVLLFEDFKAKIADYNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLRSSGTAAPPHNHQN

SEQ ID NO: 12683 - protein, 366 aa, Helianthus annuus
MRRWLCCTCQVEESYPSNENGLTKSHSANADGHQKDKVPPPVKFDAQKPVPTIEVPALSLDELKEKTENFGSKALIGEGSYGRVYFANLNNGKSVAVKKLDVSTEAESDNEFLTQVAMVSTLKHENLVELCGYCVEGNTRVLAYEFATMGSLHDILHGRKGVQGAQPGPVLDWMQRVKIAVDAAKGLDYLHEKVQPSIIHRDVRSSNVLLFEDLRAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKAVAKLAAVAALCVQYEAEFRPNMSIVVKALQPLLRAPAPAAAAAAPEV

SEQ ID NO: 12684 - protein, 260 aa, Nicotiana tabacum
MRRWLCCTCQVEESYPSNETEHLKNPATHADGYQNGSRVPAPAKAEAEKAIPTIEVPALSLDELKEETDNFGSKALIGEGSYGRVYYANLSNEKAVAVKKLDVSSEPETNVDFLTQLARVSRLKHDNLVELLGYCVEGNIRVLAYEFATMGSLHDILHGRKGVQGAQPGPTLDWMQRVKIAVDAARGLEYLHEKVQPSIIHRDIRSSNVLLFEDYKAKIADFNLSNQAPDGCSPSFYSSFRNIWLSCTGIRYDWTTDTEE

SEQ ID NO: 12685 - protein, 370 aa, Tripterygium wilfordii
MRKWLCCTCQVEESYPSNENEHLKSPNNHIDGYPKGSKVSAPVKPEVQKAVPIIEVPALSLEELKEKTENFGSKALIGEGSYGRVYYANLDNEKAVAVKKLDVSSEPESNVEFLTQISMVSRLKHDNIVELLGYCVEGNLRVLAYEFARMGSLHDILHGRKGVQGAQPGPTLDWMHRVRIAVDAARGLEYLHEKAQPPVIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKAPAPAPASAPTAAPET

SEQ ID NO: 12686 - protein, 281 aa, Brassica napus
YAKFNDGKAMAAKKLDNASEPETNVEFLTQVSKVSRLNNDNFVQLLGYCVEGNVRVLAYEFATMGSLHDILHGRKGVQGAQPGPTLEWMQRVRVAVDAAKGLEYLHEKVQPAVIHRDIRSSNVLLFEDFKAKIADYNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLRSSGAAAPPPNPHT

SEQ ID NO: 12687 - protein, 281 aa, Brassica napus
YATLNDGVAVALKKLDVSPEAESDAVFLSQVSMVSRLNHENLVQLLGFCVDGSLRVLAYEFATMGSLHDILHGRKGVQGAQPGPTLDWTTRVKIAVEAARGLEYLHEKSQPPVIHRDIRSSNVLLFEDYKAKIADFNLSNQAPDNAARLHSTRVLGTFGYHAPEYAMTGQLTQKSDVYSFGVVLLELLTGRKPVDHTMPRGQQSLVTWATPRLSEDKVKQCIDPKLKADYPPKAVAKLAAVAALCVQYESEFRPNMSIVVKALQPLLKLAAPAPPSPAPES

SEQ ID NO: 12688 - protein, 361 aa, Orobanche aegyptiaca
MRRWLCCTCQVEESYQPNENEHLKSPKGHADGYQRGSKASAAPMKQEVQIPPIEVPSLSLEELKEKTDNFGSKSLIGEGSYGRVYFAQLNNGNEVAVKKLDVSSEPDSNVEFLTQVSMVSKMKHENLVELLGYCVDGNLRVLVYEFATMGSLHDILHGRKGVQGAQPGPVLDWMQRVRIAVDAARGLEYLHEKVQSSIIHRDIRSSNVLLFEDYKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKSTVPSPEV

SEQ ID NO: 12689 - protein, 176 aa, Carthamus tinctorius
  misc_feature (110)..(110): Xaa can be any naturally occurring amino acid
MRRWLCCTCQVEESVPSNDNEFVKNSTDHGDGHQKGSKGSPIKSEVQKAVPPMEVPALPLEELKEKTDDFGSKALIGEGSYGRVYFATLNNEKTVAVKKLDVSTEAESNXEFLTQVSMFSRLKHDNLIELLGYCVEGNVRVLAYEFATMGSLHDILHGRKGVQEHNQGQCLIGCNG

SEQ ID NO: 12690 - protein, 369 aa, Brassica napus
MRRWLCCSCHVQESNHPRVEHNRSRTPPTRHYDYGRNDKKPPPPMKPAVLKEPPPIDVPTMSLAELKEKTENFGSKALIGEGSYGRVYYAKFNDGKAMAVKKLDNASEPETNVEFLTQVSKVSRLNNDNFVQLLGYCVEGNVRVLAYEFATMGSLHDILHGRKGVQGAQPGPTLEWMQRVRVAVDAAKGLEYLHEKVQPAVIHRDIRSSNVLLFEDFKAKIADYNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLRSSGAAAPPPNPRT

SEQ ID NO: 12691 - protein, 136 aa, Abies balsamea
MAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYEADFRPNMSIVVKALQPLLTPKPAIPASEPQT

SEQ ID NO: 12692 - protein, 366 aa, Pseudotsuga menziesii
MRRWFCCVCSTEGSPEQPENQFLNAAKNNGNGFQGDYKASEGAKSGPPQKVQPIEAPALSLDELKEATDNFGAKTLIGEGSYGRVYYATLRDGQPAAIKKLDVSSQPEANSEFLAQVSMVSRLKHDHIVELVGYCVEGTLRVLAYEFATMGSLHDILHGRKGVQGAQPGPVLDWMQRVKIAVGAAKGLEYLHEKAQPHIIHRDIRSSNVLLFDDFQAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESDFRPNMSIVVKALQPLLAPRPAIPASEPQT

SEQ ID NO: 12693 - protein, 366 aa, Picea glauca
MRRWFCCACSTEGAPEQPENQFLNAAKNNGNGFQGDYKASEGAKSGPPQKVPPIEAPSLSLDELKEATDNFGPKALIGEGSYGRVYYATLSDGQPAAIKKLDVSNQPEANAEFLAQVSMVSRLKHDHIVELVGYCVEGTLRVLAYEFATMGSLHDILHGRKGVQGAQPGPVLDWMQRVKIAVGAAKGLEYLHEKAQPHIIHRDIRSSNVLLFDDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYEADFRPNMSIVVKALQPLLTPKPAIPASEPQT

SEQ ID NO: 12694 - protein, 124 aa, Brassica napus
LGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKPPAPAPVPES

SEQ ID NO: 12695 - protein, 368 aa, Panicum virgatum
MRQWLCCNCQVDDEEDGRGKEQSKVQSNKIDPKQKSSKPPVSQPEPEISPPTIDVPDLSLDDLKEKTDNFGSSALIGEGSYGRVYHATLDDGRQAAVKKLDASENEPNDEFLKQVSLASKLKHENLVEMLGYCVEGNYRILAYGFATMGSLHDVLHGRKGVQGAQPGPVLDWMQRVKIAIEAAKGIEYLHEKVQPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALSPLLQQRPAPAPSEPATEPAS

SEQ ID NO: 12696 - protein, 217 aa, Brassica napus
MGSLHDILHGRKGVQGAQPGPTLDWIQRVRIAVDAARGLEYLHEKVQPVVIHRDIRSSNVLLFEDFKAKIADFNLSNQSPDMAARLHSTRVLGTFGYHAPEYAMTGQLTQKSDVYSFGVVLLELLTGRKPVDHTMPRGQQSLVTWATPRLSEDKVKQCVDPKLKGDYPPKAVAKLAAVAALCVQYESEFRPNMSIVVKALQPLLRSSTAVPVQSQGI

SEQ ID NO: 12697 - protein, 366 aa, Cephalotaxus harringtonia
MRRWLCCACSVDDAPEQPENQYFNATKPSPNGNQGNSKASEGAKNDAPQKVPPIEAPALSLEELKEATDNFGPKALIGEGSYGRVYYATLSNGSAAAIKKLDVSSQPEANSEFLAQVSMVSRLKQEHVVELVGYCVEGDIRVLAYEFATMGSLHDILHGRKGVQGAQPGPVLDWMQRVKIAVGAAKGLEYLHEKAQPHIIHRDIRSSNVLLFDDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPSKAVAKLAAVAALCVQYEADFRPNMSIVVKALQPLLNPKPVAPASEAQN

SEQ ID NO: 12698 - protein, 71 aa, Fagopyrum esculentum
GRVQCRVSDTGCHGSQLKHENFVELQGYCVEGTSEFWHMNLPPWDPCMMSYMGEKVFKVHNLVLCLTGCRE

SEQ ID NO: 12699 - protein, 194 aa, Fagopyrum esculentum
AYEFATMGSLHDVLHGRKGVQGAQPGPVLDWMQRVRIAVEAAKGLEFLHEKIQPPIIHRDIRSSNVLLFEDFKAKIADFNVSNQAPDMAARLHSTRVLGTFGYHAPEYAMTGQLTQKSDVYSFGVVLLELLTGRKPVDHTMPRGQQSLVTWATPRLSEDKVKQCVDPKMKDYPAKGVAKLAAVAALCVQYEAEF

SEQ ID NO: 12700 - protein, 362 aa, Flaveria ramosissima
MRRWLCCTCQVEESYPSNDNGFVKSHNDHIDGHQKDKVPAPAKFDTQKAVPTIEVPALSLDELKEKTENFGSKALIGEGSYGRVYFANLDNGKSVAVKKLDVSTEAESDNEFLTQVSMVSKLKHENFVELCGYCVEGNTRVLAYEFATMGSLHDILHGRKGVQGAQPGPVLDWMQRVRIAVDAAKGLEYLHEKVQPSIIHRDIRSSNVLLFEDLRAKIADFNLSNQAPDMAARLHSTRVLGTFGYHAPEYAMTGQLTQKSDVYSFGVVLLELLTGRKPVDHTMPRGQQSLVTWATPRLSEDKAKQCVDPRLKEEYPSKAVAKLAAVAALCVQYESEFRPNMSIVVKALQPLLRAPAPTAPEV

SEQ ID NO: 12701 - protein, 338 aa, Flaveria ramosissima
MRRWLCCTCQVEESYPSNDNGFVKSHNDHIDGHQKDKVPPPAKFDTQKAVPTIEVPALSLDELKDKTENFGSKALIGEGSYGRVYFANLDNGKSVAVKKLDVSTEAESDNEFLTQVSMVSKLKHENFVELCGYCVEGNTRVLAYEFATMGSLHDILHGRKGVQGAQPGPVLDWMQRVRIAVDAAKGLEYLHEKVQPSIIHRDIRSSNVLLFEDLRAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKEEYRQSSGKAGGCGSFMCAIRVRVQA

SEQ ID NO: 12702 - protein, 362 aa, Flaveria ramosissima
MRRWLCCTCQVEESYPSNDNGFIKSHNDHIDGQQKDRVPPPAKFDAQKAVPTIEVPSLSLDELKEKTENFGSKALIGEGSYGRVYFANLNNGKSVAVKKLDVSTEAESDNEFLTQVSMVSKLKHENFVELCGYCVEGNTRVLAYEFATMGSLHDILHGRKGVQGAQPGPVLDWMQRVRIAVDAAKGLEYLHEKVQPSIIHRDIRSSNVLLFEDLRAKIADFNLSNQAPDMAARLHSTRVLGTFGYHAPEYAMTGQLTKKSDVYSFGVVLLELLTGRKPVDHTMPRGQQSLVTWATPRLSEDKVKQCVDPRLKEEYRPKAVAKLAAVAALCVQYESEFRPNMSIVVKALQPLLRAPAPTAPEV

SEQ ID NO: 12703 - protein, 320 aa, Plantago ovata
EVQKAVPTIEVPALSLVELKDKTDNFGSKALIGEGSYGRVYFAQLDSGKDVAVKKLDTSSENESDNEFLTQVAMVSGFKHENLVELHGYCVEGNIRILAYEFATMGSLHDILHGRKGVQGAQPGPVLDWMQRVRIAVDAARGLEYLHEKVQPSIIHRDIRSSNVLLFEDYKAKIADFNLSNQAPDMAARLHSTRVLGTFGYHAPEYAMTGQLTQKSDVYSFGVVLLELLTGRKPVDHTMPRGQQSLVTWATPRLSEDKVQQCVDPKLKTDYPPKGVAKLAAVAALCVQYEAEFRPNMSIVVKALQPLLKTPTPAVAPAPQ

SEQ ID NO: 12704 - protein, 364 aa, Primula obconica
MRKGFCCTCQVEETYPYSENEPFKSPRNYGDEYRKGLRASAPVKVEAQKEVPPIEVPVLSLSELKEKTDNFGSKALIGEGSYGRVYYAHLDNGKAVAVKKLDVSTEADSNVEFLTQVSTVSRLKHDNLVELLSYCVEGNLRVLAYEFATMGSLHDILHGRKGVQGAQPGPVLDWMQRVRIAVDAARGLEYLHEKVQPSIIHRDIRSSNVLLFEDFKAKIADFNLMNQSPDMAARLHSTRVLGTFGYHAPEYAMTGQLTQKSDVYSFGVVLLELLTGRKPVDHNMPRGQQSLVTWATPRLSEDKVKQCIDPKLKDCCPPKAVAKLAAVAALCVQYEAEFRPNMSIVVKALQPLLKSVAPAPAPEI

SEQ ID NO: 12705 - protein, 362 aa, Unknown
  Sequence found in Organisms: Solanum lycopersicum, Solanum tuberosum
MRRWLCCTCQVEESYPSHETEHLKHPASHADGYQKGSRVSDPIRAEADKAVPTIEVPALSLDELKQETDNFGSKALIGEGSYGRVYYANLSNGKAVAVKKLDVSSEPETNVDFLNQVARVSRLKHDNLVELLGYCVEGNIRVLAYEFATMGSLHDILHGRKGVQGAQPGPTLEWVQRVRIAVDAARGLEYLHEKVQPSVIHRDIRSSNVLLFEDYKAKIADFNLSNQAPDMAARLHSTRVLGTFGYHAPEYAMTGQLTQKSDVYSFGVVLLELLTGRKPVDHTMPRGQQSLVTWATPRLSEDKVQQCVDPKLKGCPPKAVAKMAAVAALCVQYEAEFRPNMSIVVKALQPLLRAPAAPAPEI

SEQ ID NO: 12706 - protein, 180 aa, Brassica juncea
EYLHEKVQPVVIHRDIRSSNVLLFEDFKAKIADFNPSNQSPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYESEFRPNMSIVVKALQPLLRSSTAVAVQSHRRII

SEQ ID NO: 12707 - protein, 140 aa, Curcuma longa
ARLHSTRVLGTFGYHAPEYAMTGQLTQKSDVYSFGVVLLELLTGRKPVDHTMPRGQQSLVTWATPRLSEDKVKQCVDPKLKGDYPPKGVAKLAAVAALCVQYEAEFRPNMSIVVKALSPLLNKQAPPPVANPSTDARGMQ

SEQ ID NO: 12708 - protein, 369 aa, Marchantia polymorpha
MAWCCCCEDRNIEKLSNDQSGYHHPNQNMHGGGQGAPKPSENQPPKPGGQTPKLQPISAPSITIEELREATDNFGPKALIGEGSYGRVYYANLQDGRAAAIKKLDASTQPDQEFLTQVSMVSRLKNENVVELIGYCLDNTQRVLAYEFATMGSLHDILHGRKGVKGAQPGPVLDWMQRVKIAVGSARGLEYLHEKAQPAIIHRDIKSSNVLLFDDYTAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKMAAVAALCVQYEADFRPNMSIVVKALQPLLTTRTAAPVQGSPTRD

SEQ ID NO: 12709 - protein, 370 aa, Avena sativa
MGHWFCCNCRSGDVEDDHETERSKAQGNKIDGKQKSSKPVDQPEPDISPPTINVPELSFEDLKEKTDNFGSNSLIGEGSYGRVYHATMDDGRQAAIKKFDASENEPNDEFLKQVSVVSRLKHENLVEMLGYYVEGNYRILAYEFATMGSLHDVLHGRKGVQGAQPGPVLDWMQRVKIAIEAAKGIEYLHEKVQPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCIDPRLKGEYPPKGVAKLAAVAALCVQYEAEFRPNMSIVVKALTPLLTHRAAAPAASEPVAAPATEA

SEQ ID NO: 12710 - protein, 186 aa, Capsicum annuum
TRVKIAVDAARGLEYLHEKVQPPIIHRDIRSSNVLLFEDYKAKIADFNLSNQSPDMAARLHSTRVLGTFGYHAPEYAMTGQLTQKSDVYSFGVVLLELLTGRKPVDHTMPRGQQSLVTWATPRLSEDKVKQCIDPKLKEVPGKGVAKMAAVAALCVQYEAEFRPNMSIVVKALQPLLKAPPPAPES

SEQ ID NO: 12711 - protein, 362 aa, Solanum phureja
MRRWLCCTCQVEESYPSHETEHLKHPASHADGYQKGSRVSDPIRAEADKAVPTIEVPALSFDELKQETDNFGSKALIGEGSYGRVYYANLSNGKAVAVKKLDVSSEPETNVDFLNQVARVSRLKHDNLVELLGYCVEGNIRVLAYEFATMGSLHDILHGRKGVQGAQPGPTLEWVQRVRIAVDAARGLEYLHEKVQPSVIHRDIRSSNVLLFEDYKAKIADFNLSNQAPDMAARLHSTRVLGTFGYHAPEYAMTGQLTQKSDVYSFGVVLLELLTGRKPVDHTMPRGQQSLVTWATPRLSEDKVQQCVDPKLKGCPPKAVAKMAAVAALCVQYEAEFRPNMSIVVKALQPLLRAPAAPAPEI

SEQ ID NO: 12712 - protein, 171 aa, Taxus baccata
MRRWLCCACSVDAAPEQPENQYFNATKAFPNGNQGNSKVSEGAKNDAPQKVPPIEAPALSLEELKEATDNFGPKALIGEGSYGRVYYATLSNGSAAAIKKLDVSSQPEANSEFLAQVSMVSRLKQEHVVELVGYCVEGIFVCWPMSLQQWVLYMTFYMDGKECKGPTRSSS

SEQ ID NO: 12713 - protein, 277 aa, Zostera marina
NDERQVAIKKLDVSSEPNSSNEFLSQISLVSRLKHENFVKLLGYCVEGNNRLLAYEFATMGSLHDVLHGRKGVQGSQPGPVLDWMQRVRIAVDAARGLDFLHEKVQPSIIHKDMRSSNILLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYESEFRPNMSIVVKALQPLLAQKLPPPIASDGTN

SEQ ID NO: 12714 - protein, 118 aa, Jatropha curcas
IPMTGQLTQKSDVYSFGVVLLELLTGRKPVDHTMPRGQQSLVTWATPRLREDKVKQCVDPKLKGEYPPKGVAKLAAVAALCVQYEAEFRPNMSIVVKALQPLLKPPAPAPVAAAPLET

SEQ ID NO: 12715 - protein, 363 aa, Pteridium aquilinum
MGNCCSCWRGYDADKPPPTLTVPATNGNGGVQRSDLAAKNAAIVSTQAIEAPCISLDVLKEATENFGVKALIGEGSYGRVYYAILDGRAAAIKKLDINSQQESDEDFLSQVSMVSRLRHENVVELVGYCLDGDLRVLAYEFATMGSLHDILHGRKGVQGAQPGPVLDWMQRVKIAVGAARGLEYLHEKVQPPIIHRDIRSSNVLLFDDFTAKVADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKSEYPPKAVAKIAAVAALCVQYESEFRPNMSIVVKALQPLLTLKPNPTVTLSVESQT

SEQ ID NO: 12716 - protein, 222 aa, Brassica oleracea
EFATMGSLHDILHGRKGVQGAQPGPTLDWTTRVKIAVEAARGLEYLHEKSQPPVIHRDIRSSNVLLFEDYKAKIADFNLSNQAPDNAARLHSTRVLGTFGYHAPEYAMTGQLTQKSDVYSFGVVLLELLTGRKPVDHTMPRGQQSLVTWATPRLSEDKVKQCIDPKLKADYPPKAVAKLAAVAALCVQYESEFRPNMSIVVRALQPLLKLAAPAPPSPAPES

SEQ ID NO: 12717 - protein, 239 aa, Nuphar advena
LLGYCVEGNLRVLSYEFATMGSLHDILHGRKGVQGAQPGPVLDWIQRVKIAVDAAKGLEYLHEKVQPSIIHRDIRSSNVLLFEDFRAKIADFNLLNQAPDMAARLHSTRVLGTFGYHAPEYAMTGQLTQKSDVYSFGVVLLELLTGRKPVDHTMPRGQQSLVTWATPRLSMDKVKQCVDPKLKGDYPAKGVAKLAAVAALCVQYESEFRPNMSIVVKALQPLLAQKPPSALPPLPLRPK

SEQ ID NO: 12718 - protein, 281 aa, Cedrus atlantica
YYATLRDDQPAAIKKLDVSSQPEANSEFLAQISMVSRLKHDHVVELVGYCVEGTLRVLAYEFATMGSLHDILHGRKGVQGAQPGPVLDWMQRVKIAVGAAKGLEYLHEKAQPHIIHRDIRSSNVLLFDDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYEADFRPNMSIVVKALQPLVTPKPAIPASEPQT

SEQ ID NO: 12719 - protein, 370 aa, Chelidonium majus
MRRWLCCTPQVEESNSKKENDVVLKRSRSHGYVDAQYKPSRHSHTAKPEIPKAPPPIEVPPLSLDELKEKTDNFGSKSLIGEGSYGRVYYATLNSGKAVAIKKLDVSSEPEPNNEFFNQVSVVSRLKNDNFVELLGYCVEGNIRALAYEFATMGSLHDILHGRKGVQGAQPGPVLDWMQRVRIAVDAARGLEYLHEKAQPSIIHRDVRSSNILIFDDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGDYPPKGLAKLAAVAALCVQYESEFRPNMSIVVKALQPLLSQKPQVPPPVLSEI

SEQ ID NO: 12720 - protein, 366 aa, Distylium racemosum
MCRLLCCAGSEEESFVPVDNHYTSPAVGTANGTQGESKASETVKNGTPQKMLPIEAPALSYEELKEATDNFGPKSLIGEGSYGRVYYATLNNGRAAAIKKLDVSSQQEPDSDFLAQVSMVSRLKHEHVVELVGYCVDGNLRVLAYEFATMGSLHDILHGRKGVQGAQPGPVLDWMQRVKIAVGAAKGLEYLHEKAQPHIIHRDIRSSNVLLFDDFTAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKMAAVAALCVQYEADFRPNMSIVVKALQPLLTPKPNASASDPNA

SEQ ID NO: 12721 - protein, 90 aa, Pinus pinaster
MRRFFCCTCSTEGAPEQPEAHFLNAAKNNGNGFQGDYKMSEGAKSGPPQKIAPIEAPALSLEELKEATDNFGAKALIGRVLRKSLLCNVK

SEQ ID NO: 12722 - protein, 367 aa, Arabidopsis thaliana
MRRWLCCSCRVQESYPSAENNRLKTPPTRHYDYGRNNKKTPAPVKPPVLKEPPPIDVPAMSLVELKEKTQNFGSKALIGEGSYGRVYYANFNDGKAVAVKKLDNASEPETNVEFLTQVSKVSRLKSDNFVQLLGYCVEGNLRVLAYEFATMRSLHDILHGRKGVQGAQPGPTLEWMQRVRVAVDAAKGLEYLHEKVQPAVIHRDIRSSNVLIFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYEAEFRPNMSIVVKALQPLLRSATAAAPPTPQP

SEQ ID NO: 12723 - protein, 366 aa, Pinus taeda
MRRFFCCTCSTEGAPEQPEAHFLNAAKNNGNGFQGDYKMSEGAKSGPPQKIAPIEAPALSLEELKEATDNFGAKALIGEGSYGRVYYAMLSDGQPAAIKKLDVNSQPEANSEFLAQISMVSRLKHDHIVELVGYCVEGTLRVLAYEFATMGSLHDILHGRKGVQGAQPGPVLDWMQRVKIAVGAAKGLEYLHEKVQPHIIHRDIRSSNVLLFDDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYEADFRPNMSIVVKALQPLLTPRPAIPASEPQT

SEQ ID NO: 12724 - protein, 366 aa, Podocarpus macrophillus
MCRLLCCSGTEEENFVPVDNQYTSPAVGAANGGQTESKATETVKNGAPHKVLPIEAPVLSFEELREATDNFGPKSLIGEGSYGRVYYANLTNGRAAAIKKLDVSSQQESDSDFLAQVSMVSRLKHDHVVELVGYCVEGNARVLAYEFATMGSLHDILHGRKGVQGAQPGPVLDWVQRVKIAVGAAKGLEYLHEKAQPHIIHRDIRSSNVLLFDDFAAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYEADFRPNMSIVVKALQPLLNPKPTTAASDPHA

SEQ ID NO: 12725 - protein, 218 aa, Taxus baccata
METKESPRHLNQPRMVHHRNLPIEAPALSFEELKEATDNFGPKSLIGEGSYGRVYYATLNNGRAAAIKKLDVSSQQESDSEFLAQVSMVSRLKHEHVVELVGYCVEGNLRVLAYEFATMGSLHDILHGRKGVQGAQPGPVLDWMQRVKIAVGAAKGLEYLHEKAQPHIIHRDIRSSNVLLFDDFAAKIADFNLSNQAPDMAARLHSTRVLGTFWLSCS

SEQ ID NO: 12726 - protein, 365 aa, Sciadopitys verticillata
MCRLLCCSGTEEESFVPVDNHYTTPAIGTANGNQGESKASESVKNGAPQKILPIEAPALSFEELKEATDNFGPKSLIGEGSYGRVYYATLNNGRAAAIKKLDSSSQQEPDSDFLAQVSMVSRLKHEHVVELVGYCVDGNLRVLAYEFATMGSLHDILHGRKGVQGAQPGPVLDWMQRVKIAVGAAKGLEYLHEKAQPHIIHRDIRSSNVLLFDDFTAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKMAAVAALCVQYEADFRPNMSIVVKALQPLLNPKPAPSVSDHA

SEQ ID NO: 12727 - protein, 365 aa, Abies balsamea
MCRLLCCSGAEEESFVPTDNQYQNQAAHNPYGSQGESKPQAVNNGAPQKVLPIEAPTLSLEELKEATDNFGPKSLIGEGSYGRVYYATLSNGQAAAIKKLDVSSQQESDSDFLAQVSMVSRLKHEHVVELVGYCVGGNQRILAYEFATMGSLHDILHGRKGVQGAQPGPVLDWMQRVKIAVGAAKGLEYLHEKAQPHIIHRDIRSSNVLLFDDFAGKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKMAAVAALCVQYEADFRPNMSIVVKALQPLLNPKPTPSASEAQL

SEQ ID NO: 12728 - protein, 217 aa, Brassica napus
MGSLHDILHGRKGVQGAQPGPTLDWIQRVRIAVDAARGLEYLHEKVQPVVIHRDIRSSNVLLFEDFKAKIADFNLSNQSPDMAARLHSTRVLGTFGYHAPEYAMTGQLTHKSDVYSFGVVLLELLTGRKPVDHTMPRGQQSLVTWATPRLSEDKVKQCVDPKLKGDYPPKAVAKLAAVAALCVQYESEFRPNMSIVVKALQPLLRSSTAVPVQSQGI

SEQ ID NO: 12729 - protein, 366 aa, Cephalotaxus harringtonia
MCRLLCCSGTEEESFVPADNHYTSPAVGTANGNQGESKGSESAKNGAPQKMLPIEAPALSFEELKEATDNFGPKSLIGEGSYGRVYYATLSNDRAAAIKKLDVSSQQESDSEFLAQVSMVSRLKHEHVVELVGYCVEGNLRVLAYEFATMGSLHDILHGRKGVQGAQPGPILDWMQRVKIAVGAAKGLEYLHEKAQPHIIHRDIRSSNVLLFDDFAAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKMAAVAALCVQYEADFRPNMSIVVKALQPLLNPKPTPSASDHHA

SEQ ID NO: 12730 - protein, 74 aa, Flaveria ramosissima
MRRWLCCTCQVEESYPSNDNGFIKSHNDHIDGQQKDRVPPPAKFDAQKAVPTIEVPSLSLDELKEKPRILDPRH

SEQ ID NO: 12731 - protein, 366 aa, Eutrema parvulum
MRRWLCCSCHVQESYPSAEHNRLKSPPTRHHDYGRNNKKPPAPVKPSVLKEPPPIDVPAMSLGELKEKTDNFGSKALIGEGSYGRVYYANFNDEKAVAVKKLDNSSEPETNVEFLTQVSKVSRLKNDNFVQLLGYCVEGNFRVLAYEFATMGSLHDVLHGRKGVQGAQPGPTLEWMQRVRVAVDAAKGLEYLHEKVQPPVIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYEAEFRPNMSIVVKALQPLLRSSGTAAASPNP

SEQ ID NO: 12732 - protein, 214 aa, Brassica juncea
GSLHDVLHGRKGVQGAQPGPTLDWTTRVKIAVEAARGLEYLHERSQPPVIHRDIRSSNVLLFEDYKPKIADFNLSNQSPDNAARLHSTRVLGTFGYHAPEYAMTGQLTQKSDVYSFGVVLLELLTGRKPVDNNMPRGQQSLVTWATPRLSEDKVKECIDPKLQADYPPKAVAKLAAVAALCVQYESEFRPNMSIVVKALQPLLKPPPPAAAPSS

SEQ ID NO: 12733 - protein, 100 aa, Gossypium hirsutum
MRRWLCCTRQVNENYRSHESEHFKSPVFLSDGQEKDTRVAADVKPEVHKSAPPIEVPALSLEELKEKTDNFGSKALVGEGSYGRVYYANLDNGKAVAVKS

SEQ ID NO: 12734 - protein, 124 aa, Solanum melongena
RVLGTFGYHAPEYAMTGQLTQKSDVYSFGVVLLELLTGRKPVDHTMPRGQQSLVTWATPRLSEDKVQQCVDPKLKGCPPKAVAKMAAVAALCVQYEAEFRPNMSIVVKALQPLLRAPTAPAPEI

SEQ ID NO: 12735 - protein, 366 aa, Gnetum gnemon
MRRFLCCVCGSDEAHDQTDNPYLSTTRNPPNGNYESITTSEGANNGPPAKVPPIEAPSLSIEELKEATDNFGPKALIGEGSYGRVYYAVLNNGNAAAIKKLDASSQPDSNSEFLAQVSMVSRLKHENVVELVGYCVEGNLRVLAYEFATMGSLHDVLHGRKGVQGAQPGPVLDWMQRVKIAVGAAKGLEYLHEKAQPHIIHRDIRSSNVLLFDDFKTKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYEADFRPNMSIVVKALQPLLNPRPATPASDVNT

SEQ ID NO: 12736 - protein, 368 aa, Lactuca sativa
MRRWLCCTCQVEESYPSNENGLIKNHNDHNDGPHKDSKLPPPVKHDAQKAVPTIEVPSLSLDELKEKTENFGSKALIGEGSYGRVYFANLNNGKSVAVKKLDVSPEAESNSEFLTQVSMVSTLKHDNFVELCGYCVEGNTRVLAYEFATMGSLHDILHGRKGVQGAQPGPVLDWMQRVRIAVDAAKGLEYLHEKIQPSIIHRDIRSSNVLLFEDLRAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKAVAKLAAVAALCVQYESEFRPNMSIVVKALQPTVRAPAPVAAAAAAAEV

SEQ ID NO: 12737 - protein, 366 aa, Sequoia sempervirens
MCHLLCCSGTEEESFVPADSHYTSPAVGTATGNQGESKASESAKNGAPQKILPIEAPALSFEELKEATDNFGPKSLIGEGSYGRVYYATLSNGRAAAIKKLDVSSQQESDSDFLAQVSMVSRLKHEHVVELVGYCVEGNLRVLAYEFATMGSLHDILHGRKGVQGAQPGPVLDWMQRVKIAVGAAKGLEYLHEKAQPHIIHRDIRSSNVLLFDDFAAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKMAAVAALCVQYEADFRPNMSIVVKALQPLLNPKPTPSASDPHA

SEQ ID NO: 12738 - protein, 364 aa, Zostera marina
MRRWICCSRFMEERYDIQDNDYNMETTADVKPKNPKFLNEAETRPQNLSEPPRIELPTIPLTEILQKTTNFDSKSLVGEGSYGRVYYALLNGERQVAIKKLDVSSESNNEFLSQVAVVSKLKHDNFVELLGYCVEEGNRLLVYEFATMGSLHDVLHGRKGVQGSQPGPVLDWMQRVRIAVNAARGLDYLHEKVQPSVIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALQPLLNQKIPTPSHDPAM

SEQ ID NO: 12739 - protein, 364 aa, Eucalyptus grandis
MRRWLCCTCQVEESYAANDDELLKSPRNHVHGPQKNSKLSAPVKPEVQKSAPPIEVPALSLDELKEKTDNFGSKSLIGEGSYGRVYYANLDSGKAVAVKKLDNSSEAESDVEFLTQVSMVSRLKHENFVQLLGYCVEGNLRVLAYEFATMGSLHDVLHGRKGVQGAQPGPVLDWTQRVRIAVDAARGLEYLHEKVQPSIIHRDIRSSNVLLFEDFKARIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLNGDYPPKGVAKLAAVAALCVQYEAEFRPNMSIVVKAMQPLLKAAAPASAPVT

SEQ ID NO: 12740 - protein, 285 aa, Cannabis sativa
VLQNVRVYYASLNNGKAVAVKKLDVSSEPETNVEFLTQVSMVSRLKQENLVELLGYCVEGNLRVLAYEFATMGSLHDILHGRKGVQGAQPGPTLDWMQRVRIAVDAARGLEYLHEKVQPSIIHRDIRSSNVLLFEDFKAKVADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKPPAPAPDAS

SEQ ID NO: 12741 - protein, 367 aa, Sorghum bicolor
MKWLCCNCHVDDEEDGHDMEQAKTQSNKIDPKQKSSKPPVSQPEPEFSPPTIDVPELSLDDLKQKTDDFGSSALIGEGSYGRVYHATLDDGRQAAVKKLDASENEPNDEFLKQVSLASKLKHENLVEMLGYCVDGNYRILAYEFATMGSLHDVLHGRKGVQGAQPGPVLDWMQRVKIAIEAAKGIEYLHEKVQPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALSPLLQQRPAPATAEPAPQPVS

SEQ ID NO: 12742 - protein, 198 aa, Saccharum officinarum
MRRFSLQSSIGTSDQAMYCCLRISGKNCRLQSFDQAQIWQLGSINSCIGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALSPLLQQRPAPATAEPAPQPVSLNQSHVMGPSAYIQSAHSMSH

SEQ ID NO: 12743 - protein, 368 aa, Eutrema halophilum
MRRWLCCSCHVKESYPSSEHNRLKSPPTRHHDYGRNNKKPPAPVKPSVLKEPPPIDVPAMSLDELREKTDNFGSKALIGEGSYGRVYYANLNDGKAVAVKKLDNSSEPETNVEFLTQVSKVSRLKNDNFVQLLGYCVQGNLRVLAYEFATMGSLHDILHGRKGVQGAQPGPTLEWMQRVRVAVDAAKGLEYLHEKVQPPVIHRDIRSSNVLLFEDFEAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKAVAKLAAVAALCVQYEAEFRPNMSIVVKALQPLLRSSGTASAHPTPQI

SEQ ID NO: 12744 - protein, 367 aa, Aristolochia fimbriata
MKRWLCCTCQADESYHPQDNEFQKNLKEYPDGNQKGPKMPAPTKSEPPRAPPEIDVPALPLDEIKEKTDNFGSKALIGEGSYGRVYYATLYDGRAVAIKKLDVSSEPESNGDFLTQVAVVSKLRHDNLVELLGYCVEGNLRVLAYEFATMGSLHDILHGRKGVQGAQPGPTLDWMQRVKIAVDAARGLEYLHEKVQPSIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGDYPPKGVAKLAAVAALCVQYEAEFRPNMSIVVKALQPLLHLKAAPPVAPVTDI

SEQ ID NO: 12745 - protein, 365 aa, Cedrus atlantica
MCRLLCCSGAEEESFVPSDNQYQNPAAHNSYGGQGDSKPQAVNNGAPQKVLPIEAPSLSLEELKEATDNFGPKSLIGEGSYGRVYYATLSNGRAAAIKKLDVSSQQEADSDFLAQVSMVSRLKHEHVVELVGYYVDGNQRILAYEFATMGSLHDILHGRKGVQGAQPGPVLDWMQRVKIAVGAAKGLEYLHEKAQPHIIHRDIRSSNVLLFDDFAAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKTEYPPKAVAKMAAVAALCVQYEADFRPNMSIVVKALQPLLNPKPAPSAAEAQL

SEQ ID NO: 12746 - protein, 364 aa, Pteridium aquilinum
MGNCCTKQIASVKPSIVSSNPAINGRTGNTAAHRVDAVVSSTATITTKPIEVPCLSMDDLKEATENFGAKALIGEGSYGRVYYAILNGRAAAIKRLDINNQQESNEEFLPQVSMVSRIKHENVVELVGYCLDGDLRILAYEFATMGSLHDILHGRKGVQGAQPGPVLDWMQRVKIAVGAARGLEYLHEKVQPPVIHRDVRSSNVLLFDDFIAKVADFNLSNQAPDMAARLHSTRVLGTFGYHAPEYAMTGQLTQKSDVYSFGVVLLELLTGRKPVDHTMPRGQQSLVTWATPRLSEDKVKQCVDPKIKSEYPPKGVAKMAAVAALCVQYEAEFRPNMSIVVKALQPLLNLRPNPTPVGQVDLPT

SEQ ID NO: 12747 - protein, 365 aa, Brassica napus
MCKWMCCTCQIQDSHEEEHLKSSHQHHHHSDAANHKNPKPPALAKPEVRKEPLPIEVPALSLDEVKQKTDNFGSKSLIGEGSYGRVYYGTLNDGIAVALKKLDAAPEAESDAEFLSQVSMVSRLKHENLVQLLGFCVDGKLRVLAYEFATMGSLHDVLHGRKGVQGAQPGPTLDWTTRVKIAVEAARGLEYLHEKSQPPVIHRDIRSSNILLFDDYKPKIADFNLSNQSPDNAARLHSTRVLGTFGYHAPEYAMTGQLTQKSDVYSFGVVLLELLTGRKPVDNNMPRGQQSLVTWATPRLSEDKVKECIDPKLNADYPPKAVAKLAAVAALCVQYEAEFRPNMSIVVKALQPLLKPPPPAAAPSS

SEQ ID NO: 12748 - protein, 233 aa, Brassica napus
MVSRLKHDNLIQLVGYCVDEDLRVLAYEFATMGSLHDVLHGRKGVQGAQPGPTLDWITRVKIAVEAARGLEYLHEKVQPPVIHRDVRSSNVLLFEDYQAKIADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQP

SEQ ID NO: 12749 - protein, 361 aa, Catharanthus roseus
MRRWLCCSCQVEESYPSNENEPFRSPKNHMDGHQKGSKVSAPVMSEAQKAVPPIEVPPLSLDELKEKTDNFGSKALIGEGSYGRVYYANLENGKAVAVKKLDVSSEPESNVEFLTQVSVVSRLKHENLVELLGYCVEGNIRVLAYEFATMGSLHDILHGRKGVQGAQPGPVLDWITRVRIAVDAARGLEYLHEKVQPPIIHRDIRSSNVLVFEDYKAKIADFNLSNQAPDMAARLHSTRVLGTFGYHAPEYAMTGQLTQKSDVYSFGVVLLELLTGRKPVDHNMPRGQQSLVTWATPRLSEDKVKQCIDPKLKDYPAKGVAKLAAVAALCVQYEAEFRPNMSIVVKALQPLLKSQVPPPES

SEQ ID NO: 12750 - protein, 365 aa, Pinus pinaster
MCRLLCCAGAEEESFVPPDNHYQNQGAHNAYGNQGESKPQPVNNGAPQKVLPIEAPSLSLEELKEATDNFGPKSLIGEGSYGRVYYATLSNGKAAAIKKLDTSSQQESDSDFLAQVSMVSRLKHEHVVELVGYYVDANQRILAYEFATMGSLHDILHGRKGVQGAQPGPVLDWIQRVKIAVGAAKGLEYLHEKAQPHIIHRDIRSSNVLLFDDFAAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKSEYPPKAVAKMAAVAALCVQYEADFRPNMSIVVKALQPLLNPKPTPSASEAQL

SEQ ID NO: 12751 - protein, 361 aa, Tabernaemontana elegans
MRRWLCCTCQVEESYPSNENEPFRSPKNHADGHQRGSKVSAPVMSEVQKAIPPIEVPALSLDELKDKTDNFGSKALIGEGSYGRVYYANLENGKAVAVKKLDVSSEPESNVEFLTQVSMVSRLKHENLVELLGYCVEGNLRVLAYEFATMGSLHDILHGRKGVQGAQPGPVLDWITRVRIAVDAARGLEYLHEKVQPPIIHRDIRSSNVLVFEDYKAKIADFNLSNQAPDMAARLHSTRVLGTFGYHAPEYAMTGQLTQKSDVYSFGVVLLELLTGRKPVDHNMPRGQQSLVTWATPRLSEDKVKQCIDPKLKDYPAKGVAKLAAVAALCVQYEAEFRPNMSIVVKALQPLLKSHVPPPES

SEQ ID NO: 12752 - protein, 362 aa, Vinca minor
MRRWLCCTCQVDESSYPSNENEPFRSPKNHADGHQRGSKVSAPVTSETQKAVPPIEVPALSLDELKDKTDNFGSKALIGEGSYGRVYYANLENGKAVAVKKLDVSSEPESNPEFLTQVSMVSRLKHENVVELLGYCVEGNLRVLAYEFATMGSLHDILHGRKGVQGAQPGPVLDWITRVRIAVDAARGLEYLHEKVQAPIIHRDIRSSNVLVFEDYKAKIADFNLSNQAPDMAARLHSTRVLGTFGYHAPEYAMTGQLTQKSDVYSFGVVLLELLTGRKPVDHNMPRGQQSLVTWATPRLSEDKVKQCIDPKLKDYPVKGVAKLAAVAALCVQYEAEFRPNMSIVVKALQPLLKSQTPLPES

SEQ ID NO: 12753 - protein, 175 aa, Vinca minor
MRRWLCCTCQVEEAYPSNENEHFRSPKNHADGHQRGSKVSAPVISETQKAIPPIEVPALSLDELKDKTDNFGSKALIGEGSYGRVYYANLENGKAVAVKKLDVSSEPESNAEFLTQVSMVSRLKHENFVELLGYCVEGNLRVLAYEFATMGSLHDILHGREGGSKVLSLVRYLTG

SEQ ID NO: 12754 - protein, 367 aa, Hordeum vulgare
MRNWLCCKGRRGEDDDEHEMEHSKAQGNKIDGKQKSSKPAEPEPDISPPTINVPELSFEDLKEKTDNFGSSSLIGEGSYGRVYHATMDDGRQAAIKKFDASENEHNDEFLKQVSLVSRLKHENLVEMLGYYVEGNYRILAYEFATMGSLHDVLHGRKGVQGAQPGPVLDWMQRVKIAIEAAKGIEYLHEKVQPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLGAVAALCVQYEAEFRPNMSIVVKALSPLLQQRAAAPAASELAQAPEV

SEQ ID NO: 12755 - protein, 164 aa, Catharanthus roseus
HEVHRDIRSSNVLVFEDYKAKIADFNLSNQAPDMAARLHSTRVLGTFGYHAPEYAMTGQLTQKSDVYSFGVVLLELLTGRKPVDHNMPRGQQSLVTWATPRLSEDKVKQCIDPKLKDYPAKGVAKLAAVAALCVQYEAEFRPNMSIVVKALQPLLKSQVPPPES

SEQ ID NO: 12756 - protein, 167 aa, Eucalyptus grandis
  misc_feature (107)..(107): Xaa can be any naturally occurring amino acid
AGIHRDIRSSNVLLFEDFKARIADFNLSNQAPDMAARLHSTRVLGTFGYHAPEYAMTGQLTQKSDVYSFGVVLLELLTGRKPVDHTMPRGQQSLVTWATPRLSEDKXKQCVDPRLNGDYPPKGVAKLAAVAALCVQYEAEFRPNMSIVVKAMQPLLKAAAPASAPVT

SEQ ID NO: 12757 - protein, 365 aa, Pinus taeda
MCRLLCCAGTEEESFVPPDNHYQNQGAHNAYGNQGESKPQPVNNGAPQKVLPIEAPSLSLEELKEATDNFGPKSLIGEGSYGRVYYATLSNGKAAAIKKLDTSSQQESDSDFLAQVSMVSRLKHEHVVELVGYYVDASQRILAYEFATMGSLHDILHGRKGVQGAQPGPVLDWIQRVKIAVGAAKGLEYLHEKAQPHIIHRDIRSSNVLLFDDFAAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKSEYPPKAVAKMAAVAALCVQYEADFRPNMSIVVKALQPLLNPKPTPSASEAQL

SEQ ID NO: 12758 - protein, 253 aa, Pseudoroegneria spicata
  misc_feature (253)..(253): Xaa can be any naturally occurring amino acid
LVSRLKHENLVEMLGYYVEGNYRILAYEFATMGSLHDVLHGRKGVQGAQPGPVLDWMQRVKIAIEAAKGIEYLHEKVQPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLGAVAALCVQYEAEFRPNMSIVVKALSPLLQQRAAAPAASELAPAPGX

SEQ ID NO: 12759 - protein, 365 aa, Pseudotsuga menziesii
MCRLLCCSGTEEESFVPPDNHYQNQAAHNSYGGQGESKPQPVNNGAPQKVLPIEAPSLSFDELKEATDNFGPKSLIGEGSYGRVYYATLSNGRAAAIKKLDVSSQQESDSDFLAQVSMVSRLKQEHVVELVGYCVDANQRILAYEFATMGSLHDILHGRKGVQGAQPGPVLDWMQRVKIAVGAAKGLEYLHEKAQPHIIHRDIRSSNVLLFDDFAAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKSEYPPKAVAKMAAVAALCVQYEADFRPNMSIVVKALQPLLNPKPTPSASEAQL

SEQ ID NO: 12760 - protein, 365 aa, Picea glauca
MCRLLCCSGAEEESFVPPDNHYQSQAAHNPYGSQGESKPQPVNNGAPRKVLPIEAPSLSLEELKEATDNFGPKSLIGEGSYGRVYYATLSNGQAAAIKKLDVSSQQESDSEFLGQVSMVSRLKHEHVVELVGYFVDANQRILAYEFATMGSLHDILHGRKGVQGAQPGPVLDWIQRVKIAVGAAKGLEYLHEKAQPHIIHRDIRSSNVLLFDDFAAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKSEYPPKAVAKMAAVAALCVQYEADFRPNMSIVVKALQPLLNPKPTPSASEAQL

SEQ ID NO: 12761 - protein, 368 aa, Triticum aestivum
MRHWLCCNIRSGDDDDRHEVEHSKAQGNKIDGKQKSSKPADQPEPDISPPTIDVPELSFEDLKEKTDNFGSSSLIGEGSYGRVYHATMDDGRQAAIKKFDASENEPNDEFLKQVSLVSRLKHENLVEMLGYYVEGNYRILAYEFATMGSLHDVLHGRKGVQGAQPGPVLDWMQRVKIAIEAAKGIEYLHEKVQPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLGAVAALCVQYEAEFRPNMSIVVKALSPLLQQRAAAPAASELAPAPGA

SEQ ID NO: 12762 - protein, 368 aa, Zea mays
MRQWLCCNCHFDDEEDGHDKEQAKAQSNKIDPKQKSSKPPVSQPEPEFSPPTIDVPELSLDDLKQKTDDFGSSALIGEGSYGRVYHAALDDGRQAAVKKLDASENEPNDEFLKQVSLASKLKHENLVEMLGYCVDGNYRILAYEFATMGSLHDVLHGRKGVQGAQPGPVLDWMQRVKIVIEAAKGIEYLHEKVQPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALSPLLQQRPAPGTAEPAPQPVS

SEQ ID NO: 12763 - protein, 365 aa, Mimulus guttatus
MRRWLCCTCHVEESYQQNENEHLKSPRNNADGHQRGSKTSAPVKPEVQRAVPPIEVPSLSLEELKEKTENFGSKALIGEGSYGRVYFAQLSDGKEVAVKKLDVSSEPDSNVEFLTQVSMVSRLKHDNLVELLGYCVDGSLRVLAYEFATMGSLHDILHGRKGVQGAQPGPVLDWMQRVKIAVDAARGLEYLHEKSQPSMIHRDIRSSNVLLFEDYKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPAKAVAKLAAVAALCVQYEAEFRPNMSIVVKALQPLLKSVVPAPEIQHP

SEQ ID NO: 12764 - protein, 368 aa, Setaria italica
MRQWFCCNCHFDDEEDGHNKEQSKAQSNKIDPKQKSSKPPVTQPEPEISPPTIDVPELSLDDLKEKTDNFGSSALIGEGSYGRVYHATLDDGRQAAVKKLDASENEPNDEFLKQVSLASKLKHDNLVEMLGYCVEGNYRILAYEFATMGSLHDVLHGRKGVQGAQPGPVLDWMQRVKIAIEAAKGIEYLHEKVQPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALSPLLQQRPAPTASEPAPEPAS

SEQ ID NO: 12765 - protein, 235 aa, Setaria italica
VEGNYRILAYEFATMGSLHDVLHGRKGVQGAQPGPVLDWMQRVKIAIEAAKGIEYLHEKVQPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALSPLLQQRPAPTASEPAPEPAS

SEQ ID NO: 12766 - protein, 368 aa, Pennisetum glaucum
MRQWFCCNCHFDDEEDGHNKDQSKAQSTKIDPKQKSSKPPVSQPVPEICPPTIDVPELSLDDLKEKTENFGSSALIGEGSYGRVYHATLDDGRQAALKKLDASENEPNDEFLKQVSLASKLKHDNLVEMLGYCVDGNYRILAYEFATMGSLHDVLHGRKGVQGAQPGPVLDWMQRVKIAIEAAKGIEYLHEKVQPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALSPLLQQKPAPTASEPAPEPAS

SEQ ID NO: 12767 - protein, 365 aa, Setaria italica
MRRWFCCTQFHASYREHENELPISPDEKEGNGFVANSDPNKAPPPIEVPELSFEELKEKTDNFGSKALIGEGSYGRVYYAILDSGKHVAVKKLDASTDPELDNEFLTQVSIASKLKHANFVEMLGYCVEGNQRLVAYEFATMGSLHDILHGRKGVPGAQPGPALDWMQRVKIAIDAAKGLEYLHEKVRPSIVHRDIRSSNVLLFEDYKAKIADFNLSNQSPDMAARLHSTRVLGTFGYHAPEYAMTGQLTQKSDVYSFGVVLLELLTGRKPVDHTMPRGQQSLVTWATPRLTEDTVKQCVDPRLKGEYPPKGVAKLAAVAALCVQYESEFRPSMSIVVKALSPLLQHKPHPPPAVAPDATAPSDA

SEQ ID NO: 12768 - protein, 575 aa, Brachypodium distachyon
MRHWFCCNCRFGGEEDDHDMEHSKAKGNKMDAKQKSSRPADQPEIDFFPPTIDVPELSFEDLKQKTDNFGSNSLIGEGSYGRVYHATMDDGRQAAIKKFDASENEPNDEFLKQVSLVSKLNHENLVEMLGYYVEGNYRILAYEFATMGSLHDVLHGRKGVQGAQPGPVLDWMQRVKIAIEAAKGVEYLHEKVHPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCIDPRLKGEYPPKGVAKLAAVAALCVQYEAEFRPNMSIVVKALSPLLQQRPVVPAASEPEGSSSRSCLRWHFLPDNDAWIKSSTPLCPFQVISSGLIEDEEQEALEVDFVNKYLGGGALSKGCVQLSYKCCICSMVHEEIRFMINSELIVGMLFMASMEDNEAIEIVGAERYGSSFRFVGDCSDTKPLDALGRRKTRILAIDSLDCPTKLQYEISGLLREVNKAFCGFLDQSKHQLYVKPFQDSNTKDNCPSVSSDGCIRVSTGIWGFWWKP

SEQ ID NO: 12769 - protein, 257 aa, Setaria italica
VSIASKLKHANFVEMLGYCVEGNQRLVAYEFATMGSLHDILHGRKGVPGAQPGPALDWMQRVKIAIDAAKGLEYLHEKVRPSIVHRDIRSSNVLLFEDYKAKIADFNLSNQSPDMAARLHSTRVLGTFGYHAPEYAMTGQLTQKSDVYSFGVVLLELLTGRKPVDHTMPRGQQSLVTWATPRLTEDTVKQCVDPRLKGEYPPKGVAKLAAVAALCVQYESEFRPSMSIVVKALSPLLQHKPHPPPAVAPDATAPSDA

SEQ ID NO: 12770 - protein, 430 aa, Oryza sativa
MVMFLLIPGGHLLFLISFWFVSLVHQVAVDTEHDDSIGVTDESGWPCIELDRRMRRMNGRNPEKNIKMEHENDSSLAWVFHAPYREHENEFPDIPEEKEGNGFAPKSDDPTKAPPPIEVPELSFDELKEKTDNFGSKALVGEGSYGRVYYATLDNGKQVAVKKLDASTEPEVDNDFLTQVSIVSRLRHENFVEMLGYCVEGNQRLVAYEFATMGSLHDILHGRKGVPGAQPGPALDWMQRVRIAIDAAKGLEYLHEKVQPSIVHRDIRSSNVLLFEDYKAKIADFNPSNQSPDMAARLHSTRVLGTFGYHAPEYAMTGQLTQKSDVYSFGVVLLELLTGRKPVDHTMPRGQQSLVTWATPRLTEDTVKQCVDPRLKGEYPPKGVAKLAAVAALCVQYESEFRPSMSIVVKALSPLLQHKPPPPPAVAPET

SEQ ID NO: 12771 - protein, 365 aa, Sorghum bicolor
MRRWFCCTQFNASYREHENERPISPEEKEGNGFAVKSDPIKVPPSIEVPELSFEELKEKTDNFGSKALIGEGSYGRVYYAILDSEKHVAVKKLDASTDPELDNEFLTQVSIASKLKHDNFVEMLGYCVEGNQRLVAYEFATMGSLHDILHGRKGVPGAQPGPALDWMQRVKIAIDAAKGLEYLHEKVQPSIVHRDIRSSNVLLFEDYKAKIADFNLSNQSPDMAARLHSTRVLGTFGYHAPEYAMTGQLTQKSDVYSFGVVLLELLTGRKPVDHTMPRGQQSLVTWATPRLTEDTVKQCVDPRLKGEYPPKGVAKLAAVAALCVQYESEFRPSMSIVVKALSPLLQHKPQPPPATTPDATAPSDA

SEQ ID NO: 12772 - protein, 370 aa, Phalaenopsis aphrodite
MPRWLCCSFNLKDTDDLHENEALKSSKPYEDGLQKDPKLSIVAKNETKVPPPIDVPALSLDELKEKTDNFGSKALVGEGSYGRVYFAVLKDGRQVAIKKLDVSQEPESNVEFLTQVAMVSKVRHDNFVELRGYCVEENLRLLSYEFATMGSLHDVLHGRKGVLGAQPGPVLDWMQRVSIAIDAAKGLEYLHEKVQPSIIHRDIRSSNILLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGIAKLAAVAALCVQYEAEFRPNMSIVVKALSPLLVNKQCLPQPDPAAAIADA

SEQ ID NO: 12773 - protein, 239 aa, Platanus occidentalis
DVSSEQESNAEFLTQVSMVSRLKHENLVELLGYCVEGNLRVLAYEFATMGSLHDILHGRKGVQGAQPGPVLDWMQRVRIAVDAARGLEYLHEKVQPSIIHRDIRSSNILLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDQTKGEYPPKELLSWLLWQLYVCSMNLSFDRI

SEQ ID NO: 12774 - protein, 369 aa, Oryza sativa
MVRWRRWICCNCQVNESDQLENGHAKVLTSNADGVTKGLKDSATEKAQPQNSALTINIPVLSLDELVEKTDDFGSSALIGEGSYGRVYYAVLDSGTKIAVKKLDSNENEPTSEFLTQVALVSRLKHENFVDMLGYCTEGNLRLVAYEFATMGSLHDVLHGRKGVQGAQPGPALDWMQRVRIAVDAAKGLEYLHEKVQPSIVHRDIRSSNILLFEDFKAKVADFNLSNQAPDMAARLHSTRVLGTFGYHAPEYAMTGQLTQKSDVYSFGVVLLELLTGRKPVDHTMPRGQQSLVTWATPRLTEDKVKQCIDPRLNGEYPPKGVAKLAAVAALCVQYEAEFRPNMSIVVKALSPLLTSKPTPPAPPPALDG

SEQ ID NO: 12775 - protein, 742 aa, Amsonia hubrichtii
MSRVYDNWDRLVRATLRREQLRLSALRTPSDLSVVSSSSSFNSSVSSRRVSSFSFPDLLVGEIFEYNQILRATDYFGASNLMRHGRSGDFFSGVLEDGTPVVVKRIDWSSAKNESYCISELEFFGKASHSRLVPLLGHCLELLDEKYLVYKYMPNGDLSSTLSREVRSDGDRQLESLDLMTRLKIATGAAEALSYLHDECVPSLVHRDIQASSILLDHDFEVRLGSCSEVCAEEKKGKQSRIAWLLQLPLESRRSPSGTTPNASCAYDVYCFGKVLLELVTGKLGISASSDAATKEWLEQTLPYISIYDKELMTRIIDPSLIIDDDLLEKGWAMAIVARSCLYPKPSGRPRMRYILIALEDLLKVVVKPDQKIRDIWPYSGHIIWLLKLLQLDHDLPLLSLENERALAIENKGHQRGSKVSAPVMSEAQKAIPPIEVPGLSLDELKDKTDNFGSKALIGEGSYGRVYYANLDNGKAVAVKKLDVSSEPESNVEFLTQVSMVSRLKHENLVELLGYCVDGNLRVLAYEFATMGSLHDILHGRKGVQGAQPGPVLDWITRVRIAVDAARGLEYLHEKVQPPIIHRDIRSSNVLVFEDYKAKIADFNLSNQAPDMAARLHSTRVLGTFGYHAPEYAMTGQLTQKSDVYSFGVVLLELLTGRKPVDHNMPRGQQSLVTWATPRLSEDKVKQCIDPKLKDYPAKGVAKLAAVAALCVQYEAEFRPNMSIVVKALQPLLKSQVPPTES

SEQ ID NO: 12776 - protein, 363 aa, Distylium racemosum
MICFRCCREDEIQKLADGTNPYTSNVPMTGNDGIYKSVDTGFKGGQNLKAQPISVPEITVEELREITENFGPKSLIGEGSYGRVYYATLSNGCATAIKKLDSSKQPEQELLAQVSMVSRLKHENVVELVGYCVDGVLRVLAYEFATMGSLHDILHGKKGVKGAEPGPVLTWMQRVKIAVGAAKGLEYLHEKAQPPIIHRDIKSSNVLLFDDYSAKIADFDLSNQAPDTAARLHSTRVLGTFGYHAPEYAMTGQLSQKSDVYSFGVVLLELLTGRKPVDHTLPRGQQSLVTWATPRLSEDKVKQCVDPRLKGDYPPKAVAKLAAVAALCVQYEADFRPNMSIVVKALQPLLHAKPAPAVEIPAF

SEQ ID NO: 12777 - protein, 352 aa, Humulus lupulus
MRRWLCCTCQVEESFPSNENEHLKSPRNYSDGNQKGSRVAAPVKPEVQKAAPPIEVPALSLEELKEKTDNFGSKALIGEGSYGRVYYASLNNGKAVAVKKLDVSSEPETNVEFLTQVSMVSRLKQENLVELLGYCVEGNLRLLAYEFATMGSLHDILHGRKGVQGAQPGPTLDWMQRVRIAVDAARGLEYLHEKVQPSIIHRDIRSSNVLLFEDFKAKVADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPL

SEQ ID NO: 12778 - protein, 361 aa, Vinca minor
MRRWLCCTCQVEESYPSNENEPFRSPKNHADGQQRGSKVSAPVIPETQKAVPPIEVPALSLDELKDKTDNFGSKALIGEGSYGRVYYANLENGKAVAVKKLDVSSEPESNDQFLTQVSMVSRLKHENLVDLLGYCVEGNLRVLAYEFATMGSLHDILHGRKGVQGAQPGPVLDWITRVRIAVDAARGLEYLHEKVQPPIIHRDIRSSNVLVFEDYKAKIADFNLSNQAPDMAARLHSTRVLGTFGYHAPEYAMTGQLTQKSDVYSFGVVLLELLTGRKPVDHNMPRGQQSLVTWATPRLSEDKVKQCIDPKLKDYPAKGVAKLAAVAALCVQYEAEFRPNMSIVVKALQPLLKSQTPPPDS

SEQ ID NO: 12779 - protein, 361 aa, Vinca minor
MRRWLCCTCQVEEAYPSNENEHFRSPKNHADGHQRGSKVSAPVISETQKAIPPIEVPALSLDELKDKTDNFGSKALIGEGSYGRVYYANLENGKAVAVKKLDVSSEPESNAEFLTQVSMVSRLKHENFVELLGYCVEGNLRVLAYEFATMGSLHDILHGRKGVQGAQPGPVLDWITRVRIAVDAARGLEYLHEKVQPPVIHRDIRSSNVLVFEDYKAKIADFNLSNQAPDMAARLHSTRVLGTFGYHAPEYAMTGQLTQKSDVYSFGVVLLELLTGRKPVDHNMPRGQQSLVTWATPRLSEDKVKQCIDPKLKDYPAKGVAKLAAVAALCVQYEAEFRPNMSIVVKALQPLLKSQTLPPES

SEQ ID NO: 12780 - protein, 101 aa, Gnetum gnemon
MCRLLCCYGSEEDNFVPADNHYHAPVAGVGSGYTVESKPGDGVEPPGAPTKVLPIEAPALSYDELTEETDNFGPKSLIGEGSYGRVYFANLSTGRAAAIKN

SEQ ID NO: 12781 - protein, 355 aa, Selaginella moellendorffii
MGCVFSSCAGNDITKPSDAPFTTVTNGNPGGAKANEGANRAGQAARVQPIAVPMLGIDELKEATENFGPKSLIGEGSYGRVYLAELRSGQAAIKKLDQNSQPDQEFLAQVSMVSRLKNENVVELIGYCVDGPLRVLAYEFATMGSLHDILHGRKGVKGALPGPVLDWAQRVKIAVGAAKGLEYLHEKVSPPLIHRDIKSSNVLLFDDYTAKIADFNLSNQAPDTAARLHSTRVLGTFGYHAPEYAMTGQLTQKSDVYSFGVVLLELLTGRKPVDHSMPRGQQSLVTWATPRLSEDKVKQCVDPKLKGEYPAKAVAKMAAVAALCVQYEADFRPNMGIVVKALQPLLTARAAPAAE

SEQ ID NO: 12782 - protein, 368 aa, Zea mays
MRRWLCCNCHYDVEEDDHAKEQAKAQSNKTDSKQKSSKPPGSQPEPEFSPPTIDVPELSLDDLKLKTDDFGSSALIGEGSYGRVYHATLDDGRQAAVKKLDASENEPNDEFLKQVSLASKLKHENLVEMLGYCVDGNYRILAYEFATMGSLHDVLHGRKGVQGAQPGPVLDWMQRVKIAIEAAKGIEYLHEKVQPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCAQYEAEFRPNMSIVVKALSPLLQQRPAPTTEEPAPQPGS

SEQ ID NO: 12783 - protein, 368 aa, Oryza sativa
MRQWFCCNCHFDEEDDHGKERSNAQGNKMDAKQKSSKPPAGQPEPEIAPLTIDVPELSLEDLKQKTDNFGSNALIGEGSYGRVYHATLDDGRQAAVKKLDASENEPNDEFLKQVSQASRLKHENLVEMLGYCVEGNYRILAYEFATMGSLHDVLHGRKGVQGAQPGPVLDWTQRVKIAIEAAKGLEYLHEKVQPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCVDPRLKSEYPPKGVAKLAAVAALCVQYEAEFRPNMSIVVKALSPLLQQKPAVPAASEPAPATEN

SEQ ID NO: 12784 - protein, 161 aa, Momordica charantia
LLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPRGVAKLAAVAALCVQYEAEFRPNMSIVVKALSPLLQQRPAPTASEPAPEPAS

SEQ ID NO: 12785 - protein, 364 aa, Brachypodium distachyon
MRRWFCCSQFHAPYREHEHEFPSSPDEKEGNGFASKSDPTKAPPPIEIPELSLDELKEKTDNFGSKALIGEGSYGRVYYAILDSEKHVAVKKLDTSSDPEPDNEFLTQISIVSKLKHENFVEMLGYCVEGNQRLVAYEFATMGSLHDILHGRKGVPGAQPGPALDWIQRVKIAIDAAKGLAYLHEKVQPSIVHRDIRSSNILLFEDYKAKIADFNLSNQSPDMAARLHSTRVLGTFGYHAPEYAMTGQLTQKSDVYSFGVVLLELLTGRKPVDHTMPRGQQSLVTWATPRLTEDTVKQCIDPRLKGEYPPKGVAKLAAVAALCVQYESEFRPSMSIVVKALSPLLQHKPQPPPAIAPNTTASDI

SEQ ID NO: 12786 - protein, 128 aa, Nuphar advena
GTFGYHAPEYAMTGQLTQKSDVYSFGVVLLELLTGRKPVDHTMPRGQQSLVTWATPRLSEDKVKQCVDPRLKGEYPAKGVAKLAAVAALCVQYESEFRPNMGIVVKALQPLLLQKQPQSAVPPPSTGT

SEQ ID NO: 12787 - protein, 365 aa, Panicum virgatum
MRRWFCCTQFHASYREHENELPISPDEKEGNGFAANSNPIKAPPPIEVPELSFEELKEKTDNFGSKALIGEGSYGRVYYAILDSEKHVAVKKLDASTDPELDNEFLTQVSIASKLKHDNFVEMLGYCVEGNQRLVAYEFATMGSLHDILHGRKGVPGAQPGPALDWMQRVKIAIDAAKGLEYLHEKVQPSIVHRDIRSSNVLLFEDYKAKIADFNLSNQSPDMAARLHSTRVLGTFGYHAPEYAMTGQLTQKSDVYSFGVVLLELLTGRKPVDHTMPRGQQSLVTWATPRLTEDTVKQCVDPRLKGEYPPKGVAKLAAVAALCVQYESEFRPSMSIVVKALSPLLQHKPQPPPVAAPDAKAPSGG

SEQ ID NO: 12788 - protein, 364 aa, Zea mays
MRRWFCCTRFNASYREHENERPITPEEKEGNGFSVKSDPIKAPPSIEVPELSFEELKEKTDNFGSKALIGEGSYGRVYYAILDSGKHVAVKKLDASTDPELDNEFLTQVSIASKLKHDNFVEMLGYCVEGNQRLVVYEFATMGSLHDILHGRKGVPGAQPGPALDWMQRVKIAIDAAKGLEYLHEKVQPSIVHRDIRSSNILLFEDYRAKIADFNLSNQSPDMAARLHSTRVLGTFGYHAPEYAMTGQLTQKSDVYSFGVVLLELLTGRKPVDHTMPRGQQSLVTWATPRLTEDTVKQCVDPRLKGEYPPKGVAKLAAVAALCVQYESEFRPSMSIVVKALSPLLQHKPQPPAATTDATAPSDA

SEQ ID NO: 12789 - protein, 363 aa, Zea mays
MRRWLCCSHFDTPYLENENGFTSSPDRTSGNGNGLNANSDPAKPPSIEVPALSLDELREKTDDFGSKALVGEGSYGRVYYAVLENEQHVAVKKLDTSADPEPDNEFLAQVSVVSRLKHENFVDMLGYCIQGDQRLLAYEFATMGSLHDILHGRKGVAGAQPGPALDWMQRVKIAVDAAKGLEYLHEKVQPSIVHRDIRSSNVLLFEDYKAKIADFNLSSQSPDMAARLHSTRVLGTFGYHAPEYAMTGQLTQKSDVYSFGVVLLELLTGRKPVDHTMPRGQQSLVTWATPRLGEDKVKQCVDPRLNGEYPPKGVAKLAAVAALCVQYESEFRPSMSIVVKALSPLLVNAPYQPAAAPDVSSDA

SEQ ID NO: 12790 - protein, 361 aa, Sorghum bicolor
MRRWLCCSHFDTPYLENENGFTSSPDKTSGNDLNSNSDPAKPPSIEVPALSFDELKEKTDDFGSKALVGEGSYGRVYYAVLETEQHVAVKKLDTSADPEPDNEFLAQVSTVSRLKHENFVDLLGYCIEGDQRLLAYEFATMGSLHDILHGRKGVAGAQPGPALDWMQRVKIAVDAAKGLEYLHEKVQPSIVHRDIRSSNVLLFEDYKAKIADFNLSSQSPDMAARLHSTRVLGTFGYHAPEYAMTGQLTQKSDVYSFGVVLLELLTGRKPVDHTMPRGQQSLVTWATPRLGEDKVKQCVDPRLNGEYPPKGVAKLAAVAALCVQYESEFRPSMSIVVKALSPLLVNAPYQPAGAPDISSDA

SEQ ID NO: 12791 - protein, 346 aa, Ananas comosus
TNHMDGLQRGSKLSAAAKPEPPKAPPPIEVPALSLEELKEKTDNFGSKALVGEGSYGRVYFATLNNGKQVAIKKLDVSSEPESNTEFLTQVSMVSRLKHENVVEMLSYCVEGNLRILAYEFATMGSLHDVLHGRKGVQGAQPGPVLDWMQRVRIAIDAAKGLEYLHEKVQPSIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALSPLLVNRHAAPPPAAAPAATPDS

SEQ ID NO: 12792 - protein, 373 aa, Phalaenopsis aphrodite
MSCWLCCSCKVDESDDPRENEALKSPKRYVDGRNGVQKGSKLSAVEKTESQKAILPIDVPALSLEELKNKTDNFGSTALVGEGSYGRVYFALLNDGRQVAIKKLDAAQEPESNAEFLSQVAKVSKLKHENFVQLLGYCAEENLRLLSYEFATMGSLHDILHGRKGVQGAQPGPALDWMQRVRIAIDAAKGLEYLHEKIQPSIIHRDIRSSNILLFEDFRAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPRLKADYPPKGVAKLAAVAALCVQYEAEFRPNMSIVVKALSPLLNKQTPQQPSLSPGVMDT

SEQ ID NO: 12793 - protein, 363 aa, Valeriana officinalis
MRRWLCCTCQVEDNYPSNRGEVIKSPKNNTDGNQKGGRALSPVKADAKKSSVPPIEVPLISLEELKEKTDNFGSQALIGEGSYGRVYYADLSSGKCVAAKKLDVPAEAESNDDFLAQVSMVSRLKHDNVVELLGYHVDGNIRILAYEYATMGSLHDVLHGRKGVQGAQPGPPLDWITRVKIAVDAARGLEYLHEKVQPSVIHRDIRSSNVLLFEDFRAKIADFNLSNQSPDMAARLHSTRVLGTFGYHAPEYAMTGQLTQKSDVYSFGVVLLELLTGRKPVDHTMPRGQQSLVTWATPRLSEDKVKQCIDPKLTTYPPKAVAKLAAVAALCVQYESEFRPNMSIVVKALQPLVRAPTPTITID

SEQ ID NO: 12794 - protein, 300 aa, Brassica rapa
  misc_feature (294)..(296): Xaa can be any naturally occurring amino acid
MRRWLCCSCHVQESNHPRVEHNRSRTPPTRHYDYGRNDKKPPPPMKPAVLKEPPPIDVPTMSLAELKEKTENFGSKALIGEGSYGRVYYAKFNDGKAMAVKKLDNASEPETNVEFLTQVSKVSRLNNDNFVQLLGYCVEGNVRVLAYEFATMGSLHDILHGRKGVQGAQPGPTLEWMQRVRVAVDAAKGLEYLHEKVQPAVIHRDIRSSNVLLFEDFKAKIADYNLSNQAPDMAARLHSTRVLGTFGYHAPEYAMTGQLTQKSDVYSFGVVLLELLTGRKPVDHTMPRGQQSLXXXLLQG

SEQ ID NO: 12795 - protein, 410 aa, Pennisetum glaucum
LHPLPSAEEPPAKNIHRSEHASIRRLPAHQIDKKEEQEEFDRPLCAGGFAALISTHHILKIKNGFTSSPDRTSGNGLTSNSDPAKPPSIEVPALSFDELKEQTDDFGSKTLVGEGSYGRVYYAVLEHGKHAAVKKLDASADPEPDNEFHNEFLAQVSVVSRLKHENFVDMLGYCIEGDQRLLAYEFATMGSLHDILHGRKGVAGAQPGPALDWMQRVRIAVDAAKGLEYLHEKVQPSIVHRDIRSSNVLLFEDYRAKIADFNLSSQSPDMAARLHSTRVLGTFGYHAPEYAMTGQLTQKSDVYSFGVVLLELLTGRKPVDHTMPRGQQSLVTWATPRLGEDKVKQCIDPRLNGEYPPKGVAKLAAVAALCVQYESEFRPSMSIVVKALSPLLANAPYQAATAATDTPSDA

SEQ ID NO: 12796 - protein, 364 aa, Raphanus sativus
  misc_feature (27)..(27): Xaa can be any naturally occurring amino acid
MCKWMCCTCQIQDSNDEEHLKSSHQHXHQHHSDANHKNPKPPAVVAKPEVVRKEPLPIEVPSLSLDEVKEKTDNFGSKALIGEGSYGRVYYGTLNDGVAVALKKLDAAPEAESDSDFLSQVSMVSRLKHENLVQLLGFCVDGKLRVLAYEFATMGSLHDVLHGRKGVQGAQPGPTLDWTTRVKIAVEAARGLEYLHDKSQPPVIHKDIRSSNILLFEDYKPKISDFNLSNQSPDNAARLHSTRVLGTFGYHAPEYAMTGQLTQKSDVYSFGVVLLELLTGRKPVDNNMPRGQQSLVTWATPRLSEDKVKECIDPKLADYPPKAVAKLAAVAALCVQYEAEFRPNMSIVVKALQPLLKPAAAPSS

SEQ ID NO: 12797 - protein, 361 aa, Setaria italica
MRRWFCCTHFDTPYLENENGFTSSPDRTSGNGLTSNSDPAKPPSIEVPALLFDELKEKTDDFGSKTLVGEGSYGRVYYAVLENGKHAAVKKLDASADPEPDNEFLAQVSVVSRLKHENFVDMLGYCIEGDQRLLAYEFATMGSLHDILHGRKGVAGAQPGPALDWMQRVRIAVDAAKGLEYLHEKVQPSIVHRDIRSSNVLLFEDYKAKIADFNLSSQSPDMAARLHSTRVLGTFGYHAPEYAMTGQLTQKSDVYSFGVVLLELLTGRKPVDHTMPRGQQSLVTWATPRLGEDKVKQCIDPRLNGEYPPKGVAKLAAVAALCVQYESEFRPSMSIVVKALSPLLANAPYQAAAATDTPSDA

SEQ ID NO: 12798 - protein, 107 aa, Amaranthus tuberculatus
QLTQKSDVYSFGVVLLELLTGRKPVDHTMPRGQQSLVTWATPRLSEDKVKQCVDPRLKDYPAKGVAKLAAVAALCVQYEGEFRPNMSIVVKALQPLLKAAAPAPDAA

SEQ ID NO: 12799 - protein, 210 aa, Cynodon dactylon
GRKGVQGAQPGPALDWMQRVKIAVDAAKGLEFLHEKVQPSIVHRDVRSSNILLFEDFMAKIADFNLSNQAPDMAARLHSTRVLGTFGYHAPEYAMTGQLTQKSDVYSFGVVLLELLTGRKPVDHTMPRGQQSLVTWATPRLTEDKVKQCVDPRLGEYPAKGVAKLAAVAALCVQYEAEFRPNMSIVVKALSPLLVNKQTPAPAQPPALEN

SEQ ID NO: 12800 - protein, 365 aa, Pennisetum glaucum
MRRWFCCTQFHASYREHENELPVSPDEKEGNGFVANSEPIKAPPRIEVPELSFEELKEKTDNFGSKALIGEGSYGRVYYAVLDSEKHVAVKKLDASTDPELDNEFLTQVSIASKLKHANFVEMLGYCVEGNQRLVAYEFATMGSLHDILHGRKGVPGAQPGPALDWMQRVKIAIDAAKGLEYLHEKVQPSIVHRDIRSSNVLLFEDYKAKIADFNLSNQSPDMAARLHSTRVLGTFGYHAPEYAMTGQLTQKSDVYSFGVVLLELLTGRKPVDHTMPRGQQSLVTWATPRLTEDTVKQCVDPRLKGEYPPKGVAKLAAVAALCVQYESEFRPSMSIVVKALSPLLQHKPQPPRTAAPDATAPSDA

SEQ ID NO: 12801 - protein, 364 aa, Avena sativa
MRRWFCCTQFHASYREHEHEFPSSPDEKEENGFASKSDPTKAPPPIEIPEMSLDELKEKTDNFGSKALIGEGSYGRVYYATLDSGKHIAVKKLDTSADPEPDNEFLTQLSIVSRLKHENFVEMLGYCVEGNQRLVAYEFATMGSLHDILHGRKGVPGAQPGPALDWLQRVKIAIDAAKGLAYLHEKVQPSIVHRDIRSSNVLLFEDYRAKVADFNLSNQSPDMAARLHSTRVLGTFGYHAPEYAMTGQLTQKSDVYSFGVVLLELLTGRKPVDHTMPRGQQSLVTWATPRLTEDTVKQCIDPRLKGDYPPKGVAKLAAVAALCVQYESEFRPSMSIVVKALSPLLQHKPQPPPAAAPDTTASDA

SEQ ID NO: 12802 - protein, 365 aa, Saccharum officinarum
MRRWFCCTQFNASYREHENERPISPEEKEGNGFAVKSDPIKVPPSIEVPELSFEELKEKTDNFGSKALIGEGSYGRVYYAILDSEKHVAVKKLDASTDPELDNEFLTQVSIASKLKHDNFVEMLGYCVEGNQRLVAYEFATMGSLHDILHGRKGVPGAQPGPALDWMQRVKIAIDAAKGLEYLHEKVQPSIVHRDIRSSNILLFEDYKAKIADFNLSNQSPDMAARLHSTRVLGTFGYHAPEYAMTGQLTQKSDVYSFGVVLLELLTGRKPVDHTMPRGQQSLVTWATPRLTEDTVKQCVDPRLKGEYPPKGGAKLAAVAALCVQYESEFRPSMSIVVKALSPLLQHKPQPPPATTTDATAPSDA

SEQ ID NO: 12803 - protein, 112 aa, Brassica juncea
GQLTQKSDVYSFGVVLLELLTGRKPVDHTMPRGQQSLVTWATPRLSEDKVKQCVDPKLKGDYPPKAVAKLAAVAALCVQYESEFRPNMSIVVKALQPLLRSSTAVAVQSQGI

SEQ ID NO: 12804 - protein, 118 aa, Pteridium aquilinum
MGNCCSCPCGSQEEVPPITQNASGAINGNNGTTGAYTIDSAASIANVQPIDAPLISLDVLKEATDNFGPKSLIGEGSYGRVYFGHVVNGRAAAIKKLDEITNKKWTTSFWHRFLLSPD

SEQ ID NO: 12805 - protein, 362 aa, Hordeum vulgare
MRRWFCCAHVDTPYEENGDEFPHSPERANGNGFTQIGDQGKAPPSIQVPELSFDELKEKTDDFGSKALVGEGSYGRVYYAVLENGTHVAVKKLDTSADPEPDNEFIAQVSVISRLKHEHFVDLLGYCLEGDQRLLAYEFATMGSLHDILHGRKGVAGAQPGPALDWMQRINIAVDAAKGLEYLHEKVQPSVVHRDIRSSNVLLFEDYKAKIADFNLSNQSPDMAARLHSTRVLGTFGYHAPEYAMTGQLTQKSDVYSFGVVLLELLTGRKPVDHTMPRGQQSLVTWATPRLGEDKVKQCVDPRLNGEYPPKGVAKLAAVAALCVQYESEFRPSMSIVVKALSPLLINKPQQQPGAPDTPSDT

SEQ ID NO: 12806 - protein, 359 aa, Brachypodium distachyon
MRRWFCCAHVDTPYHEHGDGFVNSPEKANGNGFTPDGDHGKTPLPIEVPELSFAELKEKTDDFGSKALVGEGSYGRVYYAVLENGKHVAVKKLDTSADPEPDNEFIAQVSVISRLKHDNFVDMLGYCLEGDQRLLAYEFATMGSLHDILHGRKGVAGAQPGPALDWMQRIKIVVDAAKGLEYLHEKVQPSVVHRDIRSSNVLLFEDYKAKIADFNLSNQSPDMAARLHSTRVLGTFGYHAPEYAMTGQLTQKSDVYSFGVVLLELLTGRKPVDHTMPRGQQSLVTWATPRLGEDKVTQCVDPRLNGEYPPKGVAKLAAVAALCVQYESEFRPSMSIVVKALSPLLVNKPQQQQPTPLDA

SEQ ID NO: 12807 - protein, 115 aa, Leymus cinereus x Leymus triticoides
LEGDQRLLAYEFATMGSLHDILHGRKGVAGAQPGPALDWMQRINIAVDAAKGLEYLHEKVQPSVVHRDIRSSNVLLFEDYKAKIADFNLSNQSPDMAARLHSTRVLGTFGYHAPE

SEQ ID NO: 12808 - protein, 171 aa, Pseudoroegneria spicata
  misc_feature (12)..(12): Xaa can be any naturally occurring amino acid
VHRDIRSSNVLXFEDYKAKIADFNLSNQSPDMAARLHSTRVLGTFGYHAPEYAMTGQLTQKSDVYSFGVVLLELLTGRKPVDHTMPRGQQSLVTWATPRLGEDKVKQCVDPRLNGEYPPKGVAKLAAVAALCVQYESEFRPSMSIVVKALSPLLINKPQQQPGAPDTPSDT

SEQ ID NO: 12809 - protein, 147 aa, Saccharum officinarum
LSSQSPDMAARLHSTRVLGTFGYHAPEYAMTGQLTQKSDVYSFGVVLLELLTGRKPVDHTMPRGQQSLVTWATPRLGEDKVKQCVDPRLNGEYPPKGVAKLAAVAALCVQYESEFRPSMSIVVKALSPLLVNAPYQAAGAPDISSDA

SEQ ID NO: 12810 - protein, 189 aa, Panicum virgatum
MRRWFCCTHFDTPYLENENGFTKSPDRTSGNGLTSNSDPAKPPSIEVPALSFDELKEKTDDFGSKTLVGEGSYGRVYYAVLENGKHAAVKKLDASADPEPDNEFLAQVSVVSRLKHENFVDMLGYCIEGDQRLLAYEFATMGSLHDILHGRKGVAVRSLVLLSTGCKESELLLMLQKVLSTFMRKFNLP

SEQ ID NO: 12811 - protein, 221 aa, Linum usitatissimum
CIHGFIHDVLHGRKGVQGAEPGPALNWSQRVKIAFGAAKGLGYLHEKCQPPIVHRDVRSSNVLLFDEFTSKIADFNISSASSDTAARLHSTRVLGTFGYHAPEYAMTGQITQKSDVYSFGVVLLELLTGRKPVDHTMPKGQQSLVTWATPRLSEDKVKQCVDPKLNNEYPPKAVAKLAAVAALCVQYEADFRPNMTIVVKALQPLLNARPAAGPDPAAAHG

SEQ ID NO: 12812 - protein, 325 aa, Humulus lupulus
REAAPREIRTVPVQPIAVPGISIDDLKEMTDSFGTKALIGEGSYGRVYRGVLKTGQTAAIKKLDSSKQPEQEFLAQISMVSRLKHENVVQLLGYCVDGPLRVLAYEYASNGSLHDLLHGKKGVKGAQPGPVLSWPQRVKIAVGAARGLEYLHEKAQPHIIHRDIKSSNILLFDYDVAKIADFDLSNQAPDAAARLHSTRVLGTFGYHAPEYAMTGQLSSKSDVYSFGVVLLELLTGRKPVDHTLPRGQQSLVTWATPKLSEDKVKQCVDARLNGEYPPKAVAKLAAVAALCVQYEADFRPNMSIVVKALQPLLNPRPAPSPGPPQ

SEQ ID NO: 12813 - protein, 361 aa, Triticum aestivum
MRRWFCCAHVDTPYQENGDEFPNSPERANGNGFTQVGDQGKAPPSIEVPELSFDELKEKTDDFGSKALVGEGSYGRVYYAVLENGTHVAVKKLDTSADPEPDNEFIAQVSVISRLKHEHFVDMLGYCLEGDQRLLAYEFATMGSLHDILHGRKGVAGAQPGPALDWMQRINIAVDAAKGLEYLHEKVQPSVVHRDIRSSNVLLFEDYKAKIADFNLSNQSPDMAARLHSTRVLGTFGYHAPEYAMTGQLTQKSDVYSFGVVLLELLTGRKPVDHTMPRGQQSLVTWATPRLGEDKVKQCIDPRLNGEYPPKGVAKLAAVAALCVQYESEFRPSMSIVVKALSPLINKPQQPPGAPDTPSDT

SEQ ID NO: 12814 - protein, 169 aa, Scabiosa columbaria
GAARGLEHLHEKIQPSIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKLYPPKAVAKMAAVAALCVQYESEFRPNMSIVVKALQPL

SEQ ID NO: 12815 - protein, 366 aa, Physcomitrella patens
MGCWCWPDKEPHNESTDPHSHYLPHNGNMGHQGMSGSTPGEQPQRTGQGPTRVQPISAPQLSLDEIRDCTDNFGPKSLIGEGSYARVYYASLPDRVAAIKKLDVSSQPDSEFLSQVSLVSRLKHENVVELIGYCLDGQLRVLAYEYATMGSLHDILHGRKGVKGAQPGPVLDWMQRVKIAVGAARGLEYLHEKAQPPIIHRDIKSSNVLLFDSYVAKIADFNLSNQAPDMAARLHSTRVLGTFGYHAPEYAMTGQLTQKSDVYSFGVVLLELLTGRKPVDPTMPRGQQSLVTWATPRLSEDKVKQCVDPKLRSEYPPKAVAKMAAVAALCVQYEPDFRPNMSIVVKALQPLLSARPAPQGGGYQGE

SEQ ID NO: 12816 - protein, 130 aa, Pseudotsuga menziesii
LHSTRVLGTFGYHAPEYAMTGQLSQKSDVYSFGVVLLELLTGRKPVDHTMPRGQQSLVTWATPRLSEDKVKQCVDSRLKGDYPPKAVAKMAAVAALCVQYEADFRPNMSIVVKALQPLLNARPVPAGRSP

SEQ ID NO: 12817 - protein, 159 aa, Sequoia sempervirens
MSTFCTTTWQRLLILYLSNQAPDMAARLHSTRVLGTFGYHAPEYAMTGQLSQKSDVYSFGVVLLELLTGRKPVDHTLPRGQQSLVTWATPRLSEDKVKQCVDPRLKGDYPPKAVAKMAAVAALCVQYEADFRPNMSIVVKALQPLLNARPAHANDSPSI

SEQ ID NO: 12818 - protein, 234 aa, Taxus baccata
MVSRLKHENVLELVGYSVEGNLRALAYEFATMGSLHDILHGRKGVKGAQPGPVLTWMQRVKIAIEAAKGLEYLHEKAQPSIIHRDIKSSNILLFDDCTAKIADFDLSNQAPDMAARLHSTRVLGTFGYHAPEYAMTGQLSQKSDVYSFGVVLLELLTGRKPVDHTMPRGQQSLVTWATPRLSEDKVKQCVDSKLKSEYPPKAVAKMAAVAALCVQYEADFRPNMSIVVKALNLC

SEQ ID NO: 12819 - protein, 119 aa, Allium cepa
MTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALSPLLANKQPHAAPPPPVAVPDI

SEQ ID NO: 12820 - protein, 139 aa, Raphanus sativus
  misc_feature (26)..(26): Xaa can be any naturally occurring amino acid
  misc_feature (66)..(66): Xaa can be any naturally occurring amino acid
  misc_feature (83)..(83): Xaa can be any naturally occurring amino acid
  misc_feature (85)..(85): Xaa can be any naturally occurring amino acid
MAARLHSTRVLGTFGYHAPEYAMTGXLTQKSDVYSFGVVLLELLTGRKPVDHTMPRGQQSLVTWAXPRLSEDKVKQCVDPKLXGXYPPKAVAKLAAVAALCVQYESEFRPNMSIVVKALQPLLKSSRSSTAAATPSQET

SEQ ID NO: 12821 - protein, 368 aa, Pennisetum glaucum
MWRRWVCCNCQVDESDQRGNGQFKVTTNNADGMTKGFKDSATGKVEPPNAAPPINIPVLSLDELVEKTDDFGSSALIGEGSYGRVYYAILDNGTKMAVKKLDSTENEPTTEFLTQVSLVSRLKHENFVDMLGYCTERNLRIVAYEFATMGSLHDVLHGRKGVQGAQPGPALNWMQRAKIAVDAAKGLEYLHEKVQPSIVHRDIRSSNILLFEDFKAKIADFNLSNQAPDMAARLHSTRVLGTFGYHAPEYAMTGQLTQKSDVYSFGVVLLELLTGRKPVDHTMPRGQQSLVTWATPRLTEDKVKQCVDPRLMGEYPAKGLAKLAAVAALCVQYEAEFRPNMSIVVKALSPLLVSKQTPTPAPPPAVDS

SEQ ID NO: 12822 - protein, 85 aa, Cucurbita pepo
AMTGQITQKSDVYSFGVVLLELLTGRKPVDHTMPKGQQSLVTWATPRLSEDKVKQCVDPKLNNDYPPKSYSKVGSSCSLVCSVRG

SEQ ID NO: 12823 - protein, 365 aa, Ricinus communis
MLCCGGAEEELDGPPANQYTAPPKGGNNYAGGGERAEPRSNNPAKSGTPQKVLPIEVPALSLDELNRLTGNFGTKALIGEGSYGRVFYAKLNNGEEAAIKKLDTSTSQEPDSDFAAQLSVVSRLKHEHFVELIGYCLEANNRILIYQFATMGSLHDVLHGRKGVQGAEPGPALSWNQRVIVAYGAAKGLEYLHEKVQPSVVHRDVRSSNVLLFDDFTSKIADFNLSSASSDTAARLHSTRVLGTFGYHAPEYAMTGQITQKSDVYSFGVVLLELLTGRKPVDHTMPKGQQSLVTWATPRLSEDKVKQCVDPKLNNDYPPKAVAKLAAVAALCVQYEADFRPNMTIVVKALQPLLNSKPAGPESHT

SEQ ID NO: 12824 - protein, 368 aa, Populus trichocarpa
MFCCGGNEEEPHGPPANQYTAPPKGANIYGGGGSSSARGEPRGANQARSGAPQKVLPIEIPSIPLDELNRMTGNFGTKALIGEGSYGRVFYAKLKDGMPAAIKKLDTSSSQEPDSDFEAQLSVVSRLKHEHFVELTGYCLEANNRILVYQFAVMGSLHDVLHGRKGVEGAEPGPVLNWNQRVKIAYGAAKGLEYLHEKVQPSIVHRDVRSSNVLLFDDFLSKIADFNLSNANSDTAARLHSTRVLGTFGYHAPEYAMTGQITQKSDVYSFGVVLLELLTGRKPVDHTMPKGQQSLVTWATPRLSEDKVKQCVDPKLNNDYPPKAVAKLAAVAALCVQYEADFRPNMTIVVKALQPLLNSKPAGPESQA

SEQ ID NO: 12825 - protein, 113 aa, Cannabis sativa
MTGQLSSKSDVYSFGVVLLELLTGRKPVDHTLPRGQQSLVTWATPKLSEDKVKQCVDARLNGEFPPKAVAKLAAVAALCVQYEADFRPNMSIVVKALQPLLNPRPAPSPGPPQ

SEQ ID NO: 12826 - protein, 215 aa, Pteridium aquilinum
MGSLHDILHGRKGVQNAQPGPVLDWMQRVKIAVGAARGLEYLHEKVQPSIIHRDIRSSNVLLFDDYTAKIADFNLSNQAPDMAARLHSTRVLGTFGYHAPEYAMTGHLTQKSDVYSFGVVLLELLTGRKPVDHTLPRGQQSLVTWATPRLSEDKVKQCVDPKLKPDYPIKAVAKMAAVAALCVQYEADFRPNMSIVVKALQALLTPRPAPGASPA

SEQ ID NO: 12827 - protein, 339 aa, Zea mays
MWRRCCCNCQVDESDQHENGHVKATINNIDGAIMGLKDSTTGKVEPQDAAPQIDIPVLSLDELIEKTDDFGSTALIGEGSYGRVYYAILDNGTKMAVKKLDSTENEPTAEFLTQVSLVSRLKHENFVDMLGYCMERNLRIVAYEFATMGSLHDVLHGRKGVQGAQPGLALDWMQRVQIAVDAAKGLEYLHEKVQPSIVHRDIRSSNILLFEDFKAKIADFNLSNQAPDMAARLHSTRVLGTFGYHAPEYAMTGQLTQKSDVYSFGVVLLELLTGRKPVDHTMPRGQQSLVTWATPRLTEDKVKQCVDPRLMGEYPAKGLAKLAAVAALCVQYEAEFAQI

SEQ ID NO: 12828 - protein, 120 aa, Cedrus atlantica
MRCFSCCTADDIHKSADSGSPFLSNGNVTGNSGRHKGAETSKDGQIIQPLLIEVPQIPIEELREVTDNFGPKSLIGEGSYGRVYYSVLRSGRTAAIKKLDTSKQPIKIPCTGVHGFKIET

SEQ ID NO: 12829 - protein, 363 aa, Cephalotaxus harringtonia
MRCFGCWTADDIQKSADAGSPFLSNGNMAGNNGAHKAADTTNKDGLVLQPLPIGVPEIPVDELREATDNFGPKSLIGEGSYGRVYYSSLRSGRPAAIKKLDTSKQSDQEFLAQVSMVSRLKHENVLELVGYCVEGNLRALAYEFATMGSLHDILHGRKGVKGAQPGPVLTWMQRVKIAIEAAKGLEYLHEKAQPSIIHRDIKSSNILLFDDCTAKIADFDLSNQAPDMAARLHSTRVLGTFGYHAPEYAMTGQLSQKSDVYSFGVVLLELLTGRKPVDHTMPRGQQSLVTWATPRLSEDKVKQCIDSKLKSDYPPKAVAKMAAVAALCVQYEADFRPNMSIVVKALQPLLNVKSVPNSGSPAL

SEQ ID NO: 12830 - protein, 202 aa, Brassica napus
VQGAEPGPVLNWNQRVKIAYGAARGLEFLHEKVQPSVVHRDVRSSNVLLFNDFVAKMADFNLTNASSDSAARLHSTRVLGTFGYHAPEYAMTGQITQKSDVYSFGVVLLELLTGRKPVDHTMPKGQQSLVTWATPRLSEDKVKQCIDPKLNNDFPPKAVAKLAAVAALCVQYEADFRPNMTIVVKALQPLLNSRPAGPESTS

SEQ ID NO: 12831 - protein, 366 aa, Ceratodon purpureus
MGWCCCSAEEEDFNKVSNDAHNQFSGHNGNPGHQGNQRPQGDQPQRAGQAQRLQPIAAPQLSIDEIRECTDNFGPKSLIGEGSYGRVYYAQLQDRVAAIKKLDASAQPDSEFLSQVSLVSRLKHENVVELIGYCLDGQLRVLAYEYATMGSLHDILHGRKGVKGAQPGPVLDWMQRVKIAVGAARGLEYLHEKAQPSIIHRDIKSSNVLLFDSYVAKIADFNLSNQAPDMAARLHSTRVLGTFGYHAPEYAMTGQLTQKSDVYSFGVVLLELLTGRKPVDPTMPRGQQSLVTWATPRLSEDKVKQCVDPKLRSEYPAKAVAKMAAVAALCVQYEADFRPNMSIVVKALQPLLTARPAPQAGGFQGE

SEQ ID NO: 12832 - protein, 368 aa, Setaria italica
MWCRWVCCNCQVDESDQRENGQFKVTTNNADGMTKGFKDSATGKVEPQNAAPPINIPVLSLDELIEKTDDFGSTALIGEGSYGRVYYAVLDNGTKMAVKKLDSTENEPTTEFLTQVSLVSRLKHENFVDMLGYCTERNLRIVAYEFATMGSLHDVLHGRKGVQGAQPGPALDWMQRVKVAVDAAKGLEYLHEKVQPSIVHRDIRSSNILLFEDFKAKIADFNLSNQAPDMAARLHSTRVLGTFGYHAPEYAMTGQLTQKSDVYSFGVVLLELLTGRKPVDHTMPRGQQSLVTWATPRLTEDKVKQCVDPRLKGEYPAKGLAKLAAVAALCVQYEAEFRPNMSIVVKALSPLLVSKQTQTPAPPPAVDS

SEQ ID NO: 12833 - protein, 366 aa, Brassica napus
MRRWLCCACHVEEPYHTTENDHRRSPKHHNGHNKNQEVSVRPDALNVPPAIDVPALSLDELKEKTDNFGSKALIGEGSYGRAYYATLKDGRAVAVKKLDNSAEPESNFEFLTQVSRVSKLQHENFVQLFGYCVEGNLRILAYEFATMGSLHDILHGRKGVQGAQPGPTLDWTQRVRIAVEAARGLEYLHEKVQPAVIHRDVRSSNVLLFEDFKAKIADFNLSNQSPDMAARLHSTRVLGTFGYHAPEYAMTGSLTQKSDVYSFGVVLLELLTGRKPVDHTMPRGQQSLVTWAAPRLSEDKVKQCVDPKLNGDYPPKAVAKLAAVAALCVQYESEFRPNMSIVVKALQPLLKSSRSSTAVATPSQET

SEQ ID NO: 12834 - protein, 359 aa, Setaria italica
MWCCSGAEEEPLAVPPAGNPAYTPPRAPAHPRGPSMPRPGAASAAKVLPIDVPAFPLSELNRLTGNFGDRALVGEGSYGRVYRAKLGTGEAVAVKMFDNGGSSGQSEAEFCEQLSVVSRLKCEHFTQLLGYCLELNNRIVLYQFATMGSLYDILHGKKGVQGAEPGPVLTWSQRARIAYGAARGLEYLHEKARPSIVHRDVRSSNVLVFDGHDAKIGDFNLTNQSPDSAARLHSTKVLGTFGYHAPEYAMTGQLTQKSDVYSFGVVLLELLTGRKPVDHTMPKGQQSLVTWATPRLSEDKVKQCVDPKLKDDYPPKAVAKLAAVAALCVQYEADFRPNMTIVVKALQPLVTARPGGDHP

SEQ ID NO: 12835 - protein, 334 aa, Sorghum bicolor
HPRGPNMPRSGAASAAKVLPIDVPAVALSELNRLTGNFGDRALVGEGSYGRVYRAKLGTGETVAVKMFDNGSSSGQSEAEFCEQLSVVSRLKCEHFTQLLGYCLELNNRIVLYQFATMGSLYDILHGKKGVKGAEPGPVLTWSQRARIAYGAARGLEHLHEKARPSIVHRDVRSSNVLVFDGHDAKIGDFNLTNQSPDSAARLHSTKVLGTFGYHAPEYAMTGQLTQKSDVYSFGVVLLELLTGRKPVDHTMPKGQQSLVTWATPRLSEDKVKQCVDPKLKDDYPPKAVAKLAAVAALCVQYEADFRPNMTIVVKALQPLVNARPGGESPVVQY

SEQ ID NO: 12836 - protein, 369 aa, Solanum lycopersicum
MSCCGGGEEDVYSGGPPSNQNTAPPRAGNPYGGGAGGASDRGEPRSAARGGTPQKVLPIEAPVFTLDELNRLTGNFGQKALVGEGSYGRVFCAKLSNGQQVAIKKLDTSASPEPDSDFAAQLSMVSRLKNEHFMTLMGYCLEGNNRILVYEFATMGSLHDVLHGRKGVQGAEPGPVLTWNQRVKIAYGAAKGLEYLHEKIQPPVVHRDVRSSNALLFDDFTAKVADFNISNQSSDTAARLHSTRVLGTFGYHAPEYAMTGQITQKSDVYSFGVVLLELLTGRKPVDHTMPKGQQSLVTWATPRLSEDKVKQCVDPKLNNDYPPKAIAKLAAVAALCVQYEADFRPNMTIVVKALQPLLNSKPAGPESQA

SEQ ID NO: 12837 - protein, 369 aa, Solanum phureja
MSCCGGGEEDVYSGGPPSNQNTAPPRAGNPYGGGTGGASDRGEPRSAARGGTPQKVLPIEAPVFTLDELNRLTGNFGQKALVGEGSYGRVFCAKLSNGQQVAIKKLDTSASPEPDSDFAAQLSMVSRLKNEHFMTLIGYCLEGNNRILVYEFATMGSLHDVLHGRKGVQGAEPGPVLTWNQRVKIAYGAAKGLEYLHEKIQPPVVHRDVRSSNALLFDDFTAKVADFNISNQSSDTAARLHSTRVLGTFGYHAPEYAMTGQITQKSDVYSFGVVLLELLTGRKPVDHTMPKGQQSLVTWATPRLSEDKVKQCVDPKLNNDYPPKAIAKLAAVAALCVQYEADFRPNMTIVVKALQPLLNSKPAGPESQA

SEQ ID NO: 12838 - protein, 364 aa, Sorghum bicolor
MWCCRGAEDEPHAAPLAAANPAATPPRAPAHPRGPNMPRSGAASAAKVLPIDVPAVALSELNRLTGNFGDRALVGEGSYGRVYRAKLGTGETVAVKMFDNGSSSGQSEAEFCEQLSVVSRLKCEHFTQLLGYCLELNNRIVLYQFATMGSLYDILHGKKGVKGAEPGPVLTWSQRARIAYGAARGLEHLHEKARPSIVHRDVRSSNVLVFDGHDAKIGDFNLTNQSPDSAARLHSTKVLGTFGYHAPEYAMTGQLTQKSDVYSFGVVLLELLTGRKPVDHTMPKGQQSLVTWATPRLSEDKVKQCVDPKLKDDYPPKAVAKLAAVAALCVQYEADFRPNMTIVVKALQPLVNARPGGESPVVQY

SEQ ID NO: 12839 - protein, 369 aa, Nicotiana tabacum
MSCCGGGEEDVYSGGPPSNQNTAPPRAGNPYGGGTGGASERGEPRSAARGGAPQKVLPIEAPVFTLDELNRLTGNFGQKALVGEGSYGRVFCAKLSNGQQAAIKKLDTSSSPEPDSDFAAQLSMVSALKHEHFMTLMGYCLEGNNRILVYEFATKGSLHDVLHGRKGVQGAEPGPVLTWNERVKIAYGSAKGLEYLHEKVQPPIVHRDVRSSNVLLFDDFTAKIADFNISNQSSATAARLHSTRVLGTFGYHAPEYAMTGQITQKSDVYSFGVVLLELLTGRKPVDHTMPKGQQSLVTWATPRLSEDKVKQCVDPKLNNDYPPKAIAKLAAVAALCVQYEADFRPNMTIVVKALQPLLNSKPAGPESQA

SEQ ID NO: 12840 - protein, 157 aa, Brassica napus
MSCFGCFGGGEDFRRVSETGPKPFHNRDGINAHHHKADPPKNSPVIQMQPISVPAIPADELKDITDNYGSKSLIGEGSYGRVFYGVLKPETQLPSRSLIPVSNLIKSFSRRYQWFRDCVKTMSLRFWGTASMDRSVFLLMNLPLMDLFMIFSTVEKV

SEQ ID NO: 12841 - protein, 332 aa, Brassica napus
HHHKADPPKNSPVIQMQPISVPAIPADELKDITDNYGSKSLIGEGSYGRVFYGVLKTGNAAAIKKLDSSKQPDQEFLAQVSMVSRLRQDNVVALLGYCVDGPLRVLAYEFASNGSLHDILHGRKGVKGAQPGPVLSWNQRVKIAVGAARGLEYLHEKANTHVIHRDIKSSNVLLFDDDVAKIADFDLSNQAPDMAARLHSTRVLGTFGYHAPEYAMTGTLSTKSDVYSFGVVLLELLTGRKPVDHTLPRGQQSLVTWATPKLSEDKVKQCVDARLNGEYPPKAVAKLAAVAALCVQYEADFRPNMSIVVKALQPLLNPPRSAPQTPHRNNPY

SEQ ID NO: 12842 - protein, 364 aa, Eutrema halophilum
MSCFGCCGGEDFRRVAETGPKPVHNAAGYNGGHHQRADPPKYPPVIQMQPIAVPAIPADELKDITDNYGSKSLIGEGSYGRVFYGVLKSGKAAAIKKLDSSKQPDQEFLAQVSMVSRLRQDNVVALLGYCVDGPLRVLAYEYAPNGSLHDILHGRKGVKGAQPGPVLSWHQRVKIAVGAARGLEYLHEKANPHVIHRDIKSSNVLLFDDDVAKIADFDLSNQAPDMAARLHSTRVLGTFGYHAPEYAMTGTLSTKSDVYSFGVVLLELLTGRKPVDHTLPRGQQSLVTWATPKLSEDKVKQCVDARLNGEYPPKAVAKLAAVAALCVQYEADFRPNMSIVVKALQPLLNPPRSAPQTPHRNNPY

SEQ ID NO: 12843 - protein, 363 aa, Arabidopsis lyrata
MSCFGCCGGEDFRRVAETGPKPVHNTGGYNGGHHQRADPPKNPPVIQMQPISVAPIPADELRDITDNYGGKSLIGEGSYGRVFYGILKSGKAAAIKKLDSSKQPDQEFLAQVSMVSRLRQDNVVALLGYCVDGPLRVLAYEYAPNGSLHDILHGRKGVKGAQPGPVLSWHQRVKIAVGAARGLEYLHEKANPHVIHRDIKSSNVLLFDDDVAKIADFDLSNQAPDMAARLHSTRVLGTFGYHAPEYAMTGTLSTKSDVYSFGVVLLELLTGRKPVDHTLPRGQQSLVTWATPKLSEDKVKQCVDARLNGEYPPKAVAKLAAVAALCVQYEADFRPNMSIVVKALQPLLNPPRSAPQTPHRNPY

SEQ ID NO: 12844 - protein, 181 aa, Brassica juncea
EYLHEKANPHVVHRDIKSSNVLLFDDDVAKIADFDLSNQAPDMAARLHSTRVLGTFGYHAPEYAMTGTLSTKSDVYSFGVVLLELLTGRKPVDHTLPRGQQSLVTWATPKLSEDKVKQCVDARLNGEYPPKAVAKLAAVAALCVQYEADFRPNMSIVVKALQPLLNPPRSAPQTPHRNNPY

SEQ ID NO: 12845 - protein, 183 aa, Brassica juncea
GLEYLHEKANPHVVHRDIKSSNVLLFDDDVAKIADFDLSNQAPDMAARLHSTRVLGTFGYHAPEYAMTGTLSTKSDVYSFGVVLLELLTGRKPVDHTLPRGQQSLVTWATPKLSEDKVKQCVDARLNGEYPPKAVAKLAAVAALCVQYEADFRPNMSIVVKALQPLLNPPRSAPQTPHRNNPY

SEQ ID NO: 12846 - protein, 211 aa, Brassica juncea
GRKGVKGAQPGPVLSWHQRVKIAVGAAKGLEYLHEKANPHVVHRDIKSSSVLMFEDDAAKIADFDLSNQAPDMAARLHSTRVLGTFGYHAPEYAMTGTLSTKSDVYSFGVVLLELLTGRKPVDHTLPRGQQSLVTWATPKLSEDKVKQCVDARLNGEYPPKAVAKLAAVAALCVQYEADFRPNMSIVVKALQPLLNPPRSAPQTPHRNNPY

SEQ ID NO: 12847 - protein, 366 aa, Theobroma cacao
MFCCGGAEEEPNGPPANQYTAPPRGGNQFGGAGSGRGEPRASNVVKSGAPQKVLPIEIPAMTLDELNRMTGNFGTKALIGEGSYGRVFYAKLSNGQDAAIKKLDTSSSQEPDSDFGAQLSVVSRLKHEHFVELMGYCLEANNRILVYQYATMGSLHDVLHGRKGVQGAEPGPVLTWNQRVKVAYGAAKGLEYLHEKVQPSIVHRDVRSSNVLLFDDFMAKIADFNLTNQSSDTAARLHSTRVLGTFGYHAPEYAMTGQITQKSDVYSFGVVLLELLTGRKPVDHTMPKGQQSLVTWATPRLSEDKVKQCVDPKLSNDYPPKAIAKLAAVAALCVQYEADFRPNMTIVVKAIQPLLNAKPAGAESQA

SEQ ID NO: 12848 - protein, 146 aa, Cleome gynandra
YLSNQAPDMAARLHSTRVLGTFGYHAPEYAMTGTLSTKSDVYSFGVVLLELLTGRKPVDHTLPRGQQSLVTWATPRLSEDKVKQCVDARLNGEYPPKAIAKLAAVAALCVQYEADFRPNMSIVVKALQPLLNPPRSAPQTPQRNLY

SEQ ID NO: 12849 - protein, 364 aa, Brassica napus
MSCFGCCGGDDFRRVAETGPKPVYGAGGHGGGHHPRADPPKNTPVIQMQPISVPAIPADELKDITDNYGSKSLIGEGSYGRVFYGVLRSGKAAAIKKLDSSKQPDQEFLAQVSMVSRLRQDNVVALLGYCVDGPLRVLAYEFAPNGSLHDILHGRKGVKGAQPGPVLSWNQRVKIAVGAARGLEYLHEKANPHVVHRDIKSSNVLLFDDDVAKIADFDLSNQAPDMAARLHSTRVLGTFGYHAPEYAMTGTLSTKSDVYSFGVVLLELLTGRKPVDHTLPRGQQSLVTWATPKLSEDKVKQCVDARLNGEYPPKAVAKLAAVAALCVQYEADFRPNMSIVVKALQPLLNPPRSAPQTPHRNNPY

SEQ ID NO: 12850 - protein, 169 aa, Brassica napus
MEECFMVFSKTGNAAAIKKLDSSKQPDQEFLAQVSMVSRLRQDNVVALLGYCVDGPLRVLAYEFASNGSLHDILHGRKGVKGAQPGPVLSWNQRVKIAVGAARGLEYLHEKANTHVIHRDIKSSNVLLLMMISLRLLISICLIKPLTWLLAFTRLVCLEPLAITLQSMQ

SEQ ID NO: 12851 - protein, 315 aa, Fraxinus spp
MSSLLQFRRFLGDELKEITDNFGSDSLIGEGSYGRVYYGILKNGRAAAIKKLDASKQPDDEFLAQVSMVSRLKHENFVELLGYCVDGNQRVLAYEFASNGSLHDILHGRKGVKGAQPGPVLSWAQRVKIAVGAAKGLEYLHEKADPHIIHRDVKSSNVLIFDDDAAKIADFDLSNQAPDMAARLHSTRVLGTFGYHAPEYAMTGQLNSKSDVYSFGVVLLELLTGRKPVDHTLPRGQQSLVTWATPKLSEDKVKQCVDGRLGGEYPPKSVAKMAAVAALCVQYEADFRPNMSIVVKALQPLLNARPGPAGEAGQT

SEQ ID NO: 12852 - protein, 190 aa, Pinus pinaster
MQRVKIAVEAAKGLEYLHEKAQLPIIHRDIKSSNILLFDDCTAKIADFDVSNQAPDMAARLHSTRVLGTFGYHAPEYAMTGQLSQKSDVYSFGVVLLELLTGRKPVDHTMPRGQQSLVTWATPRLSEDKVKQCVDSRLKSDYPPKAVAKMAAVAALCVQYEADFRPNMSIVVKALQPLLNARPVSAGRSP

SEQ ID NO: 12853 - protein, 360 aa, Phaseolus coccineus
MGCFGFCKGDDSVAISDRGPFMQNTPTGNASYHGRHNAVTAPRPINFQPIAVPSITVDELKSLTDSFGSKSFIGEGAYGKVYQATLKTGRAVVIKKLDSSNQPEQEFLSQVSIVSRLRHENVVELVNYSVDGSFRALSYEYAPKGSLHDILHGRKGVKGAQPGALLSWAQRVKIAVGAARGLEYLNEKAEIHIIHRYIKSSNILLFDDDVAKIADFDLSNQAPDAAARLHSTRVLGTFGYHAPEYAMTGQLTSKSDVYSFGVILLELLTGRKPVDHTLPRGQQSLVTWATPKLSEDKVKQCVDVRLKGEYPSKSVAKMAAVAALCVQYEAEFRPNMSIIVKALQPLLNTRSTPSKESPNM

SEQ ID NO: 12854 - protein, 232 aa, Cleome gynandra
CVDGSSRILAYEFAKNGSLHDILHGRKGVKGAQPGPVLSWHQRVKIAVGAARGLEYLHEKAEPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVKQCVDARLGGEYPPKAVAKLAAVAALCVQYEADFRPNMSIVVKALQPLLNARPGPTGEGAVP

SEQ ID NO: 12855 - protein, 363 aa, Cryptomeria japonica
MICFSCCREDEIQHTSDGTSPFMPNAHLTGNDGIYKSADTAFKGNQNIKPQPIAVPEITVEELREATDNFGEKSLIGEGSYGRVYHATLRNGRVTAIKKLDSSKQPDQELLAQVSMVSRLKHENVVELVGYCVDGILRTLAYEFATMGSLHDILHGRKGVKGAQPGPVLCWMERVKIAVGSAKGLEYLHEKLQPPIIHRDIKSSNVLLFDDYLAKIADFDLSNQAPDMAARLHSTRVLGTFGYHAPEYALTGQLSQKSDVYSFGVVLLELLTGRKPVDHTLPRGQQSLVTWATPRLSEDKVKQCVDPRLKGDYPPKAIAKMAAVAALCVQYEADFRPNMSIVVKALQPLLNARPAHANDSPSM

SEQ ID NO: 12856 - protein, 135 aa, Setaria italica
MRRWFCCTHFDTPYLENENGFTSSPDRTSGNGLTSNSDPAKPPSIEVPALLFDELKEKTDDFGSKTLVGEGSYGRVYYAVLENGKHAAVKKLDASADPEPDNEFLAQVSVVSRLKHENFVDMLGYCIERDQRLWL

SEQ ID NO: 12857 - protein, 357 aa, Pennisetum glaucum
MSCLACCGGEDTQRAPDSGGPYPGGYPARNDAYRTADPTPRGTQPVKVQPIAVPTIPVEEIREVTKGFGDEALIGEGSFGRVYFGVLKNGRSAAIKKLDSSKQPEQEFLAQVSMVSRLKHDNVVELLGYCVDGNTRILAYEFATMGSLHDILHGRKGVKGAQPGPVLSWTQRVKIAVGAAKGLEYLHEKAQPHIIHRDIKSSNVLLFDDDMSKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGEYPPKSVAKFAAVAALCVQYEADFRPNMSIVVKALQPLLNARASNHPG

SEQ ID NO: 12858 - protein, 369 aa, Mimulus guttatus
MMCCGGAEEEPYSGPPANNYNSAPPKTGNNYGGAGGGDRGEPRSGAARNGQAQKVLPIELPSLPLSELNRLTSNFGTKALIGEGSYGRVFYAKLSDGQPAAIKKLDSSSSPEPDNDFTAQLSTVSRLKNEHFVGLLGYCLESDNRILVYEFATMGSLHDVLHGRKGVQGAEPGPVLTWGQRVKVALGAAKGLEFLHEKCQPSIVHRDVRSSNVLLFDDFVAKIADFSLTNQSSDTAARLHSTRVLGTFGYHAPEYAMTGQITQKSDVYSFGVVLLELLTGRKPVDHTMPKGQQSLVTWATPRLSEDKVKQCVDPKLNDDYPPKAIAKMAAVAALCVQYEADFRPNMTIVVKALQPLLNSTKPAGPDSNA

SEQ ID NO: 12859 - protein, 360 aa, Pinus taeda
MRCFSCCTADDIRMSADSGSPFLSNGNITGNSGGHKSAETSKDGQIIQPILIEVPQIPIEELKEATDNFGPKSLIGEGSYGRVYYSVLRNGRTAAIKKLDTSKQPDQEFLAQVSMVSRLKHENVLELVGYCVEGSLRVLAYEFATMGSLHDILHGRKGVRGAQPGPVLTWMQRVKIAVEAAKGLEYLHEKAQLPIIHRDIKSSNILLFDDCTAKIADFDVSNQAPDMAARLHSTRVLGTFGYHAPEYAMTGQLSQKSDVYSFGVVLLELLTGRKPVDHTMPRGQQSLVTWATPRLSEDKVKQCVDSRLKSDYPPKAVAKMAAVAALCVQYEADFRPNMSIVVKALQPLLNARPVSAGRSP

SEQ ID NO: 12860 - protein, 356 aa, Prunus persica
MSCFSCCVQDDIRKASENGPFVANNSAGSSGGYYHRETAPKDTQTVNILPIAVPAIPVDELKDLTDNFGTKSLIGEGSYGRVYHGVLKSGPAAAIKKLDSSKQPDQEFLSQVSMVSRLKHENVVELVGYCIDGPLRLLAYEYAPNGSLHDILHGRKGVKGAQAGPVLSWVQRVKIAVGAARGLEYLHEKAQPHIIHRDIKSCNILLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDARLNGEYPSKAVAKLAAVAALCVQYEADFRPNMSIVVKALQPLLNARSGPHH

SEQ ID NO: 12861 - protein, 355 aa, Oryza sativa
MWCCSGAEEELHGAPAANPAAPPPRAPGPPRGPNAPRAGGAPAKVLPIDVPAVALAELNRLTGNFGDRSLVGEGSYGRVYRATLSTGEAAAVKMFDNNGGSGQSEADFCAQLSVVSRLKCDHFTQLLGYCLELNNRIVLYEFATKGSLYDILHGKKGVKGAEPGPVLTWSQRARIAYGAARGLEYLHERAQPPIVHRDIRSSNALVFDGHDAKIGDFNLTNQSPDSAARLHSTKVLGTFGYHAPEYAMTGQLTQKSDVYSFGVVLLELLTGRKPVDHTMPKGQQSLVTWATPRLSEDKVKQCVDPKLNDEYPPKAVAKLAAVAALCVQYEADFRPNMTIVVKALQPLISARPGDH

SEQ ID NO: 12862 - protein, 356 aa, Sorghum bicolor
MSCLACCGGEDTQRTPDNGGPYPGGYPARDDAYRTADPTPRGAQPLKVQPIVPTIPVEEIREVTKAFGDEALIGEGSFGRVYFGVLENGRSAAIKKLDSSKQPEQEFLAQVSMVSRLKHDNVVELLGYCVDGNTRILAYEFATMGSLHDMLHGRKGVKGAQPGPVLSWIQRVKIAVGAAKGLEYLHEKAQPHIIHRDIKSSNVLLFDNDVSKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGEYPPKSVAKFAAVAALCVQYEADFRPNMSIVVKALQPLLNARASNNPG

SEQ ID NO: 12863 - protein, 360 aa, Picea glauca
  misc_feature (301)..(302): Xaa can be any naturally occurring amino acid
MRCFSCCTADDIHRSADGGSPFLSNGNTTGNNGGHKSAETSKDGQIIQPLLIEVPQIPIEELKEATDNFGPKSLIGEGSYGRVYYSVLRNGRTAAIKKLDTSKQPDQEFLAQVSMVSGLKHENVLELVGYCVEGSLRVLAYEFATMGSLHDILHGRKGVRGAQPGPVLTWMQRVKIAVEAAKGLEYLHEKAQSPIIHRDIKSSNILLFDDCTAKIADFDVSNQAPDMAARLHSTRVLGTFGYHAPEYAMTGQLSQKSDVYSFGVVLLELLTGRKPVDHTMPRGQQSLVTWATPRLSEDKVXXCVDSRLKGDYPPKAVAKMAAVAALCVQYEADFRPNMSIVVKALQPLLNARPVPAGRSP

SEQ ID NO: 12864 - protein, 357 aa, Saccharum officinarum
MSCLACCGGEDTQRTPDNGGPYPGGYPARDDAYRTADPTPRGAQPVKVQPIAVPTIPVEEIREATKAFGDEALIGEGSFGRVYFGVLENGRSAAIKKLDSSKQPEQEFLAQVSMVSRLKHDNVVELLGYCVDGNTRILAYEFATMGSLHDMLHGRKGVKGAQPGPVLSWIQRVKIAVGAAKGLEYLHEKAQPHIIHRDIKSSNVLLFDDDVSKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGEYPPKSVAKFAAVAALCVQYEADFRPNMSIVVKALQPLLNARASNNPG

SEQ ID NO: 12865 - protein, 360 aa, Panicum virgatum
  misc_feature (108)..(108): Xaa can be any naturally occurring amino acid
MICCCGGAEETYAVPASRHPAAPTSQNNAAPGKPRGPNAPRTGGPPKVLPVDVPAISMGELNSITGNFGQKALIGEGSYGKIYKAVLASGEPVAIKKLDPSVSSDSLXDFSQLSMVSRLKNEYFLQLMGYYLDDSHRILVYQFASNGSLHDTLHGKKGVKDATPGPALSWAQRVKIAYGAARGLEYLHEKVQPSIVHRDVRSSNVLLFDGYESKIADFNLTSQPPDGAARLHSTRVLGTFGYHAPEYAMTGVLTQKSDVYSFGVILLELLTGRKPVDHTMPKGQQSLVTWATPRLSEDKVKQCVDPKLGEDYPPKAVAKLAAVAALCVQYESDFRPNMTIVVKALQPLVKAAAAAAEGPA

SEQ ID NO: 12866 - protein, 364 aa, Hordeum vulgare
MRRWFCCSQFHASYREHEHEFPSSPDEKEGNGFDTKSDPTKAPPPIEIPELSLDELKEKTDNFGSKALIGEGSYGRVYYAILDSGKHLAVKKLDTSADPEPDNEFLTQLSIVSRLKHENFVEMLGYCVEGNQRLVAYEFATMGSLHDILHGRKGVPGAQPGPALDWMQRVKIAIDAAKGLAYLHEKVQPSIVHRDIRSSNVLLFEDYRAKVADFNLSNQSPDMAARLHSTRVLGTFGYHAPEYAMTGQLTQKSDVYSFGVVLLELLTGRKPVDHTMPRGQQSLVTWATPRLTEDTVKQCIDPRLKGECPPKGVAKLAAVAALCVQYESEFRPSMSIVVKALSPLLQQKPQAPPAAAPNTATSDA

SEQ ID NO: 12867 - protein, 368 aa, Pseudoroegneria spicata
  misc_feature (365)..(365): Xaa can be any naturally occurring amino acid
MRRWFCCSQFHASYREHEHEFPSSPDEKEGNGFDSKSDPTKAPPPIEIPELSLDELKEKTDNFGSKALIGEGSYGRVYYAILDSGKHLAVKKLDTSADPEPDNEFLTQLSIVSRLKHENFVEMLGYCVEGNQRLVAYEFATMGSLHDILHGRKGVPGAQPGPALDWMQRVKIAIDAAKGLAYLHEKVQPSIVHRDIRSSNVLLFEDYRAKVADFNLSNQSPDMAARLHSTRVLGTFGYHAPEYAMTGQLTQKSDVYSFGVVLLELLTGRKPVDHTMPRGQQSLVTWATPRLTEDTVKQCIDPRLKGEWPPKGVAKLAAVAALCVQYESEFRPSMSIVVKALSPLLQQKPQAPPAAAPNTTTSDAXEEF

SEQ ID NO: 12868 - protein, 49 aa, Raphanus sativus
GAQPGPTLDWTTMVKIAVEAARGLEYLHEKSQPPVILRRVMCTALGSFF

SEQ ID NO: 12869 - protein, 364 aa, Triticum aestivum
MRRWFCCSQFHASYREHEHEFPSSPDEKEGNGFDSKSDPTKAPPPIEIPELSLDELKEKTDNFGSKALIGEGSYGRVYYAILDSGKHLAVKKLDTSADPEPDNEFLTQLSIVSRLKHENFVEMLGYCVEGNQRLVAYEFATMGSLHDILHGRKGVPGAQPGPALDWMQRVKIAIDAAKGLAYLHEKVQPSIVHRDIRSSNVLLFEDYRAKVADFNLSNQSPDMAARLHSTRVLGTFGYHAPEYAMTGQLTQKSDVYSFGVVLLELLTGRKPVDHTMPRGQQSLVTWATPRLTEDTVKQCIDPRLKGECPPKGVAKLAAVAALCVQYESEFRPSMSIVVKALSPLLQQKPQAPPAAAPNTTTSEA

SEQ ID NO: 12870 - protein, 366 aa, Citrullus lanatus
MFCCGGVEEENFGAPSSQYTAPPRGNTYGGSERGEPRSSNVVRTGAPQQVLPIETPVIPLDELNRLTGNFGTKSFIGEGSYGRVYYATLKSGQAAAIKKLDTSSSPEPDTDFAAQLSTVSRLKQENFLELIGYCLEANNRILVYQFAKMGSLHDILHGRKGVQGAEPGPVLTWNQRVKIAYGAAKGLEYLHEKVQPSIVHRDIRSSNVLLFDDFLAKIADFNLTNQSSDTAARLHSTRVLGTFGYHAPEYAMTGQITQKSDVYSFGVVLLELLTGRKPVDHTMPKGQQSLVTWATPRLSEDKVKQCVDPKLNNDYPPKAIAKLAAVAALCVQYEADFRPNMTIVVKALQPLLNSSKPPGPESQPHP

SEQ ID NO: 12871 - protein, 366 aa, Cucumis sativus
MFCCGGVEEENFGAPSSQYTAPPRGNTYGGSERGEPRTSNVVRSGAPQQVLPIETPVIPLDELNRLTGNFGTKSFIGEGSYGRVYYATLKSGQAAAIKKLDTSSSPEPDTDFAAQLSSVSRLKQENFLELIGYCLEANNRILVYQFAKMGSLHDILHGRKGVQGAEPGPVLAWNQRVKIAYGAAKGLEYLHEKVQPSIVHRDIRSSNVLLFDDFLAKIADFNLTNQSSDTAARLHSTRVLGTFGYHAPEYAMTGQITQKSDVYSFGVVLLELLTGRKPVDHTMPKGQQSLVTWATPRLSEDKVKQCVDPKLNNDYPPKAIAKLAAVAALCVQYEADFRPNMTIVVKALQPLLNSSKPPGPESQPHP

SEQ ID NO: 12872 - protein, 364 aa, Sorghum bicolor
MSCCGGAEEDSYGPPANQAVPPPNANAPGNRGGPRGPGAPRVGGPAKPVSIDVPAIPFDELKKITNNFSDRALIGEGSYGRVYNATLSDGRAAVIKKLDTNASQDSDTDFAAQIAMVSKLKNEYFLELLGYCLEDGTRMLAYQFATMGSLHNILHGKKGVQGAEPGPVLNWAQRVKIAYGAARGLEYLHEKVQPSIVHRDIRSSNVLIFDDFSSKIADFNLTNQGTDTAARLHSTRVLGTFGYHAPEYAMTGQINQKSDVYSFGVILLELLTGRKPVDHTMPKGQQSLVTWATPRLSEDKVKQCVDPKLNSDYPPKAVAKLAAVAALCVQYESDFRPNMTIVVKAITPLLNAPKPAAPAAAPQS

SEQ ID NO: 12873 - protein, 113 aa, Amorphophallus konjac
MRRWLCCVRHLEDSRHSNENDYMRSPKNHLDGNLKNSKLSNVVNSEAHKALPTIDVPAISLDELKEKTDNFGSKCLIGEGSYGRVYYARLNNGKDVAVKNLMFHLSPSPTMNF

SEQ ID NO: 12874 - protein, 334 aa, Eucalyptus grandis
GGERGETRSSNVVRSGATQKVLPIEIPALPLNELNRLTGNFGSKALIGEGSYGRVFYARLSTGEEAAVKKLDTSASQEPDSDFAAQLSTVSRLKNEHFVELIGYCLEANNRILVHEFATMGSLHDVLHGRKGVQGAEPGPVLTWNQRVKIAYGAAKGLDYLHEKVQPSIVHRDVRSSNVLLFDDFVTKIADFNLSNQSSDTAARLHSTRVLGTFGYHAPEYAMTGQITQKSDVYSFGVVLLELLTGRKPVDHTMPKGQQSLVTWATPRLSEDKVKQCVDPKLNDDYPPKAIAKLAAVAALCVQYEADFRPNMTIVVKALQPLLHSKPAGPDSHL

SEQ ID NO: 12875 - protein, 363 aa, Setaria italica
MSCCGGAEEDSYGPPANQAAPPPNANAPGNRGGPRGPGAPRPGGPAKPVSIDVPAIPFDELKKITNNFSDRALIGEGSYGRVYNATLSDGRAAVIKKLDTSASQDSDSDFAAQIAMVSKLKNEYFLELMGYCLEDGNRMLAYQFATMGSLHNILHGKKGVQGAEPGPVLNWLQRVKIAYGAARGLEYLHEKVQPSIVHRDIRSSNVLIFDDFSSKIADFNLTNQGTDTAARLHSTRVLGTFGYHAPEYAMTGQINQKSDVYSFGVILLELLTGRKPVDHTMPKGQQSLVTWATPRLSEDKVKQCVDPKLNNDYPPKAVAKLAAVAALCVQYESDFRPNMTIVVKAIQPLLNAPKPAAPAAPQS

SEQ ID NO: 12876 - protein, 363 aa, Setaria italica
MSCCGGAEEDSYGPPANQAAPPPNANAPGNRGGPRGPGAPRPGGPAKPVSIDVPAIPFDELKKITNNFSDRALIGEGSYGRVYNATLSDGRAAVIKKLDTSASQDSDSDFAAQIAMVSKLKNEYFLELVGYCLEDGNRMLAYQFATMGSLHNILHGKKGVQGAEPGPVLNWLQRVKIAYGAARGLEYLHEKVQPSIVHRDIRSSNVLIFDDFSSKIADFNLTNQGTDTAARLHSTRVLGTFGYHAPEYAMTGQINQKSDVYSFGVILLELLTGRKPVDHTMPKGQQSLVTWATPRLSEDKVKQCVDPKLNNDYPPKAVAKLAAVAALCVQYESDFRPNMTIVVKAIQPLLNAPKPAAPAAPQS

SEQ ID NO: 12877 - protein, 365 aa, Eutrema halophilum
MFCCGGADEEPAGPPANQYAAPPNKAGNPNFGGGNRGEPRNPNAPRSGAPAKVLPIEIPAVALDELNRMAGNFGNKALIGEGSYGRVFYGKYKGNDVAIKKLDASSSEEPDSDFTSQLSVVSRLKHEHFVELMGYCLEANNRILIYEFATKGSLHDVLHGRKGVQGAEPGPVLNWNQRVKIAYGAAKGLEFLHEKVQPPIVHRDVRSSNVLLFNDFVAKMADFNLTNASSDTAARLHSTRVLGTFGYHAPEYAMTGQITQKSDVYSFGVVLLELLTGRKPVDHTMPKGQQSLVTWATPRLSEDKVKQCIDPKLNNDFPPKAVAKLAAVAALCVQYEADFRPNMTIVVKALQPLLNSKPAGPESAS

SEQ ID NO: 12878 - protein, 365 aa, Eutrema parvulum
MFCCGGADEEPAGPPANQYSAPPNKAGNPNFGGGNRGEPRNPNAPRSGAPAKVLPIEIPAVALDELNRMAGNFGNKALIGEGSYGRVFYGKYKGDDVAIKKLDASSSEEPDSDFTSQLSVVSRLKHEHFVELLGYCLEANNRILIYEFATKGSLHDVLHGRKGVQGAEPGPVLNWNQRVKIAYGAAKGLEFLHEKVQPPIVHRDVRSSNFLLFNDFVAKMADFNLTNASSDTAARLHSTRVLGTFGYHAPEYAMTGQITQKSDVYSFGVVLLELLTGRKPVDHTMPKGQQSLVTWATPRLSEDKVKQCIDPKLNNDFPPKAVAKLAAVAALCVQYEADFRPNMTIVVKALQPLLNSKPAGPESSS

SEQ ID NO: 12879 - protein, 365 aa, Arabidopsis lyrata
MFCCGGADEEPAGPPANQYAAPPNKAGNPNFGGGNRGEPRNPNAPRSGAPAKVLPIEIPSVALDELNRMAGNFGNKALIGEGSYGRVFCGKFKGEAVAIKKLDASSSEEPDSDFTSQLSVVSRLKHDHFVELLGYCLEANNRILIYQFATKGSLHDVLHGRKGVQGAEPGPVLNWNQRVKIAYGAAKGLEFLHEKVQPPIVHRDVRSSNVLLFDDFVAKMADFNLTNASSDTAARLHSTRVLGTFGYHAPEYAMTGQITQKSDVYSFGVVLLELLTGRKPVDHTMPKGQQSLVTWATPRLSEDKVKQCIDPKLNNDFPPKAVAKLAAVAALCVQYEADFRPNMTIVVKALQPLLNSKPTGPESTS

SEQ ID NO: 12880 - protein, 365 aa, Arabidopsis thaliana
MFCCGGADEEPAGPPANQYAAPPNKAGNPNFGGGNRGEPRNPNAPRSGAPAKVLPIEIPSVALDELNRMAGNFGNKALIGEGSYGRVFCGKFKGEAVAIKKLDASSSEEPDSDFTSQLSVVSRLKHDHFVELLGYCLEANNRILIYQFATKGSLHDVLHGRKGVQGAEPGPVLNWNQRVKIAYGAAKGLEFLHEKVQPPIVHRDVRSSNVLLFDDFVAKMADFNLTNASSDTAARLHSTRVLGTFGYHAPEYAMTGQITQKSDVYSFGVVLLELLTGRKPVDHTMPKGQQSLVTWATPRLSEDKVKQCIDPKLNNDFPPKAVAKLAAVAALCVQYEADFRPNMTIVVKALQPLLNSKPAGPESTS

SEQ ID NO: 12881 - protein, 363 aa, Sciadopitys verticillata
MRCFGCWSADDIQKSADANSPFLSNGNMTGNIGVQKIADITSKEGQVLQTLPIEVPEIPIEELRDATDNFGPKSLIGEGSYGRVYYSTLRSGRPAAIKKLDSSKQADQEFLAQVSMVSRLKHENVLELVGYCVEGSIRSLAYEFATMGSLHDILHGRKGVKGAQPGPVLTWMQRVKIAVEAAKGLTYLHEKAQPPIIHRDIKSSNILLFDDCTAKIADFDLSNQAPDMAARLHSTRVLGTFGYHAPEYAMTGQLSQKSDVYSFGVVLLELLTGRKPVDHTMPRGQQSLVTWATPRLSEDKVKQCVDSRLKGDYPPKAVAKMAAVAALCVQYESDFRPNMSIVVKALQPLLNARSVSNNGIPAL

SEQ ID NO: 12882 - protein, 229 aa, Panicum virgatum
DGNRMLAYQFATMGSLHNILHGKKGVQGAEPGPVLNWMQRVKIAYGAARGLEYLHEKVQPSIVHRDIRSSNVLIFDEFSSKIADFNLTNQGTDTAARLHSTRVLGTFGYHAPEYAMTGQINQKSDVYSFGVILLELLTGRKPVDHTMPKGQQSLVTWATPRLSEDKVKQCVDPKLNNDYPPKAVAKLAAVAALCVQYESDFRPNMTIVVKAIQPLLNAPKPAAPAAPQS

SEQ ID NO: 12883 - protein, 363 aa, Fagopyrum esculentum
ACFGCFGGGNAYKTSENGGTYVMKPVPGRDGNLRAPENAPSKAPVVKVQPILIPLISVDELKEVTDDFGTSALIGGGSYGRVYYGVLKSGRAAAIKKLDTSKQPDDEFLAQVSMVSRMKNDHFVELLGYCVDGNVRMLAYEFASSGSLHDILHGRKGVKGAQPGPVLSWAQRVKIAVGAAKGLEYLHEKADPHIIHRDIKSSNVLIFDDDVSKIADFDLSNQAPDMAARLHSTRVLGTFGYHAPEYAMTGQLNAKSDVYSFGVVLLELLTGRKPVDHNLPRGQQSLVTWATPRLSEDKVKQCVDPRLNGEYPPKAVAKMAAVAALCVQYEADFRPNMSIVVKALQPLSNARAGGGAVTESPRS

SEQ ID NO: 12884 - protein, 144 aa, Pteridium aquilinum
LSNQAPDMAARLHSTRVLGTFGYHAPEYAMTGLLTQKSDVYSFGVVLLELLTGRKPVDHTLPRGQQSLVTWATPRLSEDKVKQCVDPKLKSDYPIKAVAKMAAVAALCVQYESDFRPNMSIVAKALQALLLPRPAVGGAIDAGI

SEQ ID NO: 12885 - protein, 363 aa, Eutrema parvulum
MSCFGCCGGEDFRRVAETGPKPVHNSAGYNGHHQKADPPKNPPVIQMQPIAVPAIPADELKDITDNYGSKSLIGEGSYGRVFYGVLKSEKAAAIKKLDSSKQPDQEFLAQVSMVSRLRQDNVVALLGYCVDGPLRVLAYEYAPNGSLHDILHGRKGVKGAQPGPVLSWHQRVKIAVGAARGLEYLHEKANPHVIHRDIKSSNVLLFDDDVAKVADFDLSNQAPDMAARLHSTRVLGTFGYHAPEYAMTGTLSTKSDVYSFGVVLLELLTGRKPVDHTLPRGQQSLVTWATPKLSEDKVKQCVDARLNGEFPPKAVAKLAAVAALCVQYEADFRPNMSIVVKALQPLLNPPRSAPQTPQRNNPY

SEQ ID NO: 12886 - protein, 362 aa, Sorghum bicolor
MFCCGGTEEDTYAAPASRHPAAPRNTSQHNAGRGKPRGPNAPRSSGPPKVLPVDVPAISMGELNNITGSFGPNALIGEGSYGKIYRAVLTSGEPVAIKKLDPSVSSDSLADFSAQLSMVSRLKNEYFLQLMGYYLDDSHRILVYQFASHGSLHDTLHGKKGVKDATPGPALSWAQRVKIAYGAARGLEYLHEKVQPSIVHRDVRSSNVLLFDGHDSKLADFNLTSQPPDGAARLHSTRVLGTFGYHAPEYAMTGVLTHKSDVYSFGVILLELLTGRKPVDHTMPKGQQSLVTWATPRLSEDKVSQCVDPKLGDDYPPKAVAKMAAVAALCVQYESDFRPNMTIVVKALQPLVKAAAATAGGA

SEQ ID NO: 12887 - protein, 362 aa, Panicum virgatum
MSCLACCGGEDTQRAPDSGGPYPGGYPARNDAYRTADPTPRGVQPVKVQPIAVPTIPVEEIREVTQGFGDEALVGEGSFGRVYYGILNNGRSAAIKKLDSSKQPEQEFLAQVSMVSRLKHDNVVELLGYCVDGNTRILAYEFATMGSLHDMLHGRKGVKGAQPGPVLSWTQRVKIAVGAAKGLEYLHEKAQPHIIHRDIKSSNVLLFDDDVSKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGEYPPKSVAKFAAVAALCVQYEADFRPNMSIVVKALQPLLNARASNNPGGHSGS

SEQ ID NO: 12888 - protein, 361 aa, Ambrosia trifida
MSCFGCCGEDDMHKAYDNGPYMPNNAAGHNAGYRATEAAPKDTQAVAVQPIAVPALQVDELKEITDNFGTKALIGEGSYGRVYHGVLRSGQAAAIKKLDSSKQPDQEFLAQVSMVSRLKNDNVVGLLGYCIDGGLRVLAYEYASNGSLHDILHGRKGVKGAQPGPVLSWSQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDTRLNGEYPPKAVAKMAAVAALCVQYEADFRPNMSIVVKALQPLLNARAGPQTEAPHL

SEQ ID NO: 12889 - protein, 361 aa, Ambrosia trifida
MSCFGCCGEDDMHKAYDNGPYMQNNAAGHNAGYRATEAAPKDTQAVAVQPIAVPALQVDELKEITDNFGTKALIGEGSYGRVYHGVLRSGQAAAIKKLDSSKQPDQEFLAQVSMVSRLKNDNVVGLLGYCIDGGLRVLAYEYASNGSLHDILHGRKGVKGAQPGPVLSWSQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDTRLNGEYPPKAVAKMAAVAALCVQYEADFRPNMSIVVKALQPLLNARAGPQTEAPHL

SEQ ID NO: 12890 - protein, 267 aa, Arnica chamissonis
IKKLDSSKQPDQEFLAQVSMVSRLKSDNVVGLLGYCVDGGLRVLAYEYASNGSLHDILHGRKGVKGAQPGPVLSWSQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDTRLNGEYPPKAVAKMAAVAALCVQYEADFRPNMSIVVKALQPLLNARAGPQTEAPHL

SEQ ID NO: 12891 - protein, 361 aa, Cirsium arvense
MSCFSCCGEDDMQKSYDNGPFMANNAAGHNAGYRATEAAPKDTQAVAIQPIAVPALQVDELKEITDNFGTKSLIGEGSYGRVYHGVLRSGQAAAIKKLDSSKQPDQEFLAQVSMVSRLKHDNVVGLLGYCVDGGLRVLAYEYASNGSLHDILHGRKGVKGAQPGPVLSWSQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDIRLNGEYPPKAVAKMAAVAALCVQYEADFRPNMSIVVKALQPLLNARPGPQTEAPHL

SEQ ID NO: 12892 - protein, 361 aa, Flaveria ramosissima
MSCFSCCGEDDMHKSFDNGPYMPNNAAGPNAGYRATEAAPKDTQAVAVQPIAVPGLQVDELKEITDNFGTKCLIGEGSYGRVYHGVLRSGQAAAIKKLDSSKQPDQEFLAQVSMVSRLKNDNVVGLLGYCIDGGLRVLAYEYASNGSLHDILHGRKGVKGAQPGPVLSWSQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDTRLNGEYPPKAVAKMAAVAALCVQYEADFRPNMSIVVKALQPLLNARAGPQTEAPHL

SEQ ID NO: 12893 - protein, 95 aa, Phalaenopsis aphrodite
MPKWLCCSCKVDESDGLHFNESLRSPKPYMDYRTGLQKGSKFSAVTKNEPQKAPPSIDVPALSFNELKEKTDNFGSKDFCWGGFLWKGIFCFFKW

SEQ ID NO: 12894 - protein, 214 aa, Plantago ovata
LHDILHGRKGVKGAQPGPVLSWAQRVKIAVGAAKGLEYLHEKAQPRIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDARLNGEYPPKAVAKMAAVAALCVQYEADFRPNMSIVVKALQPLLNTRSGHPGESPSV

SEQ ID NO: 12895 - protein, 362 aa, Citrullus lanatus
MGCFGCCEEDGIQKPADNSSMYQVKASAGTDEGYHKRQTAPKSPPIVKMRPIEVPAISFEELKEVTKNFDADCLIGEGSYGRVYYGVFTSGQTVGIKKLDASKQSDDEFLSQVSMVSRLKHHNFLNLIGYCVDGNSRILAYEYASNGSLHDILHGRKGVKGAQPGPVLSWAQRVKIAVGAAKGLEYLHEKVDPHIIHRDIKSSNVLIFDDDLAKIADFDLSNQAPDMAARLHSTRVLGTFGYHAPEYAMTGQLNAKSDVYSFGVVLLELLTGRKPVDHTLPRGQQSLVTWATPKLCEDKVKQCVDAKLGDEYPPKSVAKFAAVAALCVQYEADFRPNMSIVVKALQPLLNVRPGPGGEAPTL

SEQ ID NO: 12896 - protein, 365 aa, Aquilegia formosa
MLCCGGAEEENNGPPVNNQYTAPPKAAHNGPGPGDRAEPNRGSHASRSQAPAKILPIETPAIPLDELNRLTNNFGQKSLVGEGSYGRVFYATLSDGQVAAVKKLDPSSSNEPDSDFAAQLSTVSRLKQEHFVELIGYCLEANNRILVYQFATMGSLHDILHGRKGAQGAEPGPVLTWNQRVKIAYGAARGLEYLHEMVQPGIVHRDVRSSNVLVFDDFAAKIADFNLTNQSPDTAARLHSTRVLGTFGYHAPEYAMTGFLTQKSDVYSFGVVLLELLTGRKPVDHTMPKGQQSLVTWATPRLSEDKVKQCIDPKLNNDYPPKAIAKLAAVAALCVQYEADFRPNMTIVVKAIQPLLTSRPAGPEH

SEQ ID NO: 12897 - protein, 361 aa, Artemisia annua
MSCFGCCGEDDMHKSYDNGPYMTNNAAGNNAGYRATEAAPKDTQAVAIQPIAVPALQVDELKEITDNFGTKSLIGEGSYGRVYHGVLRSGQAAAIKKLDSSKQPDQEFLGQVSMVSRLKHDHVVGLLGYCVDGGLRVLAYEYASNGSLHDILHGRKGVKGAQPGPVLSWSQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDTRLNGEYPPKAVAKMAAVAALCVQYEADFRPNMSIVVKALQPLLNARPGPQTEAPHM

SEQ ID NO: 12898 - protein, 355 aa, Cucumis sativus
MGCFGCCEEDAIQKAADNSNTYQVKTSAGTDESYHKRQTAPKSPPIVKIQPIEVPAISFEELKEVTKNFDADCLIGEGSYGRVYYGVFTSGQTVGIKKLDASKQSDDEFLSQVSMVSRLKHDNFLNLIGYCVGGNSRILAYEYASNGSLHDILHGRKGVKGSQPGPVLSWAQRVKIAVGAAKGLEYLHEKVDPHITHRDIKSSNVLIFDDDLAKIADFDLSNQAPDMAARLHSTRVLGTFGYHAPEYAMTGQLNSKSDVYSFGVVLLELLTGRKPVDHTLPRGQQSLVTWATPKLCEDKVKQCVDAKLGNEYPPKSVAKFAAVAALCVQYEADFRPNMSIVVKALQPLLNARPGP

SEQ ID NO: 12899 - protein, 196 aa, Cynara scolymus
MSCFNCCGEDDMHKSYDNGPFMANNAAGHNAGYRATEAAPKDTQAVAIQPIAVPALQVDELKEITDNFGTKSLIGEGSYGRVYHGVLRSGQAAAIKKLDSSKQPDQEFLAQVSMVSRLKHDNVVGLLGYCVDGGLRVLAYEYASNGSLHDILHGRKGVKGAQPGPVLSWSQRVKIAVGAAKGLEYLHERRSLILSS

SEQ ID NO: 12900 - protein, 153 aa, Solanum melongena
DDDVAKIADFDLSNQAPDMAARLHSTRVLGTFGYHAPEYAMTGQLSSKSDVYSFGVVLLELLTGRKPVDHTLPRGQQSLVTWATPRLSEDKVKQCVDARLGTDYPPKAVAKMAAVAALCVQYEADFRPNMSIVVKALQPLLHARPAPSETSNL

SEQ ID NO: 12901 - protein, 359 aa, Zea mays
MWCCSGADDEPHAAPLAANPAATPPRAPAQARGPSMPRTGGAAASAAKVLPIDVPAVALSELNRLTGNFGDRALVGEGSYGRVYRATLATGEVAAVKMFDNGSSSGQSEAEFCEQLSVVSRLKCEHFTQLLGYCLELNNRIVLYQFATIGSLYDILHGKKGVKGAAPGPVLTWIQRARIAYGAARGLEHLHEKARPSIVHRDVRSSNVLVFGGHDAKIGDFNLTNQSPDSATRLHSTKVLGTFGYHAPEYAMTGQLTHKSDVYSFGVVLLELLTGRKPVDHTMPKGQQSLVTWATPRLSEDKVKQCVDPKLKDDYPPKAVAKLAAVAALCVQYEADFRPNMTIVVKALQPLVNARPGGE

SEQ ID NO: 12902 - protein, 364 aa, Medicago truncatula
MLCCGGSEEDTSGPPANQYTAPSRGGNSYGAGGGGEPRSNITKSGGPQKVLPIEIPSISLAELNRLTGNFGSKAFIGEGSYGRVYYAKMNDGTEAAIKRLDTSSSPDSDSNDFAAQLSVVSRLKHDNFVELTGYCLEADNRILVYQYASLGSLHDVLHGRKGVQGAEPGPVLSWNQRAKIAFGAAKGLEFLHEKVQPSIVHRDVRSSNVLLFNDYEAKIADFSLTNQSSDTAARLHSTRVLGTFGYHAPEYAMTGQITQKSDVYSFGVVLLELLTGRKPVDHTMPKGQQSLVTWATPRLSEDKVKQCVDPKLNNDYPPKAIAKLAAVAALCVQYEADFRPNMTIVVKALQPLLNAKPAGPDPNA

SEQ ID NO: 12903 - protein, 196 aa, Cucumis melo
KGSQPGPVLSWAQRVKIAVGAAKGLEYLHEKVDPHIVHRDIKSSNVLIFDDDLAKIADFDLSNQAPDMAARLHSTRVLGTFGYHAPEYAMTGQLNAKSDVYSFGVVLLELLTGRKPVDHTLPRGQQSLVTWATPKLCEDKVKQCVDAKLGNEYPPKSVAKFAAVAALCVQYEADFRPNMSIVVKALQPLLNARPGP

SEQ ID NO: 12904 - protein, 361 aa, Avena sativa
MSCFGCCGDEDTQRAPDNRNQYPGSHPARNDAYRTADPTPKGPQPVKVQPIAVPTIPMDEIREVTKGFGDEALIGEGSFGRVYFGVLRNGRSAAVKKLDSSKQPDQELLAQVSMVSRLKHENVVELLGYCLDGATRVLAYEFATMGSLHDMLHGRKGVKGAQPGPVLSWVQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGDFPPKAVAKFAAVAALCVQYEADFRPNMSIVVKALQPLLNARAAHPGEHAGR

SEQ ID NO: 12905 - protein, 361 aa, Arachis hypogaea
MGCFGFCKQDDSYKPSDNRSLMPTNSTGNTGYSTRPTAVTTPKIIEFKPIAVPSLSLDELKSLTDNFGAKCFIGEGAYGKVYRATLKDGRDVVIKKLDSSRQPDQEFLAQVSIVSRLKHENVVELVSYCVDGPLRALAYEYAPKGSLHDILHGRKGVKGAQPGPVLSWAQRVKIAVGAARGLEYLHEKAEIHIIHRYIKSSNIMLFDDDVAKIADFDLSNQNPDAAARLHSTRVLGTFGYHAPEYAMTGTLTAKSDVYSFGVILLELLTGRKPVDHTLPRGQQSLVTWATPRLSEDKVKQCVDVRLKGDYPPKAVAKLAAVAALCVQYEAEFRPNMSIVVKALQPLLNTRSGQPKESAHKM

SEQ ID NO: 12906 - protein, 360 aa, Arachis hypogaea
MSCFSCCEGDDLHNTTDSGAPFAVKNSAGNDGNHHASETAKQGAQTVKVQPIEVPAIPVDELKELQITWENALIGEGSYGRVYHGVLKSGQTAAIKKLDASKQPDDEFLAQVSMVSRLKHDNFVQLLGYCVDGNSRVLAYEYASNGSLHDILHGRKGVKGAKPGPVLTWAQRVKIAVGAAKGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDARLGGEYPPKAVAKLAAVAALCVQYEADFRPNMSIVVKALQPLLNARPGPAGETPN

SEQ ID NO: 12907 - protein, 362 aa, Populus trichocarpa
MSCFGCCEEDDIHKAADYGGQYTVKSSAGNLGNYHASETAPKGAQAFKIQPIEVPEISGDELKEVTDNFGTSSLIGEGSYGRVYYGALKSGQDASIKKLDASKQPDDEFLSQVSMVSRLKHENFVQLLGYCVDGGSRVLIYEFASNGSLHDILHGRKGVKGAQPGPVLTWPQRVKIAVGAAKGLEYLHEKADPHIVHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVKQCVDARLQGEYPPKAVAKMAAVAALCVQYEADFRPNMSIVVKALQPLLNARPGPAGEAPSI

SEQ ID NO: 12908 - protein, 363 aa, Populus trichocarpa
MFCCGDKEEEPHGPPANQYTAPPRGGNPYGSGRGEPRSANPARNGAPQKVLPIEIPAIPLDELNRMTGNFGTKALIGEGSYGRVFYAKLSDGMRAAIKKLDTSSSQEPDSDFAAQLSVVSRLKHEHFVELTGYCLDANNRILVYQFAVMGSLHDVLHGRKGVQGAEPGPVLNWNQRVKIAYGAAKGLEYLHEKVQPPIVHRDVRSSNVLLFDDFMSRIADFNLSNAHSDTAARLHSTRVLGTFGYHAPEYAMTGQITQKSDVYSFGVVLLELLTGRKPVDHTMPKGQQSLVTWATPRLSEDKVKQCVDPKLNNDYPPKAVAKLAAVAALCVQYEADFRPNMTIVVKALQPLLNSKPAGPDAHA

SEQ ID NO: 12909 - protein, 363 aa, Pseudotsuga menziesii
MWCFSCCAEDEIQNAADGTRPIMVNGNFPGNDGVYENANTALRSGQNLKLQPIAVPEITVDELREVTDNFSQNSLIGEGSYGPVYHGILKNGRDSAIKKLDARKQPDQELLAQVSMVSRLKHENLVELVGYCVDGSLRVLAYEFATMGSLHDILHGKKGVKGAQPGPVLTWTQRVKIAVGAAKGLEYLHEKAQPSIIHRDIKSSNVLLFDDYTAKIADFDLSNQAPDMSARLHSTRVLGTFGYHAPEYAMTGQSTQKSDVYSFGIVLLELLTGRKPVDHTLPRGQQSLVTWATPRLSEDKVKQCVDPRLKGDYPPKAVAKMAAVAALCVQYEADFRANMSIIVKALRPLLNAQSAPVGGSAAE

SEQ ID NO: 12910 - protein, 364 aa, Oryza sativa
MICCGGEEEETYAPRAASRSRSRRPTPATQYNAGPRKPRGPNAPRSGGPPPKVLSIDVPAISMGELNNITGHFGQSALIGEGSYGRIYRAVLTSGEPVAIKKLDPSVSSDSEADFSAQLSMVSRLKNEYFIRLMGYYLDANRRILVYQFATHGSLHDILHGKKGVRDAAPGPALNWSQRVKVAYGAARGLEYLHEKAQPPIVHRDVRSSNVLLFDGYESKLADFNLTTQPPDGAARLHSTRVLGTFGYHAPEYAMTGQLNQKSDVYSFGVILLELLTGRKPVDHTMPKRQQSLVTWATPRLSEDKVRQCVDPKLGDDYPPKAVAKMAAVAALCVQYESDFRPNMTIVVKALQPLLSKPAGAGGP

SEQ ID NO: 12911 - protein, 366 aa, Glycine max
MLCCGGAEEESTGSPANQYPTAPPRGGNTYGGGGNDRGEPRGNVAKSGAPQKVLPIEIPSMPLDELNRLTGNFGTKAFIGEGSYGRVFYAKLSDGTDAAIKKLDTSSSPEPDSDFAAQLSIVSRMKHDNFVELIGYCLEADNRLLVYQYASLGSLHDVLHGRKGVQGAEPGPVLSWNQRAKIAFGAAKGLEFLHEKVQPSIVHRDVRSSNVLLFNDYEAKIADFSLTNQSSDTAARLHSTRVLGTFGYHAPEYAMTGQITQKSDVYSFGVVLLELLTGRKPVDHTMPKGQQSLVTWATPRLSEDKVKQCVDPKLNNDYPPKAIAKLAAVAALCVQYEADFRPNMTIVVKALQPLLNAKPSGPDPHA

SEQ ID NO: 12912 - protein, 366 aa, Glycine max
MLCCGGAEEDFGIPPGNQYNASPKKGNAYNGGGGGDRGEPRGNVVKNGAPQKTLPIEIPAISLDELDRLTSNFSTEALIGEGSYGKVYYAKLSDGMEAAIKKLDTSSSPDPDSDFAAQLSIVSRLKNEHFVELMGYCLEENYRILVYQYASLGSLHDVLHGRKGVQGAEPGPILNWSQRIKIAFGAAKGLEFLHEKCQPSIVHRDVRSSNVLLFNDYESKVADFNLTNQSSDTAARLHSTRVLGTFGYHAPEYAMTGQITQKSDVYSFGVVLLELLTGRKPVDHTMPKGQQSLVTWATPRLSEDKVKQCVDPKLNNEYPPKAIAKLAAVAALCVQYEADFRPNMTIVVKALQPLLNSKPTSVDPDT

SEQ ID NO: 12913 - protein, 361 aa, Helianthus annuus
MSCFGCCGEDDMHKSYDNGTYMPNNAAGNNAGYRATEAAPKDTQAVAVQPIAVPALQVDELKEITDNFGTKSLIGEGSYGRVYHGVLRSGQAAAIKKLDSSKQPDQEFLAQVSMVSRLKNDNVVGLLGYCIDGGLRVLAYEYASNGSLHDILHGRKGVKGAQPGPVLSWSQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDTRLNGEYPPKAVAKMAAVAALCVQYEADFRPNMSIVVKALQPLLNARAGPQTEAPHL

SEQ ID NO: 12914 - protein, 360 aa, Nicotiana tabacum
  misc_feature (66)..(66): Xaa can be any naturally occurring amino acid
MGCFGCCDDDDMHKAADHGPFMTNNSAGYNAGQRATESAQKETQTVNIQPIAVPSIAVDELKDITXNFGTKALIGEGSYGRVYHGVLKSGRAAAIKKLDSSKQPDREFLAQVSMVSRLKHENVVELLGYCVDVGLRVLAYEYAPNGSLHDILHGRKGVKGAQPGPVLSWAQRVKIAVGAAKGLEYLHEKAQPHIIHRDIKSSNVLLFDDDVAKIADFDLSNQAPDMAARLHSTRVLGTFDYHAPEYAMTGQLSSKSDVYSFGVVLLELLTGRKPVDHTLPRGQQSLVTWATPRLSEDKVKQCVDARLGTEYPPKAVAKMAAVAALCVQYEADFRPNMSIVVKALQPLLHARSAPSETSNV

SEQ ID NO: 12915 - protein, 361 aa, Tragopogon dubius
MSCFSCCGEDDIHKSYDNGPFMTNNAAGNNAGYRATEAAPKDTQAVAIQPIAVPALQVDELKEITDNFGTKSLIGEGSYGRVYHGVLRSGQAAAIKKLDSSKQPDQEFLAQVSMVSRLKHDNVVGLLGYCIDGGLRVLAYEFASNGSLHDILHGRKGVKGAQPGPVLSWSQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDTRLNGEYPPKAVAKMAAVAALCVQYEADFRPNMSIVVKALQPLLNARAGPQTEAPHL

SEQ ID NO: 12916 - protein, 371 aa, Oryza sativa
MGCFSCCGADDVGKKKKRDDPYVPIPDPGGNYGRSKPGPPAPSRSPPTSRNLPIAVPAIPLDEIKGITKNFSSDALIGEGSYARVFFGVLRDGRRSAVKKLDSSKQPDQEFLVQVSAVSRLKHENIIQLIGYCAGGSIRVLAYEYAPRGSLHDILHGKKGVKGAQPGPALSWMQRVKIALSAAKGLEFLHEKAEPRVVHRDIKSSNIMLFDNDVAKVGDFDVSNQSPDMAARLHSTRVLGTFGYHAPEYAMTGQLSTKSDVYSFGVVLLELLTGRKPVDHTLPRGQQSLVTWATPRLSEDKVKQCVDPRLEGDYPPKAVAKMAAVAALCVQYEADFRPNMSIVVKALNPLLNSRPNNRPASFTDAGERSGL

SEQ ID NO: 12917 - protein, 258 aa, Leymus cinereus x Leymus triticoides
VAVAVAVALVSRLKHDNFVDILGYCMERNLRIAAYEFATMGSLHDVLHGRKGVQGAQPGPPLNWMQRMKIAVDAAKGLEYLHEKVQPSIVHRDVRSSNILLFEDFKAKIADFNLSNQAPDMAARLHSTRVLGTFGYHAPEYAMTGQLTQKSDVYSFGVVLLELLTGRKPVDHTAPRGQQSLVTWATPRLTEDKVKQCIDPRLEGDYPPKGVAKLAAVAALCVQYEAEFRPSMSIVVKALTPLTMSRQTPPAPPPALDS

SEQ ID NO: 12918 - protein, 362 aa, Silene vulgaris
MSCFGCFGGGATHRPAENGGGYMPPKPAGRDGYRTVESQPSKPPVKIQPIAVPAISADELRDVTENYGSGALIGEGSYGRVYYGTLKNGREAAIKKLDASKQPDDEFLAEVSMVSRLKHDNFVELLGYCVDGSSRVLAYEFAPKGSIHDVLHGRKGVKGAQPGPVLSWAQRVKIAVGAARGLEYLHEKADPHIFHRDIKSSNVLLFDDDVAKIGDFDLSNQAPDMAARLHSTRVLGTFGYHAPEYAMTGQLNAKSDVYSFGVVLLELLTGRKPVDHTLPRGQQSLVTWATPKLSEDKVKQCVDPRLNGEYPPKAVAKMAAVAALCVQYEADFRPNMSIVVKALQPLLNTPRTGASSVPANHL

SEQ ID NO: 12919 - protein, 365 aa, Solanum lycopersicum
MSCCGGREEDVYSGGPPSNQNTVPPRAGNPYAGASDRAEPRGGTRNGTPQKVLPIEIPVLPLDELNKLTGNFGQKALIGEGSYGRVFFAKLSNGQEAAIKKLDTSSSPEPDSDFTAQLSMVSRLKHEHFVNLMGYCLEANNRILIYEFAAMGSLHDVLHGRKGVQGAEPGPVLTWNQRVKVAFGAAKGLEYLHEKIQPAIVHRDVRSSNVLLFDDFTAKVADFNLTNQTSDTAARLHSTRVLGTFGYHAPEYAMTGQITQKSDVYSFGVVLLELLTGRKPVDHTMPKGQQSLVTWATPRLSEDKVKQCVDPKLNNDYPAKAIAKMAAVAALCVQYEADFRPNMTIVVKALQPLLTAKPAGPESNT

SEQ ID NO: 12920 - protein, 238 aa, Setaria italica
RHPVAPTSRNNAGPGKPRGPNAPRSGGPPKVLPVDVPAISMGELNNITGNFGQKALIGEGSYGKIYKAVLISGELVAIKKLDPSVSSDSLADFSAQLSMVSRLKNEYFLQLLGYYRILVYQFASHGSLHDALHGKKGVKDAAPGPVLSWAERVKIAYGAARGLEYLHEKVQPSIVHRDVRSSNVLLFDGYDSKIADFNLTSQPPDGAARALHARPGHLRLPCSRVRDDRSLDAQERCV

SEQ ID NO: 12921 - protein, 365 aa, Setaria italica
MICCCGGAEEDTFAAPASRHPAAPTSRNNAGPGKPRGPNAPRSGGPPKVLPVDVPAISMGELNNITGNFGQKALIGEGSYGKIYKAVLISGELVAIKKLDPSVSSDSLADFSAQLSMVSRLKNEYFLQLLGYYLDDSHRILVYQFASHGSLHDALHGKKGVKDAAPGPVLSWAERVKIAYGAARGLEYLHEKVQPSIVHRDVRSSNVLLFDGYDSKIADFNLTSQPPDGAARLHSTRVLGTFGYHAPEYAMTGVLTHKSDVYSFGVVLLELLTGRKPVDHTMPKGQQSLVTWATPRLSEDKVKQCVDPKLGDDYPPKAVAKMAAVAALCVQYESDFRPNMTIVVKALQPLVNKAAAATAGGPSST

SEQ ID NO: 12922 - protein, 363 aa, Zea mays
MSCCGGAEEDSYGPPANQAVPPPNANAPGNRGGPRGPGAPRVGGPAKPVSIDVPAIPFDELKRITNNFSDRALIGEGSYGRVYNATLSDGRAAVIKKLDTSASQDSDTDFAAQIAMVSKLKNEYFLELLGYCLEDGNRMLTYQFATMGSLHNILHGKKGVQGAEPGPVLNWAQRVKIAYGAARGLEYLHEKVQPSIVHRDIRSSNVLIFDDFSSKIADFNLTSQGTDTAARLHSTRVLGTFGYHAPEYAMTGQINQKSDVYSFGVILLELLTGRKPVDHTMPKGQQSLVTWATPRLSEDKVKQCVDPKLDSDYPPKAVAKLAAVAALCVQYESDFRPNMTIVVKAITPLLNAPKPAAPAAPQS

SEQ ID NO: 12923 - protein, 363 aa, Zea mays
MSCCGGAEEDSYGPPANQAVPPPNANAPGNRGGPRGPGAPRVGGPAKPISIDAPSIPLDELKKITNNFSERALIGEGSYGRVYNATLGDGRAAVIKKLDTSASQDSDTDFSAQIAMVSKLKNEYFLELLGYCLEDGNRMVAYQFATMGSLHNILHGKKGVQGAEPGPVLNWAQRVKIAYGAARGLEYLHEKVQPSIVHRDIRSSNVLIFDDFSSKIADFNLTNQGTDTAARLHSTRVLGTFGYHAPEYAMTGQINQKSDVYSFGVILLELLTGRKPVDHTMPKGQQSLVTWATPRLSEDKVKQCVDPKLNSDYPPKAVAKLAAVAALCVQYESDFRPNMTIVVKAITPLLNAPKPAAPAAPQS

SEQ ID NO: 12924 - protein, 363 aa, Oryza sativa
MSCCGGAEEDSYGPPANQAAPPPNVNAPGNRGGPRGPGAARPGGPPKPVNIDVPAIPFEELKKITSNFSDRALIGEGSYGRVYNGTLSDGRAAVIKKLDPGASQETDSEFSAQIAMVSKLKNEYFLELLGYCLEDGNRMLAYQFATMGSLHNILHGKKGVQGAEPGPVLNWAQRVKIAYGAARGLEYLHEKVQPSIVHRDVRSSNVLIFDEFSSKIADFNLTNQGTDTAARLHSTRVLGTFGYHAPEYAMTGQINQKSDVYSFGVILLELLTGRKPVDHTMPKGQQSLVTWATPRLSEDKVKQCVDPKLNNDYPPKAVAKLAAVAALCVQYEADFRPNMTIVVKAIQPLLNTKPAGPAEPPPA

SEQ ID NO: 12925 - protein, 365 aa, Glycine max
MLCCGGAEEESSGPPANQYPTAPPRGGSTYGGGNDRGEPRGNVAKSGAPQKVLPIEIPSMPLDELNRLTGNFGTKAFIGEGSYGRVYYAKLSDGTDAAIKKLDTSSSAEPDSDFAAQLSIVSRLKHDNFVELIGYCLEADNRLLVYQYASLGSLHDVLHGRKGVQGAEPGPVLSWSQRAKIAFGAAKGLEFLHEKVQPSIVHRDVRSSNVLLFNDYEAKIADFSLTNQSSDTAARLHSTRVLGTFGYHAPEYAMTGQITQKSDVYSFGVVLLELLTGRKPVDHTMPKGQQSLVTWATPRLSEDKVKQCVDPKLNNDYPPKAIAKLGAVAALCVQYEADFRPNMTIVVKALQPLLNAKPAGPDSHA

SEQ ID NO: 12926 - protein, 365 aa, Nicotiana tabacum
MSCCGGGEEDVYSGGPPSNQNTAPPRAGNPYGGASDRGEPGGGAKTGTPQKVLPIEIPVVSLDELNKLTGNFGQKALIGEGSYGRVFFAKLSDGQQAAIKKLDTSSSSEPDSDFTAQLSMVSALKHEHFVTLMGYCLEANNRILVYEFAAMGSLHDVLHGRKGVQGAEPGPVLTWNERVKIAYGAAKGLEYLHEKVQPPIVHRDVRSSNVLLFDDFTAKIADFNLTNQSSDTAARLHSTRVLGTFGYHAPEYAMTGQITQKSDVYSFGVVLLELLTGRKPVDHTMPKGQQSLVTWATPRLSEDKVKQCVDPKLNNDYPAKAIAKMAAVAALCVQYEADFRPNMTIVVKALQPLLNAKPAGPESNT

SEQ ID NO: 12927 - protein, 363 aa, Eutrema halophilum
MSCFGWCGSDDFRKAADSGPMPAHNPAGYNGGHYQRAAPLMNQPVIQMQPVSVPAIPADELRDITDNYGSKALIGEGSYGRVFYGVLKSGSVAAIKKLDSSKQPDQEFLSQVSMVSRLRHDNVIALIGYCVDGPLRVLAYEYAPNGSLHDILHGRKGVKGALRGPVMTWQQRVKIAVGAARGLEYLHEKVNPQVIHRDIKSSNVLLFDDDVAKIADFDLSDQAPDMAARLHSTRVLGTFGYHAPEYAMTGTLSTKSDVYSFGVVLLELLTGRKPVDPTLPRGQQSLVTWATPKLSEDKVKQCIDARLLGEYPPKAVAKLAAVAALCVQYEANFRPNMSIVVKALQPLLNPPRSAPQTPHRNPY

SEQ ID NO: 12928 - protein, 363 aa, Eutrema parvulum
MGCFGWCGTDDFRKTADTGPMPAHNPAGYSGSHYLRNDPPMNQPVVAMQPIAVPAIPVDELRDITDNYGPKALIGEGSYGRVFYGVLKSGRISAIKKLDSSKQPDQEFLSQISRVSRLQHENVIALVGYCVDGPLRVLAYEYAPNGSVHDILHGRKGVKGALRGPLMTWQQRVKIAVGAARGLEYLHEKVSPPVIHRDIKSCNILLFDDDVAKIADFDLSDQAPDMAARLHSTRVLGTFGYHAPEYAMTGTLSTKSDVYSFGVVLLELLTGRKPVDHTLPRGQQSVVTWATPKLSEDKVKQCVDARLLGEYPPKAVAKLAAVAALCVQFEANFRPNMSIVVKALQPLLNPPRSAPQTPHRNPY

SEQ ID NO: 12929 - protein, 361 aa, Cirsium arvense
MSCFNCCGEDDMHKSYDNGPFMANNAAGHNAGYRATEAAPKDTQAVAIQPIAVPALQVDELKEITDNFGTKSLIGEGSYGRVYHGVLRSGQAAAIKKLDSSKQPDQEFLAQVSMVSRLKHDNVVGLLGYCVDGGLRVLAYEYASNGSLHDILHGRKGVKGAQPGPVLSWSQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDTRLNAEYPPKAVAKMAAVAALCVQYEADFRPNMSIVVKALQPLLNARPGPQTEAPHL

SEQ ID NO: 12930 - protein, 361 aa, Unknown
  Sequence found in Organisms: Citrus sinensis, Citrus clementina, Citrus sinensis
MSCFGCCEEDDMHKAADNGNAYMVKSSAGTDGAYHASEAAPKGAQAVKVQPIEVPAISVDELKEITENFGTNALIGEGSYGRVYYGILKSGHAAAIKKLDASKQPDEEFLAQVSMVSRLKHENFVQLLGYCVDGTSRVLAYEFASNGSLHDILHGRKGVKGAQPGPVLSWQQRVKIAVGAAKGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDARLGGDYPPKAVAKMAAVAALCVQYEADFRPNMSIVVKALQPLLNARPGPAGESAS

SEQ ID NO: 12931 - protein, 363 aa, Citrus clementina
MLCCGGQEEEPQPPASQTTAPPRSGNTQPGGSARGEPRTNVVKTGTPQKALPIEIPQIKLDELNRLTSNFGTKALIGEGSYGRVFYAKLTDGTPAAIKKLDTSSAPEPESDFAAQLSVVSRLKHEHFVELLGYCLESNNRILVYQFATMGSLHDVLHGRKGVQGAEPGPVLTWNQRVKVAYGAAKGLEFLHEKVQPPIVHRDVRSSNVLLFDDFKSKIADFNLTNQSSDTAARLHSTRVLGTFGYHAPEYAMTGQITQKSDVYSFGVVLLELLTGRKPVDHTMPKGQQSLVTWATPRLSEDKVKQCVDPKLNNDYPPKAIAKLAAVAALCVQYEADFRPNMTIVVKALQPLLNSKPAGPEAQA

SEQ ID NO: 12932 - protein, 362 aa, Eucalyptus grandis
MSCFSCCEDDDIHKAPDSGGMYPMKSSTGNDGAYHASESAPKGAQAVKVQPIEVPAIPVDELKEITDNFGTTALIGEGSYGRVYYGVLKSGQAAAIKKLDASKQPDDEFLAQVSMVSRLKDENFVELLGYCVDGSSRVLAYEFASNGSLHDILHGRKGVKGAQPGPVLSWAQRVKIAVGAAKGLEYLHEKAEPRVIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDARLGGEYPAKAVAKLAAVAALCVQYEADFRPNMSIVVKALQPLLNARPGPAGEARTL

SEQ ID NO: 12933 - protein, 363 aa, Eucalyptus grandis
MLCCGGSEEENYGPPASQYTAPPRGGDPYGNARGEPKPSNVARGGAPQKVLPIEVPALSLGELNRTTGNFGSKALVGEGSYGRVFLAKLSNGQRAAVKKLDTSSSEEPDSEFEAQLSMVSRLKHENFTELIGYCLEANNRILVYQFATQGSLHDILHGRKGVQNAEPGPVLSWNQRVKIAYGAARGLEYLHEKVQPPIVHRDIRSSNVLLFDDFLAKIADFNLSNQSSDTAARLHSTRVLGTFGYHAPEYAMTGQITQKSDVYSFGVVLLELLTGRKPVDHTMPKGQQSLVTWATPRLSEDKVKQCVDPKLNNDYPPKAIAKLAAVAALCVQYEADFRPNMTIVVKALQPLLNSKPAGPDSQA

SEQ ID NO: 12934 - protein, 362 aa, Euonymus alatus
MGCFSCCADDDMHKTSDNGGQYMFKNSAGNDGGYHTSETASKGAQAVKIQPIEVPALPVDELREVTDNFGTNALIGEGSYGRVYYGVLKSGQAAAIKKLDASKQPDDEFLAQVSMVSRLKHENFVQLLGYSVEGGSRVLAYEFASNGSLHDILHGRKGVKGAQPGPVLSWAQRVKIAVGAAKGLDYLHEKADPRVVHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDARLNGEYPPKAVAKMAAVAALCVQYEADFRPNMSIVVKALQPLLNARPGPTGETASS

SEQ ID NO: 12935 - protein, 363 aa, Citrus sinensis
MLCCGGQEEEPQPPASQTTAPPRSGNTQPGGSARGEPRTNVVKTGTPQKALPIEIPQIKLDELNRLTSNFGTKALIGEGSYGRVFYAKLTDGTPAAIKKLDTSSAPEPESDFAAQLSVVSRLKHEHFVELLGYCMESNNRILVYQFATMGSLHDVLHGRKGVQGAEPGPVLTWNQRVKVAYGAAKGLEFLHEKVQPPIVHRDVRSSNVLLFDDFKSKIADFNLTNQSSDTAARLHSTRVLGTFGYHAPEYAMTGQITQKSDVYSFGVVLLELLTGRKPVDHTMPKGQQSLVTWATPRLSEDKVKQCVDPKLNNDYPPKAIAKLAAVAALCVQYEADFRPNMTIVVKALQPLLNSKPAGPEAQA

SEQ ID NO: 12936 - protein, 360 aa, Phalaenopsis aphrodite
MSCFACCGEQDIYSAPDKGGAFPANQAAGYDGSNRASDPAPKGVQTVKVQPIEVPIIPVEEIKEVTDNFGNNALIGEGSYGRVYYGLLKNGKAAALKKLDSSKQPDQEFLAQVSMVSRLKNENVVELLGYYVDGGLRVLAYEFATMGSLHDILHGRKGLKGAQPGPVLSWTQRVKIAVGAARGLEYLHEKAQPRIIHRDIKSSNILLFDEDVAKIADFDLSNQSPDMAARLHSTRVLGTFGYHAPEYAMTGQLSAKSDVYSFGVVLLELLTGRKPVDHTLPRGQQSLVTWAAPRLSEDKVKQCVDTRLGTDYPPKSVAKFAAVAALCVQYEADFRPNMSIVVKALQPLLNARSGGPAVES

SEQ ID NO: 12937 - protein, 140 aa, Platanus occidentalis
GVLKNGRQTAIKKLDSSKQPDQEFLAQFSMVSRLIHENVVELVGYCVDGNLRVLAYEFATMGSLHDILHGRKGVKGAQPGPVLSWAQRVKIAVGAAKGLEYLHEKAQPHIIHRDIKSSNVLLFDDDVAKIADFDLYKSSS

SEQ ID NO: 12938 - protein, 203 aa, Scabiosa columbaria
KGAQPGPVLSWSQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDTRLNSEYPPKAVAKMAAVAALCVQYEADFRPNMSIVVKALQPLLNTRSGPPTESHHL

SEQ ID NO: 12939 - protein, 243 aa, Silene vulgaris
MVSRLKHDNVLELVGYCLDSTLRVLAYEYAPNGSLHDILHGRKGVKGAQPGPVLTWAQRVKIAVGAARGLEYLHEKAQPHIIHRDIKSSNVLLFDEDVAKIADFDLSNQAPDMAARLHSTRVLGTFGYHAPEYAMTGQLSSKSDVYSYGVVLLELLTGRKPVDHTLPRGQQSLVTWATPKLSEDKVKQCVDPRLGSDYPPKAVAKMAAVAALCVQYESDFRPNMSIVVKALQPLLNTRTGPQP

SEQ ID NO: 12940 - protein, 371 aa, Solanum lycopersicum
MICCGGAEEDSYISGPPVNQNTAPPKAGNPQSYGAAGSERGEARSGGAAPKSGPPQKILPIEVPEMSLAELNRLTANFGKKTLIGEGSYGRVFAAKLSNGQQAAIKKLDTACSPEPDSDFTAQLSMVSRLKHEHFVTLLGCCLTANNRILVFEFATMGSLHDVLHGRKGVQGAEPGPVLTWNQRVKIAYGAAKGLEYLHEKVQPPIKHRDVRSSNVLLFDDFTAKIADFNLTNQCSDTAARLHSTRVLGTFGYHAPEYAMTGQITQKSDVYSFGVVLLELLTGRKPVDHTMPKGQQSLVTWATPRLSEDKVKQCVDPKLNNEYPPKAIAKMAAVAALCVQYEADFRPNMTIVVKALQPLLNAKPAGAQPHA

SEQ ID NO: 12941 - protein, 354 aa, Solanum lycopersicum
MSCFSCCDDDDMHRATDNGPFMAHNSAGNNGGQRATESAQRETQTVNIQPIAVPSIAVDELKDITDNFGSKALIGEGSYGRVYHGVLKSGRAAAIKKLDSSKQPDREFLAQVSMVSRLKDENVVELLGYCVDGGFRVLAYEYAPNGSLHDILHGRKGVKGAQPGPVLSWAQRVKIAVGAAKGLEYLHEKAQPHIIHRDIKSSNILLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVKQCVDARLNTDYPPKAIAKMAAVAALCVQYEADFRPNMSIVVKALQPLLPRPVPS

SEQ ID NO: 12942 - protein, 361 aa, Trigonella foenum-graecum
MSCFSCCEEDEFHKAAESGGPYVVKNPAGNDGNYHASETAKQGAQTVKVQPIEVPEIQADELKEVTDNFGQDSLIGEGSYGRVYYGVLKSGQAAAIKKLDASKQPDEEFLAQVSMVSRLKHDNFVQLLGYCVDGNSRILAYEFASNGSLHDILHGRKGVKGAQPGPVLTWAQRVKIAVGAARGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDTRLGGEYPPKAVAKMAAVAALCVQYEADFRPNMSIVVKALQPLLTARAGPAGETAN

SEQ ID NO: 12943 - protein, 277 aa, Tripterygium wilfordii
GVLKSGQTAAIKKLDASKQPDDEFLAQVSMVSRLKHENFVQLLGYSVEGGSRVLAYEFASNGSLHDILHGRKGVKGAQPGPVLSWAQRVKIAVGAAKGLEYLHEKADPHIVHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDARLNGEYPPKAVAKMAAVAALCVQYEADFRPNMSIVVKALQPLLHARPGPTGETASS

SEQ ID NO: 12944 - protein, 361 aa, Valeriana officinalis
MSCFGCCADDEMQKASDNGPFMANNTAGGHNAGYYATQDAPRDTKAVPIQPIAVPSIQVDELKEITDNFGTKSLIGEGSYGRVYHGVLRSGAAAAIKKLDSSKQPDHEFLAQVSMVSRLKHDNVVELLGYSVDSSLRVLAYEYASNGSLHDILHGRKGVKGAQPGPVLSWSQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDTRLNSEYPPKAVAKMAAVAALCVQYEADFRPNMSIVVKALQPLLNTRSGPPTESHH

SEQ ID NO: 12945 - protein, 361 aa, Aquilegia formosa
MGCFGCCEEDDNYKASDNRVPVMANNSAGHNHATDTAPKGAQSVKVQPIAVPSISVDELKEVTDNFGTKALVGEGSYGRVYYGVMRNGLTAAIKKLDASKQPDQEFLAQVSMVSRLKHENVVELISYCVDGNLRVLAYEFATMGSLHDILHGRKGVKGAQPGPVLSWAQRVKIAVGAAKGLEYLHEKAQPHVIHRDIKSSNVLLFDDDVAKIADFDLSNQAPDMAARLHSTRVLGTFGYHAPEYAMTGQLNSKSDVYSFGVVLLELLTGRKPVDHTLPRGQQSLVTWATPRLSEDKVRQCVDQRLGGDYPPKAVAKMAAVAALCVQYEADFRPNMSIVVKALQPLLNARSGAPGPGETPNL

SEQ ID NO: 12946 - protein, 361 aa, Arabidopsis lyrata
MSCFGCCREDDLPGAADYGAHNMTKQSGGNDGRRNGSETAQKGAQSVKVQPIEVAAILAAELIEATNDFGTNSLIGEGSYARVYHGVLKNGQRASVKKLDSNKQPDEEFLAQVSMVSRLKHANFIELLGYSVDGNTRILVFEFAQNGSLHDILHGRKGVKGAKPGPLLSWHQRVKIAVGAARGLEYLHEKANPHVIHRDIKSSNVLIFDNDVAKIADFDLSNQAPDMAARLHSTRVLGTFGYHAPEYAMTGQLSAKSDVYSFGVVLLELLTGRKPVDHTLPRGQQSLVTWATPKLSEDKVKQCVDSRLGGDYPPKAVAKLAAVAALCVQYEADFRPNMSIVVKALQPLLNARTGPAGEGAP

SEQ ID NO: 12947 - protein, 361 aa, Arabidopsis thaliana
MSCFGCCREDDLPGANDYGGHNMTKQSGGNDGRRNGSETAQKGAQSVKVQPIEVAAILADELIEATNDFGTNSLIGEGSYARVYHGVLKNGQRAAIKKLDSNKQPNEEFLAQVSMVSRLKHVNFVELLGYSVDGNSRILVFEFAQNGSLHDILHGRKGVKGAKPGPLLSWHQRVKIAVGAARGLEYLHEKANPHVIHRDIKSSNVLIFDNDVAKIADFDLSNQAPDMAARLHSTRVLGTFGYHAPEYAMTGQLSAKSDVYSFGVVLLELLTGRKPVDHTLPRGQQSLVTWATPKLSEDKVKQCVDSRLGGDYPPKAVAKLAAVAALCVQYEADFRPNMSIVVKALQPLLNARTGPAGEGAP

SEQ ID NO: 12948 - protein, 362 aa, Aristolochia fimbriata
MGCFSCCEDDDFNKAAESGGSYMANNSAGNAGAYHASDPVPKGPQAVKSQPPAVPAIPVDELKEVTDNFGQKALIGEGSYGRVYHGVLKNGQTAAIKKLDASKQPDLEFLAQVSMVSRLKHENVVELIGYCVDGSLRVLAYEFATMGSLHDILHGRKGVKGAQPGPVLSWAQRVKIAVGAARGLEYLHEKAQPHIIHRDIKSSNVLLFDDDVAKIADFDLSNQAPDNAARLHSTRVLGTFGYHAPEYAMTGQLSAKSDVYSFGVVLLELLTGRKPVDHTLPRGQQSLVTWATPRLSEDKVRQCVDTRLGGEYPPKAVAKMAAVAALCVQYEADFRPNMSIVVKALQPLLNTRSGPHGEASNL

SEQ ID NO: 12949 - protein, 362 aa, Hordeum vulgare
MSCFGCCGDEDTQRAPDNRNQYPGSHPARNDAYRTADPTPKGPQPVKVQPIAVPAIPMDEIREATQGFGDEALIGEGSFGRVYFGTLRNGRGAAIKKLDSSKQPDQELLAQVSMVSRLKHENVVELLGYCLDGNTRVLAYEFATMGSLHDMLHGRKGVKGAQPGPVLSWIQRVKIAVGAAKGLEYLHEKAQPHVIHRDIKSSNVLLFDEDVAKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGDYPPKAVAKFAAVAALCVQYEADFRPNMSIVVKALQPLLNARAAHPGAEHAGR

SEQ ID NO: 12950 - protein, 361 aa, Phaseolus coccineus
MSCFSCCEEDELQKSAESGGPYVVKNPAGNDGNYHASETAKQGTQPVKAQPIEVPNIPADELKDVTDNFGQDALIGEGSYGRVYYGVLKSEQAAAIKKLDASKQPDEEFLAQVSMVSRLKHENFVRLLGYCIDGSSRILAYEFASNGSLHDILHGRKGVKGAQPGPVLSWAQRVKIAVGAARGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDTRLGGEYPPKAVAKMAAVAALCVQYEADFRPNMSIVVKALQPLLAARPGPAGETPN

SEQ ID NO: 12951 - protein, 361 aa, Beta vulgaris
MSCFSCCGDDDFQRGGDNGAFMTHNPSGNHTAYPTKEDKPKDTQTVNFQPPAVPAITVDELKEITENFGTKALIGEGSYGRVYYGTLRSGQAAALKKLDSSKQPDQEILGQVSMVSRLKHENVLELVGYCLDGNFRVLAYEYAANGSLHDILHGRKGVKGAQPGPVLSWAQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDPRLGSDYPPKAVAKMAAVAALCVQYESDFRPNMSIVVKALQPLLNTRTGPHNEASHV

SEQ ID NO: 12952 - protein, 365 aa, Brachypodium distachyon
MWCCAGVEEERHGPPAGYPATPPPRAPAQARGPHAPRNGVGPAKVLPIDVPAVSLAELNRATGNFGSRSLVGEGSYGRVYRAKLNSSTGETTTVAVKMFDNGGSGQPEPEFCAQLSVVSRLKSEHFTQLLGYCLELNNRIALYEFATEGSLYDILHGKKGGAGGQHQQGPSGPALTWAQRARVALGAAKGLEYLHEKAQPSVIHRDVRSSNVLVFGGHVGKIADFNLSNQSADSAARLHSTKVLGTFGYHAPEYAMTGQLTHKSDVYSFGVVLLELLTGRKPVDHTMPKGQQSLVTWATPRLSEDKVKQCVDPKLNNDYPPKAVAKLAAVAALCVQYEADFRPNMTIVVKALQPLVSARPGGDQH

SEQ ID NO: 12953 - protein, 362 aa, Theobroma cacao
MSCFGCCEEDDFHKAADNGGQYMVKNSAGNDGGYHTSETASKSAQTVKVQPIEVPAIPADELKEITDNFGTNSLIGEGSYGRVYYGVLKSGQAAAIKKLDASKQPDDEFLAQVSMVSRLKHENFVQLLGYCVDGSSRILAYEFASNGSLHDILHGRKGVKGAQPGPVLTWAQRVKIAVGAAKGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDQRLGGEYPPKAVAKMAAVAALCVQYEADFRPNMSIVVKALQPLLNARPGPAGETPST

SEQ ID NO: 12954 - protein, 362 aa, Gossypium hirsutum
MSCFGCCEEDNIHNATDNGGQYMVKNSAGNVGGYHTSETASKSAQTVKVQPIEVPAILADELKEITDNYGNDALIGEGSYGRVYYGVLKSGEAAAIKKLDASKQPDDEFLAQVSMVSRLKHENFVQLLGYCVDGSSRILAYEFASNGSLHDILHGRKGVKGAQPGPVLTWAQRVKIAVGAAKGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPRLSEDKVRQCVDQRLGGDYPPKAVAKMAAVAALCVQYEADFRPNMSIVVKALQPLLNARPGPAGETPST

SEQ ID NO: 12955 - protein, 354 aa, Solanum melongena
MSCFGCCEDDDMHRAADNGPFMAHHSADNNGGQHATESAQKETQTVNIQPIAVPSIAVDELKDITDNFGSKALIGEGSYGRVYHGVLKSGRAAAIKKLDSSKQPDREFLAQVSMVSRLKDENVVELLGYCVDGGFRVLAYEYAPNGSLHDILHGRKGVKGAQPGPVLSWAQRVKIAVGAAKGLEYLHEKAQPHIIHRDIKSSNILLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVKQCVDARLNTDYPPKAIAKMAAVAALCVQYEADFRPNMSIVVKALQPLLPRPVPS

SEQ ID NO: 12956 - protein, 304 aa, Festuca arundinacea
  misc_feature (294)..(294): Xaa can be any naturally occurring amino acid
HEADISPPTIDVPELSFEDLKQKTDNFGSSSLIGEGSYGRVYHATMDDGRQAAIKKFDASENEPNDEFLKQVSLVSRLKHDNLVEMLGYYVEGNYRILAYEFATMGSLHDVLHGRKGVQGAQPGPVLDWVQRVKIAIEAAKGIEYLHEKVQPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCIDPRLKGEYPPKGVAKLAAVAALCVQYEAEFXPNMSIVVKAL

SEQ ID NO: 12957 - protein, 139 aa, Setaria italica
PDMAARLHSTRVLGTFGYHAPEYAMTGQLSSKSDVYSFGVVLLELLTGRKPVDHTLPRGQQSLVTWATPRLSEDKVRQCVDSRLGGDYPPKAVAKFAAVAALCVQYEADFRPNMSIVVKALQPLLNARAAHPGAEHAGR

SEQ ID NO: 12958 - protein, 360 aa, Glycyrrhiza uralensis
MSCFSCCEEDDYHKTAESGGPYVVKNSGNDGNYHASETAKQGAQTVKIQPIEVPEIPVDELKEITDNFGESSLIGEGSYGRVYYGVLKSGQAAAIKKLDASKQPDEEFLAQVSMVSRLKHDNFVQLLGYCVDGNSRVLAYEFASNGSLHDILHGRKGVKGAQPGPVLTWAQRVKIAVGAAKGLEYLHERANPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDTRLGGEYPPKAVAKMAAVAALCVQYEADFRPNMSIVVKALQPLLTARPGPAGETAN

SEQ ID NO: 12959 - protein, 361 aa, Lotus japonicus
MSCFNCCEEDDFHKTAESGGPYVVKNPSGNDGNHHASETAKQGGQTVKPQPIEVPNISEDELKEVTDNFGQDSLIGEGSYGRVYYGVLKNGQAAAIKKLDASKQPDEEFLAQVSMVSRLKHENFVQLLGYSVDGNSRILVYEFASNGSLHDILHGRKGVKGAQPGPVLTWAQRVKIAVGAARGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDTRLGGEYPPKAVAKMAAVAALCVQYEADFRPNMSIVVKALQPLLTARPGPAGETAN

SEQ ID NO: 12960 - protein, 362 aa, Zea mays
MSCFACCGDEDTQVPDTRAQYPGHHPARADAYRPSDQPPKGPQPVKMQPIAVPAIPVDEIREVTKGFGDEALIGEGSFGRVYLGVLRNGRSAAVKKLDSNKQPDQEFLAQVSMVSRLKHENVVELLGYCADGTLRVLAYEFATMGSLHDMLHGRKGVKGAQPGPVLSWSQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGDYPPKAVAKFAAVAALCVQYEADFRPNMSIVVKALQPLLNAHARATNPGEHAGS

SEQ ID NO: 12961 - protein, 356 aa, Zea mays
MSCFACCGDEDTQVPDTRTQYPGHHPARADAYRPADQPPKGSQPVKMQPIAVPAIPVDELREVTKGFGDEALIGEGSFGRVYLGVLRNGRSAAVKKLDSNKQPDQEFLAQVSMVSRLKHENVVELLGYCADGTLRVLAYEFATMGSLHDMLHGRKGVKGAQPGPVLSWLQRVKIAVGAAKGLEYLHEKAQPHIMHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGDYPPKAVAKFAAVAALCVQYEADFRPNMSIVVKALQPLLNAHARATNP

SEQ ID NO: 12962 - protein, 283 aa, Pennisetum glaucum
RALSGEGSYARVYNATLSDGRAAVIKKLDTSASQDSDSDFAAQIAMVSKLKNEYFLELVCLEDGNRMLAYQFATMGSLHNILHGKKGVQGAEPGPVLNWLQRVKIAYGAARGLEYLHEKVQPSIVHRDIRSSNVLIFDDFNSKIADFNLTNQGTDTAARLHSTRVLGTFGYHAPEYAMTGQINQKSDVYSFGVILLELLTGRKPVDHTMPKGQQSLVTWATPRLSEDKVKQCVDPKLNNDYPPKAVAKLAAVAALCVQYESDFRPNMTIVVKAIQPLLNAPKP

SEQ ID NO: 12963 - protein, 362 aa, Mimulus guttatus
MSCFGCCEDDDMHKAAGNGPYMTTNYAGNPAGNYAAETAQKEKQAVAMQPIAVPAISVDELKDITDNFGSKCLIGEGSYGRVYHGVLKTGQAAAIKKLDSSKQPHQEFLAQVSMVSRLKHENVVELLGYCVDGGLRVLAYEYAPNGSLHDILHGRKGVKGAQPGPVLSWAQRVKIAVGAAKGLEYLHEKSQPHIIHRDIKSSNVLLFDDDVAMIADFDLSNQAPDMAARLHSTRVLGTFGYHAPEYAMTGQLSSKSDVYSFGVVLLELLTGRKPVDHTLPRGQQSLVTWATPKLSEDKVKQCVDGRLNGEYPPKAVAKMAAVAALCVQYEADFRPNMSIVVKALQPLLNTRSGPPTTETPNY

SEQ ID NO: 12964 - protein, 360 aa, Nicotiana benthamiana
MGCFGCCDDDDMHKAADHGPFMTNNSAGYNAGQRATESAQKETQTVNIQPIAVPSIAVDELKDITDNFGTKALIGEGSYGRVYHGVLKSGRAAAIKKLDSSKQPDREFLAQVSMVSRLKHDNVVELLGYSVDGGLRVLAYEYAPNGSLHDILHGRKGVKGAQPGPVLSWAQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVKQCVDARLGTDYPPKAVAKMAAVAALCVQYEADFRPNMSIVVKALQPLLHARSAPSETSNV

SEQ ID NO: 12965 - protein, 361 aa, Cajanus cajan
MSCFSCCEEDDFQKTAESGGQHLIKNTTGSDGNGRASETAKQGTQTVKIQPIEVPELSVDELKEITDSFGESSLIGEGSYGRVYYGVLRSGQAAAIKKLDASKQPDEEFLAQVSMVSRLKNENFVQLLGYCIDGNSRVLAYEFASNGSLHDILHGRKGVKGAQPGPVLTWTQRVKIAVGAAKGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPRLSEDKVRQCVDGRLGGEYPPKAVAKMAAVAALCVQYEADFRPNMSIVVKALQPLLNARHGPAGETSN

SEQ ID NO: 12966 - protein, 361 aa, Cajanus cajan
MSCFGCCEDDDLNKAAENGGPYVVKNPAGNDGNYHASETAKQGAQPVKAQPIEVPNIQADELKEVTDNFGQDSLIGEGSYGRVYYGSLKSGQAAAIKKLDASKQPDEEFLAQVSMVSRLRHENFVQLLGYCIDGSSRILAYEFASNGSLHDILHGRKGVKGAQPGPVLTWAQRVKIAVGAARGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDTRLGGEYPPKAVAKMAAVAALCVQYEADFRPNMSIVVKALQPLLTARPGPAGETPN

SEQ ID NO: 12967 - protein, 362 aa, Populus trichocarpa
MSCFGCCEEDDVQKAADNGGPYAVKSSAGHVGNYHASETAPRGPQAVKIQPIEVPAISVDELKEVTVNFGTDSLIGEGSYGRVYYGVLKSEQAAAIKKLDASKQPDDEFLAQVSMVSRLKHENFVQLLGYCVDGGSRVLAYEFASNGSLHDILHGRKGVKGAQPGPVLTWPQRVKIAVGAAKGLEYLHEKADPRIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVKQCVDARLQGECPLKAVAKMAAVAALCVQYEADFRPNMSIVVKALQPLLNARPGPAGESVGM

SEQ ID NO: 12968 - protein, 354 aa, Unknown
  Sequence found in Organisms: Solanum tuberosum, Solanum phureja
MSCFSCCDDDDMHRAADNGPFMAHNSAGNNGGQHATESAQRETQTVNIQPIAVPSIAVDELKDITDNFGSKALIGEGSYGRVYHGVLKSGRAAAIKKLDSSKQPDREFLAQVSMVSRLKDDNVVELLGYCVDGGFRVLAYEYAPNGSLHDILHGRKGVKGAQPGPVLSWAQRVKIAVGAAKGLEYLHEKAQPHIIHRDIKSSNILLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVKQCVDARLNTDYPPKAIAKMAAVAALCVQYEADFRPNMSIVVKALQPLLPRPVPS

SEQ ID NO: 12969 - protein, 306 aa, Solanum phureja
MSLVELNRLTGNFGKKTLIGEGSYGRVFGAKLSNGQQAAIKKLDTTSSPEPDSDFTAQLSMVSRLKHEHFVTLLGCCLAANNRILVYEFATMGSLHDVLHGRKGVQGAEPGPVLTWNQRVKIAYGAARGLEYLHEKVQPPIKHRDVRSSNVLLFDDFTAKIADFNLTNQCSDTAARLHSTRVLGTFGYHAPEYAMTGQITQKSDVYSFGVVLLELLTGRKPVDHTMPKGQQSLVTWATPRLSEDKVKQCVDPKLNNEYPPKAIAKMAAVAALCVQYEADFRPNMTIVVKALQPLLNAKPAGAEPHA

SEQ ID NO: 12970 - protein, 113 aa, Sorghum bicolor
MWRRCCCNCQVDESDQRENDLVKATTNNIDGATKGFKDSATGKVESHNAAPPIDIPVLSLDELIEKTDDFGSTALIGEGSYGRVYYAVLDNGTKMAVKKLDSTENEPTTKFLT

SEQ ID NO: 12971 - protein, 362 aa, Sorghum bicolor
MSCFACCGDEDTQVPDTRTQYPGHHPARTDAYRPADQPPKGPQPVKMQPIAVPAIPVDEIREVTKGFGDEALIGEGSFGRVYFGVLRNGRSAAVKKLDSNKQPDQEFLAQVSMVSRLKHENVVELLGYCADGTLRVLAYEFATMGSLHDMLHGRKGVKGAQPGPVLSWSQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGDYPPKAVAKFAAVAALCVQYEADFRPNMSIVVKALQPLLNAHARATNPGENAGS

SEQ ID NO: 12972 - protein, 361 aa, Glycine max
MSCFSCCEEDDLHKAAESGGPYVVKNPAGNDGNYHASQTAKQGTQPVKPQPIEVPNISADELKEVTDNFGQDSLIGEGSYGRVYYGVLKSGQAAAIKNLDASKQPDEEFLAQVSMVSRLKHENFVQLLGYCIDGTSRILAYQFASNGSLHDILHGRKGVKGAQPGPVLTWAQRVKIAVGAARGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDTRLGGEYPPKAVAKMAAVAALCVQYEADFRPNMSIVVKALQPLLTARPGPAGETPN

SEQ ID NO: 12973 - protein, 361 aa, Glycine max
MSCFSCCEEDDLHKAAESGGPYVVKNPAGNDGNYLASETAKQGTQPVKPQPIEVPNISADELKEVTDNFGQDALIGEGSYGRVYYGVLKSELAAAIKKLDASKQPDEEFLAQVSMVSRLKHENFVQLLGYCIDGSSRILAYEFASNGSLHDILHGRKGVKGAQPGPVLTWAQRVKIAVGAARGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDTRLGGEYPPKAVAKMAAVAALCVQYEADFRPNMSIVVKALQPLLTARPGPAGEIPN

SEQ ID NO: 12974 - protein, 361 aa, Glycine max
MSCFGCCEEDDYQKTAESGGQHVVKNSTGNDGNSRASETAKQGTQAVKIQPIEVPELQVDELKEITDGFGESSLIGEGSYGRVYYGVLKSGQAAAIKKLDASKQPDDEFLAQVSMVSRLKHDNFVQLLGYCIDGNSRVLAYEFASNGSLHDILHGRKGVKGAQPGPVLTWTQRVKIAVGAAKGLEYLHERADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPRLSEDKVRQCVDARLGGEYPPKAVAKMAAVAALCVQYEADFRPNMSIVVKALQPLLNARHGPAGETPN

SEQ ID NO: 12975 - protein, 365 aa, Fragaria vesca
MSCCGGAEEENYGPPPNQYTTAPPRGGGGGAYGNDRGEPRSSNPVRSGAPAKALPIELPAMPLDELIRLTGNFGQKALIGEGSYGRVFYAKLSNGKPAAIKKLDAGSQEPDSDFGNQLSTVSRLKHDHFVELMGYCLEGNNRILVFEFAQMGSLHDILHGRKGVQGAEPGPALSWNQRIKIAYGAAKGLEYLHEKVQPSIVHRDVRSSNVLLFDDHVAKIADFNLTNQSSDTAARLHSTRVLGTFGYHAPEYAMTGQITQKSDVYSFGVVLLELLTGRKPVDHTMPKGQQSLVTWATPRLSEDKVKQCVDPKLNNDYPPKAIAKLAAVAALCVQYEADFRPNMTIVVKALQPLLNSKPAGPDANA

SEQ ID NO: 12976 - protein, 362 aa, Saccharum officinarum
MSCFACCGDEDTQVPDTRTQYPGHHPARADAYRPADQPPKGPQPVKMQPIAVPAIPVDEIREVTKGFGDEALIGEGSFGRVYFGVLRNGRSAAVKKLDSNKQPDQEFLAQVSMVSRLKHENVVELLGYCADGTLRVLAYEFATMGSLHDMLHGRKGVKGAQPGPVLSWSQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGAYPPKAVAKFAAVAALCVQYEADFRPNMSIVVKALQPLLNAHARATNPGENAGS

SEQ ID NO: 12977 - protein, 334 aa, Solanum lycopersicum
SERGEARSGGAAPKSGPPQKILPIEVPEMSLAELNRLTANFGKKTLIGEGSYGRVFAAKLSNGQQAAIKKLDTACSPEPDSDFTAQLSMVSRLKHEHFVTLLGCCLTANNRILVFEFATMGSLHDVLHGRKGVQGAEPGPVLTWNQRVKIAYGAAKGLEYLHEKVQPPIKHRDVRSSNVLLFDDFTAKIADFNLTNQCSDTAARLHSTRVLGTFGYHAPEYAMTGQITQKSDVYSFGVVLLELLTGRKPVDHTMPKGQQSLVTWATPRLSEDKVKQCVDPKLNNEYPPKAIAKMAAVAALCVQYEADFRPNMTIVVKALQPLLNAKPAGAQPHA

SEQ ID NO: 12978 - protein, 362 aa, Triphysaria pusilla
MSCFGCCEDDDMHKTPGNGAYPTTHTTGNPAGYHATETAQKDKQTINMQPISVPAIPVDELKDITDNFGSKSLIGEGSYGRVYHGVLKTGQAAAVKKLDSSKQPDQEFLSQVSMVSRLKNENVVGLLGYCVDGGLRVLAYEFAPNGSLHDILHGRKGVKGAQPGPVLSWAQRVKIAVGSAKGLEYLHEKATPRIIHRDIKSSNVLLYDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDERLNGEYPPKAVAKMAAVAALCVQYEADFRPNMSIVVKALQPLLNARSAGPPIEIPNL

SEQ ID NO: 12979 - protein, 362 aa, Triticum aestivum
MSCFGCCGDEDTQRAPDNRNQYPGSHPARNDAYRTADPIPKGPQPVKVQPIAVPTIPMDEIREVTKGFGDEALIGEGSFGRVYFGTLRNGRGAAIKKLDSSKQPDQELLAQVSMVSRLKHENVVELLGYCLDGNTRVLAYEFATMGSLHDMLHGRKGVKGAQPGPVLSWIQRVKIAVGAAKGLEYLHEKAQPHVIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGDYPPKAVAKFAAVAALCVQYEADFRPNMSIVVKALQPLLNARAAHPGAEHAGR

SEQ ID NO: 12980 - protein, 361 aa, Medicago truncatula
MSCFGCCEEDEFHKAAESGGPYVVKNPAGNDGNYHASDTAKQGAQTVKVQPIEVPEIQADELKEVTDNFGQDSLIGEGSYGRVYYGVLKSGQAAAIKKLDASKQPDEEFLAQVSMVSRLKHDNFVQLLGYCVDGNSRILAYEFASNGSLHDILHGRKGVKGAQPGPVLTWAQRVKIAVGAARGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDTRLGGEYPPKAVAKMAAVAALCVQYEADFRPNMSIVVKALQPLLTARAGPAGETAN

SEQ ID NO: 12981 - protein, 98 aa, Petunia hybrida
YSFGVVLLELLTGRKPVDHTMPRGQQSLVTWATPRLSEDKVQQCVDPKLKGYPPKAVAKMAAVAALCVQYEAEFRPNMSIVVKALQPLLKAPAPAPET

SEQ ID NO: 12982 - protein, 364 aa, Hordeum vulgare
MSCCGSAEEDTYGPPANQAAPPPNVNAPGNRGGPRGPGAQRPGGPPKVLTIDVPAIPLDELNKMTNNFSDKALIGEGSYGRVYNCTLSDGRPAVIKKLDPSASQESDPDFSAQLAMVSKLKNEYFVELLGYCMEEGNRMLAYQFATMGSLHNILHGKKGVQGAEPGPVLNWAQRVKIAYGAARGLEYLHEKVQPSIVHRDIRSSNILIFDEFSSKIADFNLTNQGTDTAARLHSTRVLGTFGYHAPEYAMTGQINQKSDVYSFGVILLELLTGRKPVDHTMPKGQQSLVTWATPRLSEDKVKQCVDPKLNSDYPPKAVAKLAAVAALCVQYESDFRPNMTIVVKAIQPLLNQKPAGPAAEAPRP

SEQ ID NO: 12983 - protein, 364 aa, Brachypodium distachyon
MSCCGSAEEDTYGPPANQAAPPPNVNNPGNRGGPRGPGAQRPGGPPKVVNIDVPAIPLDELNKMTNNFSDRSLIGEGSYGRVYNGTLSDGRAAVIKKLDSSTSQESDAEFSAQLAMVSKLKNEYFLELVGYCMEDGNRMLAYQFATMGSLHNILHGKKGVQGAEPGPVLNWAQRVKIAYGAARGLEYLHEKVQPSIVHRDIRSSNVLIFDEFSSKIADFNLTNQGTDSAARLHSTRVLGTFGYHAPEYAMTGQINQKSDVYSFGVILLELLTGRKPVDHTMPKGQQSLVTWATPRLSEDKVKQCVDPKLNNDYPPKAVAKLAAVAALCVQYESDFRPNMTIVVKAIQPLLNQKPAGPAIEAPRP

SEQ ID NO: 12984 - protein, 83 aa, Fagopyrum esculentum
MSVLQLLEVRRQQQPDDEYLAQVSMVSRLKHENFLNCLDIVWTEISVCLLMSLHLTGLFMIFFTVERVSKVHSLAQFCLGHSV

SEQ ID NO: 12985 - protein, 249 aa, Fagopyrum esculentum
VSRMKHENFLELLGYSVDGNLRVLAYEFASNGSLHDILHGRKGVKGAQPGPVLSWAQRVKIAVGAAKGLEYLHEKADPHIIHRDIKSSNVLLFDDDLAKIADFDLSNQAPDMAARLHSTRVLGTFGYHAPEYAMTGQLNAKSDVYSFGVVLLELLTGRKPVDHTLPRGQQSLVTWATPRLSEDKVKQCVDPRLNGEYPPKAVAKMAAVAALCVQYEADFRPNMSIVVKALQPLLNTRAGVGAGSETPGS

SEQ ID NO: 12986 - protein, 173 aa, Elaeis guineensis
MACFSWCGRNVSHLDTDSGGPFTTSNVSGNVGVNGGSDPAPRGAQSVRVQPIAVPAILLDEIKEITKYFSNETLIGEGSYAKVYYGVLKSGEKSAIKKLDASKQPDQEYLAQVSLVSRLKHENVDSYLAIVLMEISVFLHMSLPLWDPFMIFYMDGKALKEHNQVQFCHGHSG

SEQ ID NO: 12987 - protein, 357 aa, Setaria italica
MSCLACCGGEDTQRAPDSGGPYSGGYPARNDAYRTADPTPRGAQPVKAQPIAVPTIPVEEIREVTKGFGDEVLIGEGSFGRVYLGVLKNGRSAAIKKLDSSKQPEQEFLAQVSMVSRLKHDNVVELLGYCVDGNTRILAYEFATMGSLHDILHGRKGVKGAQPGPVLSWTQRVKIAVGAAKGLEYLHEKAQPHIIHRDIKSSNVLLFDDDVSKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGEYPPKSVAKFAAVAALCVQYEADFRPNMSIVVKALQPLLNARASNNPG

SEQ ID NO: 12988 - protein, 364 aa, Silene vulgaris
MSCFGCFGGDNSHKPIENGGGYVPPKPSGRDGYHIIENQTSKPPVKAQPIDVPAISADELRDITNNYGSKALIGEGSYGRVYYGVLKSGRKAAIKKLDASKQPDNEFLAQVSMASRLKHDNFVELLGYCVDGNSRVLAYEFASNGSIHDVLHGKKGVKGAQPGPVLSWAQRVKIAVTAARGLEYLHEKADPRIFHRDIKSSNILLFDDDVAKIGDFDLSNEAPDMAARLHSTRVLGTFGYHAPEYAMTGQLNAKSDVYSFGVVLLEILTGRKPVDHTLPRGQQSLVTWATPKLSEDKVSQCIDPKLNGEYPPKSVAKMAAVAALCVQYESDFRPNMSIVVKALQPLLNTPRTGASRPTTVAPNY

SEQ ID NO: 12989 - protein, 255 aa, Allium cepa
MRRWICCQCIFDDAHNPDESQTLKSANNYVDGNHKGKGSGPTISPKDEPEKKEIIIEVPKLALEELKEKTDNFGSKALVGEGSYGRVYFAVLSNGQQVAIKKLDVSQEPEPTNNEFLNQVASVSKLKHENFVELLGYCMDGNYRLLSYEFATMGSLHDVLHGRKGVQGSQPGPALDWMQRVRIAIDAAKGLEYLHEKHQPSIIHRDVRSSNGLLFEDFRAKIADFNLSNQAPDMAARLHSTRVLGTLDIMHQSML

SEQ ID NO: 12990 - protein, 186 aa, Cirsium arvense
GGQRAKIAYGAARGLEYLHEKVQPPIVHRDIRSSNVLVFDDYETKIGDFSLSNISSENAARLHSTRVLGTFGYHAPEYAMTGQLTQKSDVYSFGVILLELLTGRKPVDHTMPKGQQSLVTWATPRLSEDKVKQCVDPQLNNDYPPKAVAKLAAVAALCVQYEADFRPNMTIVVKALQPLVNAKPGS

SEQ ID NO: 12991 - protein, 370 aa, Mimulus guttatus
MSCCGGAEDETISGPPANNYSTAPPNSAYGHGGGGGERGEPRSSAARGGAGAPQKVLPIEIPALSLDELNKATSNFGSKALIGEGSLGRVFYAKLKDGQESAIKKLDTSSTDPDTDFAAQLSTVSRLKNEHFVGLLGYCLEPNNRILVYEYATMGSLHDVLHGRKGVQGAEPGPVLTWSQRVKIAYGAAKGLEFLHEKCQPSIVHRDVRSSNVLLFDDFVAKIADFSFTNQSSDTAARLHSTRVLGTFGYHAPEYAMTGQITQKSDVYSFGVVLLELLTGRKPVDHTMPKGQQSLVTWATPRLSEDKVKQCVDTKLNNDYPPKAIAKMAAVAALCVQYEADFRPNMTIVVKALQPLLNSKPAGPADNANA

SEQ ID NO: 12992 - protein, 139 aa, Triphysaria pusilla
NQSSDTAARLHSTRVLGTFGYHAPEYAMTGQITQKSDVYSFGVVLLELLTGRKPVDHTMPKGQQSLVTWATPRLSEDKVKQCVDPKLNDDYPPKAIAKMAAVAALCVQYEADFRPNMTIVVKALQPLINSKPAGPDSNA

SEQ ID NO: 12993 - protein, 272 aa, Ananas comosus
GRSAAIKKLDSSKQPDQEFLAQVSMVSRLRHENVVELIGYCIEGNLRVLAYEFATMGSLHDILHGRKGVKGAQPGPVLSWTQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVRQCVDPRLGGEYPPKAVAKMAAVAALCVQYEADFRPNMSTVVKALQPLLNTRSGHPGEAPGS

SEQ ID NO: 12994 - protein, 330 aa, Chelidonium majus
MGCFSCCDDDDSQRTPDGGGPYMVNNMAGNLGGNHATDPTTKVPQTVKVQPIEVPVITVDELKDVTDNFGTKALIGEGSYGRVYFGELKSGQAAAIKKLDASKQPDQEFLAQVSMVSRLKHEHVVELVGYCVDGNLRVLAYEFATMGSLHDILHGRKGVKGAQPGPVLSWAQRVKIAVGAAKGLEYLHEKAQPHIIHRDIKSSNILLFDDYVAKVADFDLSNQAPDMAARLHSTRVLGTFGYHAPEYAMTGQLSSKSDVYSYGVVLLELLTGRKPVDHTLPRGQQSLVTWATPRLSEDKVRQCVDQRLGGDYPPKDSCKDGCSSCPMCSI

SEQ ID NO: 12995 - protein, 361 aa, Flaveria ramosissima
MSCFSFCGEDDMHKSYDNGPFVANNAAGHNAGYHATEAAPKDTQAVPIQPIAVPSLQVDELKEITDNFGTNSLIGEGSYGRVYHGVLRSGQAAAIKKLDSSKQPDQEFLAQVSMVSRLKHDNVVGLLGYCVDGGLRVLAYEYASNGSLHDILHGRKGVKGAQPGPVLSWSQRVKIAVGAAKGLEYLHEKAQPHIIHRDIKSSNVLLFDDDIAKIADFDLSNQAPDMAARLHSTRVLGTFGYHAPEYAMTGQLSSKSDVYSFGVVLLELLTGRKPVDHTLPRGQQSLVTWATPKLSEDKVKQCVDTRLNGEYPPKAVAKMAAVAALCVQYEADFRPNMSIVVKALQPLLNARPGHQTEPQHS

SEQ ID NO: 12996 - protein, 362 aa, Brassica napus
MSCFGCCGGDDFRRVAETGPKPVYGAGGHGGGHHPRADPPKNTPVIQMQPISVPAIPADELKDITDNYGSKSLIGEGSYGRVFYGVLRSGKAAAIKKLDSSKQPDQEFLAQVSMVSRLRQDNVVALLGYCVDGPLRVLAYEFAPNGSLHDILHGRKGVKGAQPGPVLSWNQRVKIAVGAARGLEYLHEKANPHVVHRDIKSSNVLLFDDDVAKIADFDLSNQAPDMAARLHSTRVLGTFGYHAPEYAMTGTLSTKSDVYSFGVVLLELLTGRKPVDHTLPRGQQSLVTWATPKLSEDKVKQCVDARLNGEYPPKAVAKLAAVAALCVQYEADFRPNMSIVVNQPLLNPPRSAPQTPHRNNPY

SEQ ID NO: 12997 - protein, 199 aa, Ipomoea batatas
PGPVLSWAQRVKIAVGAAKGLEYLHEKTQPHIIHRDIKSSNVLLFDDDVAKIVDFDLSNQAPDMAARLHSTRVLGTFGYHAPEYAMTGQLNSKSDVYSFGVVLLELLTGRKPVDHTLPRGQQSLVTWATPRLSEDKVKQCVDARLNGEYPPKAVAKMAAVAALCVQYEADFRPNMSIVVKALQPLLNARAGHSSDTPNL

SEQ ID NO: 12998 - protein, 182 aa, Ipomoea nil
  misc_feature (5)..(5): Xaa can be any naturally occurring amino acid
  misc_feature (10)..(10): Xaa can be any naturally occurring amino acid
  misc_feature (38)..(38): Xaa can be any naturally occurring amino acid
AKGLXYLHEXTQPHIIHRDIKSSNVLLFDDDVAKIADXDLSNQAPDMAARLHSTRVLGTFGYHAPEYAMTGQLNSKSDVYSFGVVLLELLTGRKPVDHTLPRGQQSLVTWATPRLSEDKVKQCVDARLNGEYPPKAVAKMAAVAALCVQYEADFRPNMSIVVKALQPLLNARAGHSSDTPNL

SEQ ID NO: 12999 - protein, 365 aa, Amsonia hubrichtii
MSCFGCCEEDDINRPSDGGGQAMVKNQTGNDAGFHATEAASKGAQAVKVQPISVPAIPVDELKEVTDNFGTNSLIGEGSYGRVYYGTLKNERVAAIKKLDASKQPDDEFLAQVSMVSRLKHENFVELLGYCVDGNQRVLAYEFASNGSLHDILHGRKGVKGAQPGPVLSWAQRVKIAVGAAKGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDAKLGTDYPPKAVAKMAAVAALCVQYEADFRPNMSIVVKALQPLLNTRPGNAGESGSNAMV

SEQ ID NO: 13000 - protein, 362 aa, Malus domestica
MGCFGCCEDDGMHKANDHGGQYTVKNPAGNEGSHHASGTAPRGAQPVRVQPIEVPTIPIDELKEITEGFGTSALIGEGSYGRVYYGVLKSGQHAAIKKLDASKQPDEEFLAQVSMVSRLKHDHFVQLLGYCVDGVSRVLAYEFASNGSLHDILHGRKGVKGAQPGPVLSWAQRVKIAVGAAKGLEYLHEKADPHIIHRDIKSSNVLIFDDDVAKIADFDLSNQAPDNAARLHSTRVLGTFGYHAPEYAMTGQLNAKSDVYSFGVVLLELLTGRKPVDHTLPRGQQSLVTWATPKLSEDKVRQCIDSRLGGEYPPKAVAKMAAVAALCVQYEADFRPNMSIVVKALQPLLNARHGPAGESPNL

SEQ ID NO: 13001 - protein, 135 aa, Malus domestica
AARLHSTRVLGTFGYHAPEYAMTGQLNAKSDVYSFGVVLLELLTGRKPVDHTLPRGQQSLVTWATPKLSEDKVRQCIDSRLGGEYPPKAVAKMAAVAALCVQYEADFRPNMSIVVKALQPLLNARHGPAGESPNL

SEQ ID NO: 13002 - protein, 361 aa, Brassica napus
MSCFGWCGNDDGFRNGDDTRPMPSHIPAGDSGSHYLRSDPPMNQPVVQMEPIAVPAIPADELSDVTDNYGSKALVGEGSYGRVFHGVLKSGITSAIKKLDSSKQPDQEFLSQISMVSRLRHENVIALVGYCVDGPLRVLAYEYAPNGSLHDVLHGRKGVKGALRGPVMTWHQRVKIAVGAARGLEYLHEKVNPQVIHRDIKSSNVLLFDDDVAKIGDFDLSNQAPDMAARLHSTRVLGTFGYHAPEYAMTGTLSTKSDVYSFGVVLLELLTGRKPVDHTLPRGQQSLVTWATPKLSEDKVKLCVDARLLGEYPSKAVAKLAAVAALCVQYEANFRPNMSIVVKALQPLLNPPRSTPHRNPY

SEQ ID NO: 13003 - protein, 362 aa, Ricinus communis
MSCFGCCEEDDMHKAADSGGPYPVKSSAGNVGGYHASETAPRGAQAVKIQPIEVPSISVDELKEVTDNFGINSLIGEGSYGRVYYGILKSGQAAAIKKLDASKQPDDEFLAQVSMVSRLKHENFVQLLGYCVDGNSRVLAYEFASNGSLHDILHGRKGVKGAQPGPVLSWQQRVKIAVGAAKGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDTRLQGDYPPKAVAKMAAVAALCVQYEADFRPNMSIVVKALQPLLNARPGPAGETPSL

SEQ ID NO: 13004 - protein, 182 aa, Cucurbita pepo
ARGLEYLHEKAETHIIHRDIKSSNVLIFDDDVAKIADFDLSNQAPDMAARLHSTRVLGTFGYHAPEYAMTGQLNAKSDVYSFGVVLLELLTGRKPVDPTLPRGQQSLVTWATPKLSEDKVRQCVDGRLGGDYPPKAVAKLAAVAALCVQYEADFRPNMSIVVKALQHLLNARPAPSGDSSNS

SEQ ID NO: 13005 - protein, 362 aa, Euphorbia peplus
MSCFGCCEEDDMHKAADNGGPHPYKSSAGNFGGYHASESAPKGAQAVKIQPIEVPPIAVDELKEVTDNFGTSALIGEGSYGRVYYGVLKSEQAAAIKKLDASKQPDDEFLAQVSMVSRLKHENFVQLLGYCVDGGSRVLAYEFASNGSLHDILHGRKGVKGAQPGPVLSWHQRVKIAVGAAKGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDTRLQGEFPPKAVAKMAAVAALCVQYEADFRPNMSIVVKALQPLLNARPGPGGEAPSM

SEQ ID NO: 13006 - protein, 362 aa, Linum usitatissimum
MSCFSCCEEDEIHKAADNGGQYPMKSSGGNYGGQHASEATPKGAQVIKIQPVEVPALPADELKEVTENFGTNALIGEGSYGRVYYGTLRDGQAAAIKKLDSSKQPDDEFLAQVSMVSRLKHGNFVQLLGYCVEGGSRVLAYEFASNGSLHDILHGRKGVKGAQPGPVLSWPQRVKIAVGAAKGLEYLHEKADPHIIHRDIKSSNVLIFDDYVAKIADFDLSNQAPDMAARLHSTRVLGTFGYHAPEYAMTGQLNAKSDVYSFGVVLLELLTGRKPVDHTLPRGQQSLVTWATPRLSEDKVRQCIDTRLGGEYPPKAAAKMAAVAALCVQYEADFRPNMSIVVKALQPLLNARPGPAGETLTI

SEQ ID NO: 13007 - protein, 224 aa, Fraxinus spp
MGCFGCCEDDYMQKAADNGPYMTSHSAGNPAGYHATETAQKDKQTITVLPIAVPTIPVDELRDITDNFGSKSLIGEGSYGRVYYGVLRSGHAAAIKKLDSSKQPDQEFLAQVSIVSRLKNENAVELLGYCVDGGLRVLAYEYAANGSLHDILHGRKGVKGAQPGPVLTWAQRVKIAVGAAKGLEFLHEKATPHIIHRDIKSSNVLLFDDDVAKIADFDLSNQAP

SEQ ID NO: 13008 - protein, 364 aa, Vitis vinifera
MFCCGGEEEENHGQPANQYTAPPRGGNAYGGGGTGEPRNSNTAKSGAPQKILPIETPAMSLDELNRLTSNFGSKALIGEGSYGRVFYAKLSSGEGAAIKKLDTSSSQEPDSDFAAQLSIVSRLTHENFVGLLGYCLEADNKILVYQFATMGSLHDMLHGRKGVQGAEPGPVLSWNQRVKIAYGAAKGLEYLHEKVQPSIVHRDVRSSNVLLFDDFLAKIADFNLSNQSSDTAARLHSTRVLGTFGYHAPEYAMTGQITQKSDVYSFGVVLLELLTGRKPVDHTMPKGQQSLVTWATPRLSEDKVKQCVDPKLNNDYPAKAIAKMAAVAALCVQYEADFRPNMTIVVKALQPLLNPKPAGPDSNA

SEQ ID NO: 13009 - protein, 363 aa, Pinus pinaster
MGCFGCCAEDEIQNAADGATPIMVNGNFPGNDRVYENANTALRSGQNVKLQPIAVPEITVEELREITENFSSKSLIGEGSYGPVYHGILKDGRASAIKKLDARKQPDQELLAQVSMVSRLKHENLVELVGYCVDGSMRVLAYEFAPMGSLHDILHGKKGVKGALPGPVLTWMQRVKIAIGAAKGLEYLHEKAQPPIIHRDIKSSNVLLFDDYTAKIADFDISNQSPDMSARLHSTRVLGTFGYHAPEYAMTGQSTQKSDVYSFGIVLLELLTGRKPVDHTLPRGQQSLVTWATPRLSEDKVKQCVDPRLKGDYPPKAVAKLAAVAALCVQYEADFRANMSIIVKALRPLLNTQSSPAGGNAAV

SEQ ID NO: 13010 - protein, 136 aa, Sarracenia psittacina
MAARLHSTRVLGTFGYHAPEYAMTGQLNAKSDVYSFGVVLLELLTGRKPVDHTLPRGQQSLVTWATPKLSEDKVRQCVDARLGGDYPPKAVAKMAAVAALCVQYEADFRPNMSIVVKALQPLLNTRPGPAAEVAHT

SEQ ID NO: 13011 - protein, 313 aa, Amaranthus tuberculatus
QPPAVSAITVDELKEITDNFGTKALIGEGSYGRVYYGVLRSGQAAALKKLDSSKQPDQEILGQVSMVSRLKHENVLELVGYCLDGNFRVLAYEYAPNGSLHDILHGRKGVKGAQPGPVLSWAQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDPRLGSDYPPKAVAKMAAVAALCVQYEADFRPNMSIVVKALQPLLNTRTGPHNEASNV

SEQ ID NO: 13012 - protein, 362 aa, Malus domestica
MSCFGCCEDDDMHKATDHGGQYMMKNPAGNEGSHHASGAAPRGAQPVRVQPIEVPTIPFDELKEITEGFGTSALIGEGSYGRVYYGVLKSGQHAAIKKLDASKQPDEEFLAQVSMVSRLKHDHFVQLLGYCVDGVSRVLAYEFASNGSLHDILHGRKGVKGAQPGPVLSWAQRVKIAVGAAKGLEYLHEKADPHIIHRDIKSSNVLIFDDDVAKIADFDLSNQAPDNAARLHSTRVLGTFGYHAPEYAMTGQLNAKSDVYSFGVVLLELLTGRKPVDHTLPRGQQSLVTWATPKLSEDKVRQCIDSRLGGEYPPKAVAKMAAVAALCVQYEADFRPNMSIVVKALQPLLNARHGPAGESPNL

SEQ ID NO: 13013 - protein, 114 aa, Brassica juncea
AMTGTLSTKSDVYSFGVVLLELLTGRKPVDHTLPRGQQSLVTWATPKLSEDKVKLCVDARLLGEYPSKAVAKLAAVAALCVQYEANFRPNMSIVVKALQPLLNPPRSTPHRNPY

SEQ ID NO: 13014 - protein, 361 aa, Phaseolus coccineus
MSCFSCCEEDDFQKHAESGGQHLVKNSTGNDGNGRASETAKQGIQAVKIQPIEVPELQVDELKEITDGFGESSLIGEGSYGRVYYGVLKSEQAAAIKKLDASKQPDDEFLAQVSMVSRLKHDNFVQLLGYCIDGNSRILAYEFASNGSLHDILHGRKGVKGAQPGPVLTWTQRVKIAVGAAKGLEYLHERADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPRLSEDKVRQCVDARLGGDYPPKAVAKMAAVAALCVQYEADFRPNMSIVVKALQPLLNARHGPAGETSN

SEQ ID NO: 13015 - protein, 361 aa, Brachypodium distachyon
MSCFGCCGDEDTQGAPDNRNPYPGSHPARNDAYRTADPTPRGPQPAKVQPIAVPTIPMDEIREVTKGFGDEALIGEGSFGRVYFGVLRNGRSAAVKKLDSSKQPDQELLAQVSMVSRLKHENVVELLGYCVDGSIRVLAYEFATMGSLHDMLHGRKGVKGAQPGPVLSWAQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGDYPPKAVAKFAAVAALCVQYEADFRPNMSIVVKALQPLLNARAPHAGEHAGH

SEQ ID NO: 13016 - protein, 367 aa, Theobroma cacao
MSCFSCCEEDDIHKASENGPFRPNNPASAHVGNTAGGYLVQEAVTRDTQSVTIQPIAVPKISVDELKEMTDNFGTKSLIGEGSHGRVYYGILKSGQAAAIKKLDSSKQPDQEFLAQVSMVSRLKHDNVVELVGYCVDGSLRVLAYEYAPNGSLHDMLHGKKGVKGAEPGPVLSWTQRVKIAVEAAKGLEYLHEKARPHIIHRDIKSSNLLLFDDDVAKIADFDLSNQAPDMAARLHSTRVLGTFGYHAPEYAMTGTLSSKSDVYSFGVILLELLTGRKPVDHTLPRGQQSLVTWATPKLSEDKVKQCVDARLNGEYPPKAVAKLAAVAALCVQYEADFRPNMSIVVKALQPLLNTRPAASHSETRHS

SEQ ID NO: 13017 - protein, 362 aa, Manihot esculenta
MSCFGCCEDDDMHKAADNGGPYPVKSSAGTVGSYNASEAAPRGAQAVKIQPIEVPSISVDELKEVTDNFGTNSLIGEGSYGRVYYGVLKSGQAAAIKKLDASKQPDDEFLAQVSMVSRLKHENFVQLLGYCIDGGSRVLAYEFASNGSLHDILHGRKGVKGAQPGPVLSWQQRVKIAVGAAKGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDARLQGDYPPKAVAKMAAVAALCVQYEADFRPNMSIVVKALQPLLNARPGPAGETPSM

SEQ ID NO: 13018 - protein, 362 aa, Manihot esculenta
MSCFGCCEEDDMHKAVDSGGPYPVKSSAGNVGGYHASEKAPKGAQAVKVQPIEVPSVSVDELREVTDNFGTNSLIGEGSYGRVYYGVLKSGQATAIKKLDASKQPDDEFLAQVSMASRLKHENFVQLLGYCVDGGSRILAYEFASNGSLHDILHGRKGVKGAQPGPVLSWQQRVKIAVGAAKGLEYLHEKADPHIIHRDIKSSNVLIFDDDVAKVGDFDLSNQAPDMAARLHSTRVLGTFGYHAPEYAMTGQLNAKSDVYSFGVILLELLTGRKPVDHTLPRGQQSLVTWATPRLSEDKVRQCVDARLQGDYPPKAVAKMAAVAALCVQYEADFRPNMSIVVKALQPLLNARPGPAGETPST

SEQ ID NO: 13019 - protein, 352 aa, Ricinus communis
MSFGYCEEDDMHKAADIGGPYPVKSSEDDASETADTGGQAIEIQPIEVPSISVDELKEVTDNFGTKSLIGKGSYGREYYGILKSGQAAVIKKLDTSEQPEDKFLAQVSLISQLKHENLVQLLGYCVDENARILAYELASNGSLHDILHGRKGVKGAQSDPGLSWQQRVKIAVGAAKGLEYLHEKADPRIIHHDIKSSNILIFDDDVAKISDLDLLNQALDMEERLQAIDEGTFDYEYAMTSQSNAKGDVYGFGVVLLELLTGQEPVDHTLTQEQQNLVTWATEESSEDKFRQYVDTRLQGDYPLRAVTKMAAVAGLCVQDEADFRPNMRIVVKALEHLLNFKPEAAGETPSI

SEQ ID NO: 13020 - protein, 374 aa, Centaurea maculosa
  misc_feature (354)..(354): Xaa can be any naturally occurring amino acid
MSCFNCCGEDDMHKSYDNGPFMANNAAGHNAGYRATEAAPKDTQAVAIQPIAVPALQVDELKDITDNFGTKSLIGEGSYGRVYHGVLRSGQAAAIKKLDSSKQPDQEFLAQVSMVSRLKHDNVVGLLGYCVDGGLRVLAYEYASNGSLHDILHGRKGVKGAQPGPVLSWSQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDTRLNAEYPPKAVAKMAAVAALCVQYEADFRPNMSIVVKALQPLLNARPGXKPKHRICDFPNLLKDLSIYC

SEQ ID NO: 13021 - protein, 361 aa, Castanea mollissima
MSCFSCCDDDDFHKAADTGGQYAVKSSAGNDGGYHASETAPKGAQAVKVQPIEVPALLVDELKEVTENFGTDTLIGEGSYGRVYYGILKSGQAAAIKKLDASKQPDDEFLAQVSMVSRLKHDNFVQLLGYCIDGNSRILAYEFASNGSLHDILHGRKGVKGAQPGPVLSWAQRVKIAVGAAKGLEYLHEMASPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDTRLNSEYPPKAVAKMAAVAALCVQYEADFRPNMSIVVKALQPLLHARPGPAGEAQH

SEQ ID NO: 13022 - protein, 341 aa, Cichorium intybus
MSCCGYCRRKNENESTHEGATTNNCQTAPPRAPLYGGGSMRAPRNNGAGPQKDLPIEAPSLSFDEINKMTDNFGSTSLIGEGSYSRIFYGKLEDGEEVAIKKLDITSSTEPESEFREKLSMISRLKSEYFSELRGYCLEKHNRILLYQYANKGGLHEILHGKKGGNEGSIVLTWAQRVKISYGAARGLEYLHEKAQPPIVHRDIRSSNVLVFDDFQSKISDFSLCNMSSDNTARLHSTRVLGTFGYHAPEYAMTGQITHKSDVYSFGVVLLELLTGRKPVDHTMPKGQQSLVTWATPRLSEDKVKQCVDPKLNNDYPSKAVAKMAAVAALCVQYEADFRQI

SEQ ID NO: 13023 - protein, 365 aa, Gossypium hirsutum
MSCFSCCEEDDIHKASGNGSFMANTPASNTGGYGYKAREAVTRDPRPVTIQPIAIPAITVDELKEMTDNFSMKSLIGEGSYGRVYYGILKSGKAAAIKKLDSSKQPEQEFLAQVSMVSRLKDENVVQLLGYCVDGSLRFLAYEYASNGSLHDRLHGKKGVKGAQPGPVLSWTQRVKIAYGAAKGLEYLHEKAHPHIIHRDIKSSNLLLFDDDVAKIADFDLSNQAPDATARLHSTRVLGTFGYHAPEYAMTGTLSSKSDVYSFGVILLELLTGRKPVDHTLPRGQQSLVTWATPKLSEDKVKQCVDGRLNGEYPPKALAKLAAVAALCVQYEADFRPNMSIVVKALQPLLNPTRPATTSRAYGER

SEQ ID NO: 13024 - protein, 361 aa, Vigna unguiculata
MSCFSCCEEDDFQKHAESGGQHLVKNSTGNDGNGRASETAKQGIQAVKIQPIEVPELQVDELKEITDGFGESSLIGEGSYGRVYYGVLKSGQAAAIKKLDASKQPDDEFLAQVSMVSRLKHDNFVQLLGYCIDGNSRILAYEFASNGSLHDILHGRKGVKGAQPGPVLTWTQRVKIAVGAAKGLEYLHERADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPRLSEDKVRQCVDARLGGDYPPKAVAKMAAVAALCVQYEADFRPNMSIVVKALQPLLNARHGPAGETSN

SEQ ID NO: 13025 - protein, 174 aa, Cyamopsis tetragonoloba
PPACSIRINSSGLSASNVLIFDDDVAKIADFDLSNQAPDMAARLHSTRVLGTFGYHAPEYAMTGQLNAKSDVYSFGVVLLELLTGRKPVDHTLPRGQQSLVTWATPRLSEDKVRQCVDQRLGGDYPPKAVAKMAAVAALCVQYEADFRPNMSIVVKALQPLLNARHGPAGETPN

SEQ ID NO: 13026 - protein, 361 aa, Setaria italica
MSCFGCCGDEDTQGVPDSRNQYPGHHPARNDAYRPADQPPKGPQPVKMQPIAVPTIPVDEIKEVTKGYGDEALIGEGSFGRVYFGVLRNGRSAAVKKLDSNKQPDQEFLAQVSMVSRLKHENVVELLGYCADGTLRVLAYEFATMGSLHDMLHGRKGVKGAQPGPVLSWAQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGDYPPKAVAKFAAVAALCVQYEADFRPNMSIVVKALQPLLNARAANPGENAGS

SEQ ID NO: 13027 - protein, 288 aa, Lactuca sativa
MSCFSCCGEDDMHKSYDNGPYMANNAAGNNGGYRTTEAAPKDTQAVAIQPIAVPTVQVDELKEITDNFGTKSLIGEGSYGRVYHGVLRSGQAAAIKKLDSSKQPDQEFLAQVSMVSRLKHDHVVELLGYCVDGGLRVLAYEYASNGSLHDILHGRKGVKGAQPGPVLSWSQRVKIAVGAAKGLEYLHEKAQPHIIHRDIKSSNVLLFDEDVAKIADFDLSNQAPDMAARLHSTRVLGTFGYHAPEYAMTGQLSSKSDVYSFGVVLLELLTGRKPVDHTLPRGQQSLVT

SEQ ID NO: 13028 - protein, 361 aa, Pennisetum glaucum
MSCFGCCGDEDTQGVPDSRNQYPGHHPARNDAYRPTDQPPKGPQPVKMQPIAVPTIPVDEIREVTKGFGDEALIGEGSFGRVYLGVLRNGRSAAVKKLDSNKQPDQEFLAQVSMVSRLKHENVVELLGYCADGTLRVLAYEFATMGSLHDILHGRKGVKGAQPGPVLSWAQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGDYPPKAVAKFAAVAALCVQYEADFRPNMSIVVKALQPLLNARATNPGENAGS

SEQ ID NO: 13029 - protein, 356 aa, Momordica charantia
GCCEEDAIQKAADDSRMYPVKSSLGTDESYHKWQAAPKSPPIVKMRPIEVPAISFQELKEVTKNFDADSLIGEGSYGRVYYGVFTNGQSVAIKKLDSSKQPDDEFLSQVSMVSRLKHNNFLNLIGYCVDGNSRILAYEYASSGSLHDILHGRKGVKGAQPGPVLSWAQRVKIAAGAAKGLEYLHEKADPHIIHRDIKLSNVLIFDDDVAKIADFDLSNQAPDMAARLHSTRVLGTFGYHAPEYAMTGQLNAKSDVYSFGVVLLELLTGRKPVDHTLPRGQQSLVTWATPKLCEDKVRQCVDAKLGDEYPPKAVAKFAAVAALCVQYEADFRPNMSIVVKALQPLLNARPGPGGEAP

SEQ ID NO: 13030 - protein, 360 aa, Tropaeolum majus
MSCFSCCREDDFHRTSDNGSYMANNPASNLGGYQEREAAPRDAQAIVIQPIAVPAITVEELKDVTDNFGTKALIGEGSYGRVYYGVLRSGQAAAIKKLDSSRQPDQEFLAQVSMVSRLMHENVVGLVGYSVDGPFRVLAYEYASHGSLHDILHGRKGVKGSEPGPVLLWAQRVKIAVGAARGLEYLHEKAEPHIIHRDIKSSNVLLFDDYVAKIADFDLSNQAPDAAARLHSTRVLGTFGYHAPEYAMTGTLSSKSDVYSFGVVLLELLTGRKPVDHTLPRGQQSLVTWATPKLSEDKVKQCVDARLNGEYPPKAVAKMAAVAALCVQYEADFRPNMSIVVKALQPLLNTRPAPQTGIPH

SEQ ID NO: 13031 - protein, 361 aa, Tropaeolum majus
MSCFGCCDESDMHKAADNESQYIVKNARENDGGYHASENAPKGAQTVKVQPIEVPTIEADELKEVTDNFGTNSLIGEGSYGRVYYGVLKNEQAAAIKKLDASKQPDEEFLAQVSMVSRLKHENFVQLLGYCVDGSSRVLAYEFASNGSLHDILHGRKGVKGAQPGPVLSWQQRVKISVGAAKGLEYLHEKANPHIIHRDIKSSNVLIFDDDVGKIADFDLSNQAPDMAARLHSTRVLGTFGYHAPEYAMTGQLNAKSDVYSFGVVLLELLTGRKPVDHTLPRGQQSLVTWATPKLSEDKVRQCIDARLGGEYPPKAVAKMAAVAALCVQYEADFRPNMSIVVKALQPLLNARPGPTSETAN

SEQ ID NO: 13032 - protein, 361 aa, Quercus alba
MSCFGCCDDDDFHKAADTGGQYAVKSSAGNDGGYHASETAPKGAQAVKVQPIEVPAILVDELKEVTENFGTNALIGEGSYGRVYYGILKSGQAAAIKKLDASKQPDDEFLAQVSMVSRLKHDNFVQLLGYCIDGNSRILAYEFASNGSLHDILHGRKGVKGAQPGPVLSWAQRVKIAVGAAKGLEYLHEMASPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDTRLNSEYPPKAVAKMAAVAALCVQYEADFRPNMSIVVKALQPLLHARPGPAGEAHN

SEQ ID NO: 13033 - protein, 361 aa, Orobanche aegyptiaca
MSCFSCCEEYDTNKNADGGGQYLVKNSSRNDGGYHNTEAALKDPAFKVQPIAVPSIPVDELNEVTSNFSAETLIGEGSYGRVYYGTLTNGRAAAIKKLDASKQPDDEFLAQVSMVSRLKHENFVELLGYCVDGNQRVLAYEFASNGSLHDILHGRKGVKGAQPGPVLSFPQRVKIAVGAAKGLEYLHEKAEPHIIHRDIKSSNVLIFNDDVAKIGDFDLSNQAPDMAARLHSTRVLGTFGYHAPEYAMTGQLNSKSDVYSFGVVLLELLTGRKPVDHTLPRGQQSLVTWATPKLSEDKVRQCIDSRLGSEYPPKAVAKMAAVAALCVQYEADFRPNMSIVVKALQPLLNTRPGPSAESGLT

SEQ ID NO: 13034 - protein, 327 aa, Ananas comosus
ASYASHPAPRAPQPVRMQPIEVPSISVEEIKEIAKNFSNDALIGEGSYARVYYGVLRNGRKSAVKKLDASKQPDQEFLTQVSMVSRLTHENVIELLGYCVDGNLRVLAYEYATMGSLHDILHGRKGVKGAQPGPVLSWAQRVKIAVGAARGLEYLHEKAQPQVIHRDIKSSNILLFEDYVAKIGDFDLSNQSPDMAARLHSTRVLGTFGYHSPEYTMTGQLSTKSDVYSFGVVLLELLTGRKPVDHTLPRGQQSLVTWAAPRLSEDKVRQCVDPRLGSEYPPKAVAKLAAVAALCIQYEADFRPNMSIVVKALQPLLNVRSGPSAEA

SEQ ID NO: 13035 - protein, 361 aa, Oryza sativa
MSCFACCGDEDTQGVPDNRNPYPGNHPARSDAYRTADPTPRGPQPVKVQPIAVPIIPVDEIREVTKNFGDEALIGEGSFGRVYFGVLRNGRSAAVKKLDSSKQPDQEFLAQVSMVSRLKHEHVVELLGYCVDGNLRVLAYEFATMGSLHDMLHGRKGVKGAQPGPVLSWAQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGDYPPKAVAKFAAVAALCVQYEADFRPNMSIVVKALQPLLNARATNPGENAGS

SEQ ID NO: 13036 - protein, 153 aa, Solanum phureja
GTKASVPAKAEVQKAIPTIEVPALSLDELKEETDNFGSKALIGEGSYGRVYYANLNNGKPVAVKKLDVSSEPETNVDFLSQVSMVSRLKHENLVELLGYCVEGNLRVLAYEFATMGSLHDILHGRKGVQGAQPGPTLDWMQRVKIVVDAARGL

SEQ ID NO: 13037 - protein, 361 aa, Glycine max
MSCFSCCEEDDYQKASESGGQHVVKNSTGNHGNGRASETAKQGTQAVKIQPIEVPELPVDELKEITDGFGESSLIGEGSYGRVYYGVLKSRQAAAIKKLDASKQPDDEFLAQVSMVSRLKHDNFVQLLGYCIDGNSRVLAYEFASNGSLHDILHGRKGVKGAQPGPVLTWTQRVKIAVGAAKGLEYLHERADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPRLSEDKVRQCVDARLGGEYLPKAVAKMAAVAALCVQYEADFRPNMSIVVKALQPLLNARHGPAGETPN

SEQ ID NO: 13038 - protein, 362 aa, Fragaria vesca
MSCFSCCDEDDMHKATDNGGPYMMKNPAGNEGSLHASGNAPRGGQAVKVQPIEVPLIPVEELKEITDNFGTNALIGEGSYGRVYYGVLKSGEHAAIKKLDASKQPDEEYLAQVSMVSRLKHDNFVQLLGYCVDGNSRVLAYEFASNGSLHDILHGRKGVKGAQPGPVLTWAQRVKIAVGAARGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDARLGGEFPAKAVAKMAAVAALCVQYEADFRPNMSIVVKALQPLLNARPGPTGESPSL

SEQ ID NO: 13039 - protein, 361 aa, Panicum virgatum
MSCFGCCGDEDAQGVPDSRNPYPGHHPARTDAYRPADQPPKGPQPVKMQPIAVPAIPVDEIREVTKGFGDEALIGEGSFGRVYFGVLRNGRSAAVKKLDSNKQPDQEFLAQVSMVSRLKHENVVELLGYCADGTLRVLAYEFATMGSLHDMLHGRKGVKGAQPGPVLSWAQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGDYPPKAVAKFAAVAALCVQYEADFRPNMSIVVKALQPLLNARATNPGENARS

SEQ ID NO: 13040 - protein, 136 aa, Panicum virgatum
MTARLHSTRVLGTFGYHAPEYAMTGQLSSKSDVYSFGVVLLELLTGRKPVDHTLPRGQQSLVTWATPRLSEDKVRQCVDSRLGGDYPPKAVAKFAAVAALCVQYEADFRPNMSIVVKALQPLLNARATNPGENARS

SEQ ID NO: 13041 - protein, 381 aa, Sorghum bicolor
MGCFSCCCVADDDDIGRRKKHDDAYVPIPAQVDNFGPSRPPAPIPVIPTGRDQPIAVPPIHLEELKEITKNFSSDALIGEGSYARVYFGVLKDGTKSAVKKLDSSKQPDQEFLVQVSAVSRLKHENVVQLVGYCAEGITRVLAYEYATRGSLHDILHGKKGVKGAQPGPVLSWMQRARIAVSAARGLEFLHEKADSRVVHRDIKSSNILLFDNDVAKIGDFDISNQSPDMAARLHSTRVLGTFGYHAPEYAMTGQLSTKSDVYSFGVVLLELLTGRKPVDHTLPRGQQSLVTWATPRLSEDKVKQCVDPRLGDEYPPKAVAKMAAVAALCVQYEGEFRPNMSIVVKALSPLLHSRPGNRPAASPASPAAAAAAAAAERSGL

SEQ ID NO: 13042 - protein, 107 aa, Nicotiana tabacum
MTGQLSSKSDVYSFGVVLLELLTGRKPVDHTLPRGQQSLVTWATPRLSEDKVKQCVDARLNTEYPPKAVAKMAAVAALCVQYEADFRPNMSIAVKALQPLLPRPVPS

SEQ ID NO: 13043 - protein, 109 aa, Primula obconica
MSCFGCCGDDNQHMAADHGNYLPNNSAGNNYGARNASDAAQKPTKIVDMKPIAVPSIPVDELKDLTDNFGVKALIGEGSYGRVYYGLLQGGRAAAIKKLDSSKQPDQDF

SEQ ID NO: 13044 - protein, 365 aa, Brachypodium distachyon
MGCFSCCGADAVGKRKKHDDPLVPAPAPGVNYGYSRGPAPTPAIRTGKTRPIEVPAIPLDEMKEITKNFSNDALIGEGSYARVFFGVQKDGQKSAVKKLDSSKQPDQEFLSQVSAVSRLKHDNVVQLMGYCAVGSTRLLAYEYATRGSLHDILHGKKGVKGAQPGPVLSWMQRARIAVNAARGLEFLHEKAEPRVVHRDIKSSNILLFDNDVAKIGDFDVSNQAPDMAARLHSTRVLGTFGYHAPEYAMTGQLSAKSDVYSFGVVLLELLTGRKPVDHTLPRGQQSLVTWATPRLSEDKVRQCVDPRLGSDYPPKAVAKMAAVAALCVQYEAEFRPNMSIVVKALAPLLHTRSRPAASASASTAI

SEQ ID NO: 13045 - protein, 360 aa, Vitis vinifera
MSCFSCCEEDDIHKASDTGPYVANNSAVGHNGNYHMTEASRSNDTQTVDVLPIAVSAISVDELKEITDNFGQQALIGEGSYGRVYHGLLKTGQAAAIKKLDSSKQPDQEFLAQVSMVSRLKNENVVELVGYSVDGGLRVVAYEYASNGSLHDILHGRKGVKGAQPGPVLSWSQRVKIAVGAAKGLEYLHEKARPHIIHRDIKSSNVLLFDDDVAKIADFDLSNQAPDSAARLHSTRVLGTFGYHAPEYAMTGQLSSKSDVYSFGVVLLELLTGRKPVDHTLPRGQQSLVTWATPKLSEDKVKQCVDTRLGGEYPPKAVAKMAAVAALCVQYEADFRPNMSIVVKALQPLLNARPGHTPTL

SEQ ID NO: 13046 - protein, 360 aa, Vitis vinifera
MSCFSCCEEDDIHKASDTGPYVANNSAVGHNGNYHMTEASRSNDTQTVDVQPIAVSAISVDELKEITDNFGQQALIGEGSYGRVYHGLLKTGQAAAIKKLDSSKQPDQEFLAQVSMVSRLKNENVVELVGYSVDGGLRVVAYQYASNGSLHDILHGRKGVKGAQPGPVLSWSQRVKIAVGAAKGLEYLHEKARPHIIHRDIKSSNVLLFDDDVAKIADFDLSNQAPDSAARLHSTRVLGTFGYHAPEYAMTGQLSSKSDVYSFGVVLLELLTGRKPVDHTLPRGQQSLVTWATPKLSEDKVKQCVDTRLGGEYPPKAVAKMAAVAALCVQYEADFRPNMSIVVKALQPLLNARPGHTPTL

SEQ ID NO: 13047 - protein, 367 aa, Triticum aestivum
MWRRCICCQAAEFDENENGRAKAKAPTNNVDGMKKGLKDSATVKAEPQDSAPSINIPVLSLDELIEKTDDFGAKALIGEGSYGRVYYAVLDNGTKMAVKKLDATENEPISEFSTQVSLVSRLKHENFVDILGYCMERNLRIVAYEFATMGSLHDVLHGRKGVQGAQPGPPLNWMQRMKIAVDAAKGLEYLHEKVQPSIVHRDVRSSNILLFEDFKAKIADFNLSNQAPDMAARLHSTRVLGTFGYHAPEYAMTGQLTQKSDVYSFGVVLLELLTGRKPVDHTAPRGQQSLVTWATPRLTEDKVKGCIDPRLEGEYPPKGLAKLGAVAALCVQYEAEFRPSMSIVVKALSPLTLSRQTPPAPAAALDS

SEQ ID NO: 13048 - protein, 125 aa, Primula obconica
SSIFGYHAPEYAMTGHLTQKSDVYSFGVVLLELLTGRKPVDHNMPRGQQSLVTWATPRLSEDKVKQCVDPKLKEYPQKGVAKLAAVAALCVQYEAEFRPNMSIVVKALQPLLKPPGPPPGPVSEL

SEQ ID NO: 13049 - protein, 358 aa, Eutrema halophilum
MSCFGCCREDDLLGANDYGGQNMTKQSGGNDGRRNTSEIAQKTVKVQPIEVAAILADELIEATNGFGSESLIGEGSYARVYHGFLKNDQPAAIKKLDSNKQPDDEFLAQVSMVSRLKHDNFVELLGYSVDGNSRILVFEFAQNGSLHDILHGRKGVKGAKPGPLLSWHQRVKVAVGAARGLEYLHEKANPHIIHRDIKSSNVLIFDDDVAKIADFDLSNQAPDMAARLHSTRVLGTFGYHAPEYAMTGQLSAKSDVYSFGVVLLELLTGRKPVDHTLPRGQQSLVTWATPKLSEDKVKQCVDSRLGGDYPPKAVAKLAAVAALCVQYEADFRPNMSIVVKALQPLLNARTGPAGGGAP

SEQ ID NO: 13050 - protein, 212 aa, Castanea mollissima
IIHGRKGVKGAQPGPVLSWAQRVKIAVGAAKGLEYLHEKAQPHIVHRDIKSSNILLFDDDVAKIADFDLSNEAPDNAARLHSTRVLGTFGYHAPEYAMTGQLSSKSDVYSFGVVLLELLTGRKPVDHTLPRGQQSLVTWATPKLSEDKVKQCVDARLNAEYPPKAVAKMAAVAALCVQYEADFRPNMSIVVKALQPLLNPRSGPPSETPQRL

SEQ ID NO: 13051 - protein, 136 aa, Actinidia deliciosa
MAARLHSTRVLGTFGYHAPEYAMTGQLTSKSDVYSFGVVLLELLTGRKPVDHTLPRGQQSLVTWATPQLSEDKVKQCIDARLGGEYPPKAVAKMAAVAALCVQYEADFRPNMSIVVKALQPLLNARSGPPSVTPNM

SEQ ID NO: 13052 - protein, 360 aa, Glycine max
MGCFGFCKGDDSVTVADRGPFMQSTPTGNPSYHGRHTAVTAPRTINFQPIAVPSITVDELKSLTDNFGSKYFIGEGAYGKVYQATLKNGHAVVIKKLDSSNQPEQEFLSQVSIVSRLKHENVVELVNYCVDGPFRALAYEYAPKGSLHDILHGRKGVKGAQPGPVLSWAQRVKIAVGAARGLEYLHEKAEIHIIHRYIKSSNILLFDDDVAKVADFDLSNQAPDAAARLHSTRVLGTFGYHAPEYAMTGQLTSKSDVYSFGVILLELLTGRKPVDHTLPRGQQSLVTWATPKLSEDKVKQCVDVRLKGEYPSKSVAKMAAVAALCVQYEAEFRPNMSIIVKALQPLLNTRSVHSKEAPKM

SEQ ID NO: 13053 - protein, 58 aa, Cichorium intybus
MSCLSYCGEDDMHKSYDNEAFMTNNAAGNNAGYHATEAAPKDTQAVAIQPITVCSSSG

SEQ ID NO: 13054 - protein, 129 aa, Utricularia gibba
TRVLGTFGYHAPEYAMTGQLTQKSDVYSFGVVLLELLTGRKPVDHTMPRGQQSLVTWAPPRLIEDKVKQCVDPKLKGEYPPKGVAKLAAVAALCVQYEAEFRPNMSIVVKALQPLLKSAAAAAPSVPEA

SEQ ID NO: 13055 - protein, 363 aa, Brassica napus
MSCFGCCGDDDFHRVNETGPKTAYNTAGYDGHHQRVEPFKSPPAIQMQPISVPAIPADELKDITDNYGSKSLIGEGSYGRVFYGVLKNGKAAAIKKLDSSKQPDQEFLSQVSMVSRLRQDNVVALLGYCVDGPLRVLAYEYAPKGSLHDILHGKKGVKGAQPGPVLSWHQRVKIAVGAAKGLEYLHEKANPHVVHRDIKSSSVLMFEDDVAKIADFDLSNQAPDMAARLHSTRVLGTFGYHAPEYAMTGTLSTKSDVYSFGVVLLELLTGRKPVDHTLPRGQQSLVTWATPKLSENNVNQCVDARLKGEYPLKAAAKMAAVAALCVQYEAEFRPNMSIVVKALQPLLNPPRSAPQTPQRNIPY

SEQ ID NO: 13056 - protein, 98 aa, Thalictrum flavum
MSCFSCCQEDDIHRANDNAGPFVVNSAAGKQGGYHAADPATKAAQVVKVQPIAVPPISVEELKEVTDNFGTKSLIGEGSYGRVYYGLLKSGRAAAIKS

SEQ ID NO: 13057 - protein, 361 aa, Vinca minor
MSCFGCCQEDDMQKTSDNGQFPAHNFAGNNAGYRSQEPVQKDAQTIKVQPIAVPAIPVDELKDITDNFGTKAFIGEGSYGRVYLGVLRSGQAAAIKKLDSSKQPDQEFLAQVSMVSRLKHEHFVELLGYSVDGGIRVLAYEYASNGSLHDILHGRKGVKGAQPGPVLTWVQRVKIAVGAAKGLEYLHEKAQPHIIHRDIKSSNVLLFDEDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDARLQDQYPPKAVAKMAAVAALCVQYESDFRPNMSIVVKALQPLLNARTGPSSTEASH

SEQ ID NO: 13058 - protein, 361 aa, Gossypium hirsutum
MSCFGCCEEDDIHRAADNGGQYVVKHAAGNDGGYQTSETASKSAQTVKVQPIEVPVIPAEELKEITDNYGTNSLIGEGSYGRVYYGVLKSGQHAAIKKLDASKQPDDEFLSQVSMVSRLKHENFVQLLGYCVDGSSRILAYEFASNGSLHDILHGRKGVKGAQPGPVLTWAQRVKIAVGAARGLEYLHEKADPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPRLSEDKVRQCVDQRLGGDYPSKAVAKMAAVAALCVQYEADFRPNMSIVVKALQPLLNARPGPVETPST

SEQ ID NO: 13059 - protein, 371 aa, Gossypium hirsutum
MFCCGGSDNEPKGPPANQYTAPSKGGDQNGGTGGTGRGEPNARNGVKPGGASQKVLPIEIPSVPLDELNKMTDNFGKKALIGEGSYGRVFYGTFNGQPAAIKKLDTGSSPEPDSEFGAQLSVVSRLKHENFVELLGYCMEENNKILIYEHATMGSLHDVLHGRKGVQGAEPGPVLSWNQRVRIAVGAAKGLKYLHEKVQPSIVHRDVRSSNVLLFDDFVTKIADFNLTNQSSDSSARLHSTRVLGTFGYHAPEYAMTGQITQKSDVYSFGVVLLELLTGRKPVDHTMPKGQQSLVTWATPRLSEDKVKQCVDPKLNNDYPPKAIAKLAAVAALCVQYEADFRPNMTIVVKALQPLLNAKPEAKPAGTDPQP

SEQ ID NO: 13060 - protein, 153 aa, Panicum virgatum
DFNLSNQAPDMAARLHSTRVLGTFGYHAPEYAMTGQLTQKSDVYSFGVVLLELLTGRKPVDHTMPRGQQSLVTWATPRLTEDKVKQCVDPRLMGEYPAKGLAKLAAVAALCVQYEAEFRPNMSIVVKALSVLLVSKQTQTPAPPVHLPLTVDA

SEQ ID NO: 13061 - protein, 259 aa, Panicum virgatum
AVSRLKHENVLQLVGFCTEGNIRVLAYEYATRGSLHDILHGKKGVKGAQPGPPLSWMQRVRIAVSAARGLEFLHEKAEPRVVHRDIKSSNILLFDNDVAKIGDFDVSNQSPDMAARLHSTRVLGTFGYHAPEYAMTGQLSTKSDVYSFGVVLLELLTGRKPVDHTLPRGQQSLVTWATPRLSEDKVRQCVDPRLDGEYPPKAVAKMAAVAALCVQYEGDFRPNMSIVVKALSPLLHSRSGNRPSVSSASASTVAERSGL

SEQ ID NO: 13062 - protein, 109 aa, Olea europaea
MTGQLSSKSDVYSFGVVLLELLTGRRPVDHTLPRGQQSLVTWATPKLSEDKVKQCVDARLNGEYPPKAVAKMAAVAALCVQYEADFRPNMSIVVKALQPLLNTRSGPPN

SEQ ID NO: 13063 - protein, 115 aa, Amorphophallus konjac
LPPASYREGISLRENNHGGCFSCCEEDNFHRASDSGGHFTTNHAAGNDGGYRATDPAPKGAQAVKVQPIAVPPIPVDELKEVTDNFGIKALIGEGSYGRVYYGVLKNGKAAAIKN

SEQ ID NO: 13064 - protein, 249 aa, Arnica chamissonis
LLAQVSMVSRLKHDNVVALQGYCIDGGLRVLAYEYASNGSLHDILHGRKGVKGAQPGPVLSWPERVKIAVGAAKGLEYLHEKARPHIIHRDIKSSNVLLFDDDIAKIADFDLSNQAPDMAARLHSTRVLGTFGYHAPEYAMTGQLSSKSDVYSFGVVLLELLTSRKPVDHTLPRGQQSLVTWATPKLSEDKVKQCVDTRLNGEYPPKAVAKMAAVAALCVQYEADFRPNMSIVVKALQPLLNARPGAQT

SEQ ID NO: 13065 - protein, 115 aa, Catharanthus roseus
MISTDLLTVVAMLWYKNQTGNDAGFHATEAASKGVPAVKLQPISVPAIPVDELKEVTDNFGTNSLIGEGSYGRVYYGTLKSGRAAAIKKLDASKQPDDEFLAQVSMVSRLNMKIS

SEQ ID NO: 13066 - protein, 360 aa, Euonymus alatus
MGCFSCCVDDEIHKAYDTGPFVPNGSTSNNTGYHVKEVAAKDVQTVFQPIAVPAISIDELKEITENFGTSTLIGEGSYGRVYYGVLSSGQAVAIKKLDSSKQPEPEFLAQVSMASRLKHENAVTLVGYCVDGPHRVIAYEYAPNGSLHNILHGRKGVKGSKPGPVLSWAQRVKIAVGAARGLEYLHEKAQPHIIHRDIKSSNVLLFDDDVAKIGDFDLSNEAPDNAARLHSTRVLGTFGYHAPEYAMTGHLTSKSDVYSFGVVLLELLTGRKPVDHTLPRGQQSLVTWATPKLSEDKVKQCVDARLNDEYPPKAMAKMAAVAALCVQYEADFRPNMSIVVKALQPLLNTRSGPASETPHP

SEQ ID NO: 13067 - protein, 352 aa, Flaveria ramosissima
MSCFSCCGEDDMHKSFDNGPYMPNNAAGPNAGYRATEAAPKDTQAVAVQPIAVPALQVDELKEITDNFGTKCLIGEGSYGRVYHGVLRSGQAAAIKKLDSSKQPDQEFLAQVSMVSRLKNDNVVGLLGYCIDGGLRVLAYEYASNGSLHDILHGRKGVKGAQPGPVLSWSQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDTRLNGEYPPKAVAKMAAVAALCVQYEADFRPNMSIVVKALQPLIERSC

SEQ ID NO: 13068 - protein, 361 aa, Avena sativa
MSCFGCCGDEDTQRAPDNRNQYPGSHPARNDAYRTADPTPKGPQPVKVQPIAVPTIPMDEIREVTKGFGDEALIGEGSFGRVYFGVLRNGRSAAVKKLDSSKQPDQELLAQVSMVSRLKHENVVELLGYCLDGTTRVLAYEFATMGSLHDMLHGRKGVKGAQPGPVLSWVQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGDFPPKAVAKFAAVAALCVQYEADFRPNMSIVVKALQPLLNARAAHPGEHAGR

SEQ ID NO: 13069 - protein, 361 aa, Phalaenopsis aphrodite
MSCFSCCGGSDNHKTTDNGAAFPAKQSSGNDGGFRASDATLKGAQSVKVQPIEVPAIPVEQIKALTDNFGSNSLVGEGSYGRVYYGLLENEKAAALKKLDASKQPDQEFLAQVSMVSRLNHENVIQLLGYCIDGSLRVLAYEFATNGSLHDILHGRKGVKGAQPGPVLSWAQRVKIAVGAARGLEYLHEKSQPPVIHRDIKSSNVLLFDEDVAKIGDFDLSNQSPDTAARLHSTRVLGTFGYHAPEYAMTGQLSSKSDVYSFGVVLLELLTGRKPVDHTLPRGQQSLVTWATPRLSEDKVSQCVDTRLGGDYPPKAVAKFAAVAALCVQYEADFRPNMSIVVKALQPLLNSRVSGSVADAP

SEQ ID NO: 13070 - protein, 361 aa, Plantago ovata
MSCFGCCGQDDFSKQADGGGQYAVKNAAGNDGGHHTTEAATKAQAVKVQPISVPPITVDELKEVTGTFSTNSLIGEGSYGRVYYGVLNSGKTAAIKKLDSSKQPDDEFLAQVSMVSRLKHENFVELLGYCVDGNQRVLAYEFASNGSLHDILHGRKGVKGAQPGPVLSWSQRVKIAVGAAKGLEYLHEKAEPHIVHRDIKSSNVLIFDEDVAKIADFDLSNQAPDMAARLHSTRVLGTFGYHAPEYAMTGQLNSKSDVYSFGVVLLELLTGRKPVDHTLPRGQQSLVTWATPKLSEDKVRQCIDGRLGGDYPPKAVAKMAAVAALCVQYEADFRPNMTIVVKALQPLLNTRPGPAGESGHI

SEQ ID NO: 13071 - protein, 182 aa, Scabiosa columbaria
VKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDTRLNSEYPPKAVAKMAAVAALCVQYEADFRPNMSIVVKALQPLLNTRSGP

SEQ ID NO: 13072 - protein, 362 aa, Tabernaemontana elegans
MSCFSCCCEEDDLQKTADNGQFAAHNFAGNNAGYHATEPVQKDPQAIKVQPIAVPPIPVDELKDITDNFGTKALIGEGSYGRVYYGVLKSGQAAAIKKLDSSKQPDQEFLAQVSMVSRLKHEHVVELLGYSVDAGLRVLAYEYASNGSLHDILHGRKGVKGAQPGPVLSWAQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPKLSEDKVKQCVDARLQDQYPPKAVAKMAAVAALCVQYEADFRPNMSIVVKALQPLLNARTGPSAEASHL

SEQ ID NO: 13073 - protein, 365 aa, Tabernaemontana elegans
MSCFSCCEEDDINRPSDGGGQPMVKNQTGSDAGFHTTEAASKGSQAVKVQPISVPEIPVDELKEVTDNFGTNALIGEGSYGRVYYGTLKSGRVAAIKKLDASKQPDDEFLAQVSMVSRLKHENFVELLGYCIDGNQRVLAYEFASNGSLHDILHGRKGVKGAQPGPVLSWAQRVKIAVGAAKGLDYLHEKAEPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDAKLGTDYPPKAVAKMAAVAALCVQYEADFRPNMSIVVKALQPLLNTRPGAAGETVSNAMV

SEQ ID NO: 13074 - protein, 361 aa, Trigonella foenum-graecum
MGCFGFCKENDAYTTADKGIYMQTNPTGNSSYHGRHTAVTVPRPINLQPISVPSITVDELRSLTDNFGSKTFVGEGAYGKVYRATLKNGREVAIKKLDSSKQPDQEFLSQVSIVSRLKHENVVELVNYCVDGPLRALAYEYAPNGSLHDILHGRKGVKGAEPGQVLSWAERVKIAVGAARGLEYLHEKAEVHIVHRYIKSSNILLFEDGVAKIADFDLSNQAPDAAARLHSTRVLGTFGYHAPEYAMTGNLSSKSDVYSFGVILLELLTGRKPVDHTLPRGQQSLVTWATPKLSEDKVKQCVDVRLKGEYPSKSVAKLAAVAALCVQYEAEFRPNMSIIVKALQPLMNNTRSSQTREPRNL

SEQ ID NO: 13075 - protein, 338 aa, Arabidopsis thaliana
MFFFLVITYVANQKNQKPQDLAKPKEILPIIVPSLSVDEVNEQTDNFGPNSLIGEGSYGRVYYATLNDGKAVALKKLDLAPEDETNTEFLSQVSMVSRLKHENLIQLVGYCVDENLRVLAYEFATMGSLHDILHGRKGVQDALPGPTLDWITRVKIAVEAARGLEYLHEKVQPQVIHRDIRSSNILLFDDYQAKIADFNLSNQSPDNAARLQSTRVLGSFGYYSPEYAMTGELTHKSDVYGFGVVLLELLTGRKPVDHTMPRGQQSLVTWATPKLSEDTVEECVDPKLKGEYSPKSVAKLAAVAALCVQYESNCRPKMSTVVKALQQLLIATGSIPQF

SEQ ID NO: 13076 - protein, 360 aa, Brachypodium distachyon
MSCFACCGGDDTQGAPDNRGSYASGYPARNDAYRTADPTPKGAQPVKVQPIAVPTISVEEIREATKDFGDETLIGEGSFGRVYFGALKNGRSAAVKKLDSSKQPDQEFLAQVSMVSRLKHENVVELLGYCVDGNTRILVYEFATMGSLHDMLHGRKGVKGAQPGPVLSWTQRVKIAVGAAKGLEYLHEKAQPHIIHRDIKSSNVLLFDDDVAKIADFDLSNQAPDMAARLHSTRVLGTFGYHAPEYAMTGQLSTKSDVYSFGVVLLELLTGRKPVDHTLPRGQQSLVTWATPRLSEDKVRQCVDSRLGSEYPPKAVAKFAAVAALCVQYEADFRPNMSIVVKALQPLLNARSSNPGEHRS

SEQ ID NO: 13077 - protein, 189 aa, Catharanthus roseus
VDPKNSARGYLHEKAEPHIIHRDIKSSNVLIFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDVKLGTDYPPKAVAKMAAVAALCVQYEADFRPNMSIVVKALQPLLNTRPGNAGETGSNAMA

SEQ ID NO: 13078 - protein, 265 aa, Cenchrus ciliaris
  misc_feature (71)..(71): Xaa can be any naturally occurring amino acid
KLDSNKQPDQEFLAQVSMVSRLKHENVVELLGYCADGTLRVLAYEFATMGSLHDMLHGRKGVKGAQPGPVXTWAQRVKIAVGAAKGLEYLHEKAQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVRQCVDSRLGGDYPPKAVAKFAAVAALCVQYEADFRPNMSIVVKALQPLLNARTTNPGENAGS

SEQ ID NO: 13079 - protein, 362 aa, Actinidia deliciosa
  misc_feature (59)..(59): Xaa can be any naturally occurring amino acid
MSCFSCCEDDDINRPNDGGGAYMVKNSAGNNGGYHATEAASKAAQTVKILPIAVPDISXDELKEVTDNFGPDSLIGEGSYGRVYYGVLKNERAAAIKKLDSSKQPDDDFKAQVSMVSRLKHSNFVELIGYCLDGNQRVLAYEFASNGSLHDILHGRKGIKGAQPGPVLSWAQRVKIAVGAAKGLEYLHEKAEPHIIHRDIKSSNVLLFDDDVAKIADFDLSNQAPDMAARLHSTRVLGTFGYHAPEYAMTGQLNAKSDVYSFGVVLLELLTGRKPVDHTLPRGQQSLVTWATPKLSEDKVRQCVDARLGADYPPKAVAKMAAVAALCVQYEADFRPNMSIVVKALQPLLNTRAGPAGETGHT

SEQ ID NO: 13080 - protein, 128 aa, Liriodendron tulipifera
AQPHIIHRDIKSSNVLLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVKQCVDTRLGGEYPPKAVA

SEQ ID NO: 13081 - protein, 362 aa, Medicago truncatula
MGCFGFCKENDAYTTADKGIFMQTNPNGGNTSYHGRHTAVTVPRHINLQPISVPSITVDELRSLTDNFGTKTFVGEGAYGKVYRATLKNGREVAIKKLDSSKQPDQEFLSQVSIVSRLKHENVVELVNYCVDGPLRALAYEYAPNGSLHDILHGRKGVKGAEPGQVLSWAERVKIAVGAARGLEYLHEKAEVHIVHRYIKSSNILLFEDGVAKIADFDLSNQAPDAAARLHSTRVLGTFGYHAPEYAMTGNLSSKSDVYSFGVILLELLTGRKPVDHTLPRGQQSLVTWATPKLSEDKVKQCVDVRLKGEYPSKSVAKLAAVAALCVQYEAEFRPNMSIIVKALQPLMNNTRSSQPREPRNL

SEQ ID NO: 13082 - protein, 206 aa, Avena sativa
MSCFGCCGDEDTQRAPDNRNQYPGSHPARNDAYRTADPTPKGPQPVKVQPIAVPTIPMDEIREVTKGFGDEALIGEGSFGRVYFGVLRNGRSAAVKKLDSSKQPDQELLAQVSMVSRLKHENVVELLGYCLDGTTRVLAYEFATMGSLHDMLHGRKGVKGAQPGPVLSWVQRVKIAVGAAKGLEYLHEKAQPHIIHRDIKSSNVSF

SEQ ID NO: 13083 - protein, 363 aa, Prunus persica
MSCFGCCEDDDMHKATDHGGPYMVKNPAGSEGSHHASGTAPRGAQAVKVQPIEVPTIPIDELKEITDGFGTSALIGEGSYGRVYYGVLKSGQHAAIKKLDASKQPDDEFLAQVSMVSRLKHDNFVQLLGYCVDGSSRVLAYEFASNGSLHDILHGRKGVKGAQPGPVLSWAQRVKIAVGAAKGLEYLHEKADPHIIHRDIKSSNVLIFDDDVAKIADFDLSNQAPDNAARLHSTRVLGTFGYHAPEYAMTGQLNAKSDVYSFGVVLLELLTGRKPVDHTLPRGQQSLVTWATPKLSEDKVRQCIDSRLGGEYPPKAVAKMAAVAALCVQYEADFRPNMSIVVKALQPLLNARQHGPTGEVPNL

SEQ ID NO: 13084 - protein, 115 aa, Senecio madagascariensis
AMTGQLSSKSDVYSFGVVLLELLTGRKPVDHTLPRGQQSLVTWATPKLSEDKVKQCVDTRLNGEYPPKAVAKMAAVAALCVQYEADFRPNMSIVVKALQPLLNARPGPQTEAPHL

SEQ ID NO: 13085 - protein, 361 aa, Valeriana officinalis
MSCFGCCIEDDIHKASDSGPFMANSGAGNHGGYRDTEAVPKDTQTVNMQPISVPEIQVDELKEITDNFGTKALIGEGSYGRVYHGVLKSGQAAAIKKLDTSKQPDQEFLSQVSMASRLKHENFVELLGYCMDGGLRALAYEFASNGSLHDILHGRKGVKGAQPGPVLSWLQRVKIAVGAAKGLEYLHEKAQPHIIHRDIKSSNVLLFDEDVAKIADFDLSNQAPDIAARLHSTRVLGTFGYHAPEYAMTGQLSSKSDVYSFGVVLLELLTGRKPVDHTLPRGQQSLVTWATPKLSEDKVKQCIDTRLNNEYPPKAVAKMAAVAALCVQYEADFRPNMSIVVKALQPLLNTRTGPSTEAPNP

SEQ ID NO: 13086 - protein, 248 aa, Aquilegia formosa
MNCFSCCPEDDIHRANDNVGPFVVNNAAGKQGGYHATDPATKAAQIVKVQPIAVPPISVEELKEVTDNFGTKSLIGEGSYGRVYYGVLKSGRAAAIKKLDASKQSDQEFTAQVSMVSRLKHENVVELVGYCIDGNLRVLAYEFATMGSLHDILHGRKGVKGAQPGPVLSWAQRVKIAVGAAKGLEYLHEKAQPHVIHRDIKSSNVLIFDDDVSKLQTLIYQTKLLTMQHVFILHVCSELSVIMLQSMQ

SEQ ID NO: 13087 - protein, 369 aa, Hordeum vulgare
MWRRCICCQAAEFDENENGRANPKAKAPTNNVDGMKKGLKDSATVKAEPQDSAPSINIPVLSLDELIEKTDDFGAKALIGEGSYGRVYYAVLDNGTKMAVKKLDSTENEPISEFSTQVSLVSRLKHENFVDILGYCMERNLRIVAYEFATMGSLHDVLHGRKGVQGAQPGPPLNWMQRMKIAVDAAKGLEYLHEKVQPSIVHRDVRSSNILLFEDFKAKIADFNLSNQAPDMAARLHSTRVLGTFGYHAPEYAMTGQLTQKSDVYSFGVVLLELLTGRKPVDHTAPRGQQSLVTWATPRLTEDKVTACIDPRLEGEYPPKGVAKLGAVAALCVQYEAEFRPSMSIVVKALSPLTLSRQTPPAPPTALDS

SEQ ID NO: 13088 - protein, 255 aa, Avena sativa
LTQVSLVSRLKHDNFVDILGYCMERNLRIVAYEFATMGSLHDVLHGRKGVQGAQPGPALDWMQRMKIAVDAAKGLEYLHEKVQPSIVHRDIRSSNILLFEDFKAKIADFNLSNQAPDMAARLHSTRVLGTFGYHAPEYAMTGQLTQKSDVYSLGVVLLELLTGRKPVDHTMPRGQQSLVTWATPRLTAEKVKQCIDPRLNGEYPPKGVAKLAAVAALCVQYEAEFRPSMSIVVKALSPLTLNRQTPPSLPPALDS

SEQ ID NO: 13089 - protein, 363 aa, Pinus taeda
MGCFGCCAEDEIQNAADGATPIMVNGNFQGNDGVYENANTALRSGQNVKLQPIAVPEITVEELREITENFSSKSLIGEGSYGPVYHGILKDGRASAIKKLDARKQPDQELLAQVSMVSRLKHENLVELVGYCVDGSMRVLAYEFAPMGSLHDILHGKKGVKGALPGPVLTWMQRVKIAIGAAKGLEYLHEKAQPPIIHRDIKSSNVLLFDDYTAKIADFDISNQSPDMSARLHSTRVLGTFGYHAPEYAMTGQSTQKSDVYSFGIVLLELLTGRKPVDHTLPRGQQSLVTWATPRLSEDKVKQCVDPRLKGDYPPKAVAKLAAVAALCVQYEADFRANMSIIVKALRPLLNTQSSPAGGRPAV

SEQ ID NO: 13090 - protein, 114 aa, Panicum virgatum
  misc_feature (35)..(35): Xaa can be any naturally occurring amino acid
KSDVYSFGVVLLELLTGRKPVDHTMPRGQQSLVTXATPRLTEDTVKQCVDPRLKGEYPPKGVAKLAAVAALCVQYESEFRPSMSIVVKALSPLLQHKPQPPPAAALDAKAPSRA

SEQ ID NO: 13091 - protein, 299 aa, Glycine max
MMVQKEDLGLSLSLNFPHHNTPNPQHPSLMSSSTHSSSPSGCNPQKPSWNEAFTSSDRNSDTCRGETRSFLRGIDVNRLPSAVDTEEETGVSSPNSTVSSVSGKRSEREEPNGEEHDMDRACSRGISDEEDAETARKKLRLSKDQSAILEESFKEHNTLNPKQKLALAKQLGLRPRQVEVWFQNRRARTKLKQTEVDCEVLKRCCENLTEENRRLQKEVQELRALKLSPQFYMQMTPPTTLTMCPSCERVAVPSSAVDAATRHHPMAQAQAQAQIRHRPIGPWASASPITHRPFDVFHH

SEQ ID NO: 13092 - protein, 294 aa, Vigna unguiculata
MMVQKEDLGLSLSLNFRHNIPNPQHLTLISSSTHSSSPSPSPSNPFKPSWNDAFDRNSDTCRGETRSFLRGIDVNRLPSGVDMEEEAGVSSPNSTVSSVSGKRSEREPNGEEHDMNRACSRGISDEEDGETSRKKLRLSKDQSAILEESFKEHNTLNPKQKLALAKQLGLLPRQVEVWFQNRRARTKLKQTEVDCEVLKRCCENLTEENRRLQKEVQELRALKLSPQFYMQMTPPTTLTMCPSCERVAVPSSAVDAAARHHPMGQAHAHSRPMGMGPWGSAASIPHRGFDGFHH

SEQ ID NO: 13093 - protein, 298 aa, Trifolium pratense
MMVEKEDLGLSLSLNFPQNPPPNPQYLNLMSSSTHSSSPSTYNLQKPSSNDAFTSNSDRDSETCRGEERSLLLRGIDVNRLPSGADCEEEAGVSSPNSTVSSVSGKRSEREVTGEDLDMERDCSRGISDEEDAETSRKKLRLTKDQSIILEESFKEHNTLNPKQKLALAKQLGLRARQVEVWFQNRRARTKLKQTEVDCEFLKRCCENLTDENRRLQKEVQELRALKLSPQFYMQMTPPTTLTMCPSCERVAVPTSAVDASTRRHPMAPTHPRAFPMGPWATAAPIQHRPFDPIRPRS

SEQ ID NO: 13094 - protein, 296 aa, Medicago truncatula
MSIEKEDFGLSLSLSFPQNPPNPQYLNLMSSSTHSYSPSTFNPQKPSWNDVFTSSDRDSETCRIEERPLILRGIDVNRLPSGADCEEEAGVSSPNSTVSSVSGKRSEREVTGEDLDMERDCSRGISDEEDAETSRKKLRLTKDQSIILEESFKEHNTLNPKQKLALAKQLGLRARQVEVWFQNRRARTKLKQTEVDCEFLKRCCENLTDENRRLQKEVQELRALKLSPQFYMQMTPPTTLTMCPSCERVAVPSSAVDAATRRHPMASNHPRTFSVGPWATAAPIQHRTFDTLRPRS

SEQ ID NO: 13095 - protein, 119 aa, Raphanus sativus
MMLEFAPIFIYLVISLLVSLILLGVPFLFASNSSTYPEKLSAYECGFDPFGDARSRFDIRFYLVSILFLIFDLEVTFFFPWAVSLNKIDLFGFWSMMAFLFILTIGFLYEWKRGALDWE

SEQ ID NO: 13096 - protein, 118 aa, Flaveria ramosissima
MLEFAPICIYLVISLLVSLILLGVPFLFASNSSTYPEKLSAYECGFDPFGDARSRFDIRFYLVSILFIIFDLEVTFFFPWAVSLNKIDLFGFWSMMAFLLILTIGFLYEWKRGALDWE

SEQ ID NO: 13097 - protein, 118 aa, Carthamus tinctorius
MLEFAPIFIYLVISLLVSLILLGVPFLFASNSSTYPEKLSAYECGFDPFGDARSRFDIRFYLVSILFIIFDLEVTFFFPWAVSLNKIDLFGFWSMMAFLLILTIGFLYEWKRGALDWE

SEQ ID NO: 13098 - protein, 123 aa, Ambrosia trifida
MPTLNQLIRHGREEKRRTDRTRALDQCPQKQGVCLRVSTRTPKKPNSALRKIAKVRLSNRHDIFAYIPGEGHNLQEHSIVLIRGGRVKDLPGVKFHCIRGVKDLLGIPDRRKGRSKYGAEKPK

SEQ ID NO: 13099 - protein, 125 aa, Cirsium arvense
MPTLNQLIRHGREEKRRTDRTRALDQCPQKQGVCLRVSTRTPKKPNSALRKIAKVRLSNRHDIFAYIPGEGQNLQEHSIVLIRGGRVKDLPGVKFHCIRGVKDLLGIPDRRKGRSKYGAEKPKSI

SEQ ID NO: 13100 - protein, 126 aa, Artemisia annua
MPTLNQLIRHGREEKRRTDRTRALDQCPQKQGVCLRVSTRTPKKPNSALRKIAKVRLSNRHDIFAYIPGEGHNLQEHSIVLIRGGRVKDLPGVKFHCIRGVKDLLGIPDRRKGRSKYGAEDMNGRC

SEQ ID NO: 13101 - protein, 125 aa, Unknown
  Sequence found in Organisms: Pennisetum glaucum, Setaria italica
MPTKNQLIRHGREEKRRTDRTRALDQCPQKQGVCLRVSTRTPKKPNSALRKIAKVRLSNRHDIFAYIPGEGHNLQEHSIVLVRGGRVKDLPGVKFHCIRGVKDLLGIPDRRKGRSKYGAERPKSK

SEQ ID NO: 13102 - protein, 123 aa, Guizotia abyssinica
MPTLNQLIRHGREEKRRTDRTRALDQCPQKQGVCLRVSTRTPKKPNSALRKIAKVRLSNRHDIFAYIPGEGHNLQEHSIVLIRGGRVKDLPGVKFIVFEESRICWEFGSKKRRSNMVQKTKSR

SEQ ID NO: 13103 - protein, 109 aa, Tragopogon dubius
MPTLNQLIRHGREEKRRTDRTRALDQCPQKQGVCLRVSTRTPKKPNSALRKIAKVRLSNRHDIFAYIPGEGHNLQEHSIVLIRGGRVKDLPGVKFHCIRGVKDLLGIPD

SEQ ID NO: 13104 - protein, 123 aa, Gossypium hirsutum
MPTLNQLIRHGREEKRRTDRTRALDQCPQKQGVCLRVLTRTPKKPNSALRKIAKVRLSNRHDIFAYIPGEGHNLQEHSMVLIRGGRVKDLPGVKFHCIRGVKDLLGIPDRRRGRSKYGAEKPK

SEQ ID NO: 13105 - protein, 125 aa, Helianthus annuus
MPTLNQLIRHGREEKRRTDRTRALDQCPQKQGVCLRVSTRTPKKPNSALRKIAKVRLSNRHDIFAYIPGEGHNLQEHSIVLIRGGRVKDLPGVKFHCIRGVKDLLGIPDRRKGRSKYGAEKPKSR

SEQ ID NO: 13106 - protein, 118 aa, Eucalyptus grandis
MLEFAPICIYLVISLLLSLILLGVPFLFASNSSTYPEKLSAYECGFDPFGDARSRFDIRFYLVSILFIIFDLEVTFFFPWAVSLNKIDLFGFWSMMAFLLILTIGFLYEWKRGALDWE

SEQ ID NO: 13107 - protein, 118 aa, Papaver somniferum
MSEFAPICIYLVISPLVSLISLGLPFLFASNSSTYPEKLSAYECGSDPSGDARSRFDIRFYLVSILFIIPDLEVTFFFPWAVSPNKIDPFGSWSMMAFLLILTIGSLYEWKRGASDRE

SEQ ID NO: 13108 - protein, 118 aa, Lippia dulcis
MSEFEPILIYLVISLLVSLILLGLPFLFSSNSSTYPEKLSAYECGFDPFGDARSRFDIRFYLVSILFIIFDLEVTFFFPWAVSLNKIDLFGFWSMMAFLLILTIGFLYEWKRGALDWE

SEQ ID NO: 13109 - protein, 118 aa, Silene vulgaris
MLEFAPICIYLVISLLVSLILLGVPFLFSSNTSTYPEKLSAYECGFDPFGDARSRFDIRFYLVSILFIIFDLEVTFFFPWAVSLNKIDLFGFWSMMAFLLILTIGFLYEWKRGALDWE

SEQ ID NO: 13110 - protein, 118 aa, Acacia harpophylla
MLEFAPICIYLVISLLVSLILLGLPFLFSSNSSTYPEKLSAYECGFDPFGDARSRFDIRFYLVSILFIIFDLEVTFFFPWAVSLNKIDLFGFWSMMAFLLILTIGFLYEWKRGALDWE

SEQ ID NO: 13111 - protein, 125 aa, Amorphophallus konjac
MPTLNQLIRHGREEKRRTDRTRALDQCPQKQGVCLRVSTRRPKKPNSALRKIAKVRLSNRHDIFAYIPGEGHNLQEHSLVLIRGGRVKDLPGVKFHCIRGVKDLLGIPDRRRGRSKYGAERPKSI

SEQ ID NO: 13112 - protein, 125 aa, Cirsium arvense
MPTLNQLIRHGREEKRRTDRTRALDQCPQKQGVCLRVSTRTPKKPNSALRKIAKVRLSNRHDIFAYIPGEGHNSQEHSIVLIRGGRVKDLPGVKFHCIRGVKDLLGIPDRRKGRSKYGAEKPKSL

SEQ ID NO: 13113 - protein, 125 aa, Beta vulgaris
MPTINQLIRHGREEKRRTDRTRALDQCPQKQGVCLRVSTRTPKKPNSALRKIAKVRLSNRHDIFAYIPGEGHNLQEHSMVLIRGGRVKDLPGVKFHCIRGVKDLLGIPDRRRGRSKYGAEKPKSI

SEQ ID NO: 13114 - protein, 125 aa, Allium cepa
MPTFNQLIRHGREEKRRTDRTRALDQCPQKQGVCLRVLTITPKKPNSALRKIAKVRLTNRHDIFAYIPGEGHNSQEHSIVLVRGGRVKDLPGVKFHCIRGVKDLLGIPDRRRGRSKYGAEKPKSK

SEQ ID NO: 13115 - protein, 99 aa, Amsonia hubrichtii
MSPEARSMPACFNENTEKPNSALRKIAKVRLSNRHDIFAYIPGEGHNLQEHSTVLIRGGRVKDLPGVKFHCIRGVKDLLGIPDRRRGRSKYGAEKPKSL

SEQ ID NO: 13116 - protein, 118 aa, Pinus pinaster
MLEFAPICIYLVISLLVSLILLGVPFLFASNGSTYPEKLSAYECGFDPFGDARSRFDIRFYLVSILFIIFDLEVTFFFPWAVSLNKIDLFGFWSMMVFLLILTIGFLYEWKKGALDWE

SEQ ID NO: 13117 - protein, 118 aa, Triphysaria pusilla
MSEFSPIFIYLVISLLVSLILLGLPILFSSNSSTYPEKLSAYECGFDPFGDARSRFDIRFYLVSILFIIFDLEVTFFFPWAVSLNKIDLFGFWSMMAFLLILTIGFLYEWKRGALDWE

SEQ ID NO: 13118 - protein, 118 aa, Linum usitatissimum
MLEFSPICIYLVISLLFSLILLGLPFLFASNSSTYPEKLSAYECGFDPFGDARSRFDIRFYLVSILFIIFDLEVTFFFPWAVSLNKIDLFGFWSMMAFLLILTIGFLYEWRRGALDWE

SEQ ID NO: 13119 - protein, 123 aa, Euonymus alatus
MPTLNQLIRHGREEKRRTDRTRALDQCPQKQGVCLRVSTRTPKKPNSALRKIAKVRLSNRHDIFAYIPGEGHNLQEHSMVLIRGGRVKDLPGVKFHCIRGVKDLLGIPDRRRGRSKYGAEKPK

SEQ ID NO: 13120 - protein, 146 aa, Quercus alba
MPTLNQLIRHGREEKRRTDRTRALDQCPQKQGVCLRVSTRTPKKPNSALRKIAKVRLSNRHDIFAHIPGEGHNLQEHSMVLIRGGRVKDLPGVKSHCIRGVKDLLGIPDRRRGRSKYGAEKPNRYEWKMPLVTCFSRSVEGTTTTL

SEQ ID NO: 13121 - protein, 125 aa, Citrus sinensis
MPTLNQLIRHGREEKRRTDRTRALDQCPQKQGVCLRVSTRTPKKPNSALRKIAKVRLSNRHDIFAYIPGEGHNLQEHSMVLIRGGRVKDLPGVKFHCIRGVKDLLGIPDRRRGRSKYGAEKPKSI

SEQ ID NO: 13122 - protein, 118 aa, Arachis hypogaea
MPTLNQLIRHGREEKRRTDRTRASDQCPQKQGVRPRVSTRTPKKPNSALRKIAKVRLSNRYDIFAYIPGEGHNLQEHSMVLIRGGRVKDLPGVKFHCIRGVKDLLGISDRRRGRSKYG

SEQ ID NO: 13123 - protein, 118 aa, Phalaenopsis aphrodite
MLEFAPIFIYLVISLLVSLILLGLPFLFASNSSTYPEKLSAYECGFDPFGDARSRFDIRFYLVSIFFIIFDPEVTFFSPWAVSLNKIDPFGFWSMMAFFLILTIGFLYEWKRGALDWE

SEQ ID NO: 13124 - protein, 113 aa, Populus trichocarpa
PICIYLVISLLVSLILLGLPFLFASPSSTYPEKLSAYECGFDPFGDARSRFDIRFYLVSILFIIFDLEVTFFFPWAVSLNKIDLFGFWSMMAFLLILTIGFLYEWKRGALDWE

SEQ ID NO: 13125 - protein, 125 aa, Fagopyrum esculentum
MPTLNQLIRHGREEKRRTDRTRALDQCPQKQGVCLRVSTRTPKKPNSALRKIAKVRLSNRHEIFAYIPGEGHNLQEHSMVLIRGGRVKDLPGVKFHCIRGVKDLLGIPDRRRGRSKYGAEKPKSI

SEQ ID NO: 13126 - protein, 114 aa, Distylium racemosum
APICIYLVISLLVSSILLGVPFLFASNGSTYPEKLSAYECGFDPFGDARSRFDIRFYLVSILFIIFDLEVTFFFPWAVSLNKIDLFGFWSMMVFLLILTLGFLYEWKKGALDWE

SEQ ID NO: 13127 - protein, 189 aa, Eutrema halophilum
MSSVCGTLDFKDANFGISTSSPTQCSNGSKHSSFAGSEDSQESDGDETGYINQTANEESAETDFGKSTLPPSSSDDDDKDENFTTTPVVLIPAIKGSREKHGLSLRKSSVSWAEDVYDPPPSIASHTRSKKQQHKPKSKDNHRKTGKKGQKSKDNSSSRSGKDKKQASRKHSREKFDWVTQMPIVAASS

SEQ ID NO: 13128 - protein, 259 aa, Arabidopsis lyrata
MLLKTVSSSSSSALSLVNFHGVKKDVSPLLSSISWNLRVSSGKSGNLSFSVRASKSSTTDALSGVVFEPFKEVKKELDLVPTSSHLSLARQKYSDECEAAINEQINVEYNVSYVYHAMYAYFDRDNVALKGLAKFFKESSVEEREHAEKLMEYQNKRGGRVRLQSIVMPLSEFEHVDKGDALYGMELALSLEKLVNEKLLNLHSVASKNNDVHLADFIESEFLNEQVEAIKMISEYVAQLRRVGKGHGTWHFNQMLLEG

SEQ ID NO: 13129 - protein, 257 aa, Raphanus sativus
MLLKTVSSSSSSALSLVSFHGGIKDVSPLLSSVSSPIDSSSKGKLSVSVRASKISTADALSGVVFQPFEEVKKELDLVPTSSDLSLARQKYSDECEAAINEQINVEYNLSYVYHAMYAYFDRDNVALKGLAKFFKESSVEEREHAEKLMEYQNKRGGKVKLQSIVVPLSEFEHVDKGDALYGMELALSLEKLVNEKLLNLHSVASKNGDVHLADFIESEFLTEQVEAIKKISEYVAQLRRVGKGHGTWHFNQMLLEQ

SEQ ID NO: 13130 - protein, 142 aa, Raphanus sativus
MYAYFDRDNVALKGLAKFFKESSVEEREHAEKLMEYQNKRGGKVKLQSIVVPLSEFEHVDKGDALYGMELALSLEKLVNEKLLNLHSVASKNGDVHLADFIESEFLTEQVEAIKKISEYVAQLRRVGKGHGTWHFNQMLLEQ

SEQ ID NO: 13131 - protein, 256 aa, Brassica napus
MLLKTVSSSSAALSLVSLHGGVKDVSPLLSSTNLRVSSGKSENLSVSVRATKDSTTDELSGVVFQPFEEVKKELDLVPTSAHVSLARQKYSDECESAINEQINVEYNLSYVYHAMYAYLDRDNVALKGLAKFFKESSVEEREHAEKLMEYQNKRGGKVKLQFIVAPLSEFEHVDKGDALYGMELALSLEKLVNEKLLNLHNVASKNGDVHLADFIESEFLTEQVEAIKKISEYVAQLRRVGKGHGTWHFNQMLLEQ

SEQ ID NO: 13132 - protein, 260 aa, Eutrema halophilum
MLLKAASCSSAFSLGMKDVSPLLSSVSSPIDSSSSLRVSSSGKSGNLSFSVRASSKGSTTDALIGVVFQPFEEVKKELELVPTSSHVSLARQKYSDECEAAINEQINVEYNLSYVYHAMYAYFDRDNVALKGLAKFFKESSVEEREHAEKLMEYQNKRGGRVKLQSIVMPLSEFEHVDKGDALYGMELALSLEKLVNEKLLNLHSVASKNGDVHLADFIESEFLTEQVEAIKKISEYVAQLRRVGKGHGTWHFNQMLLEA

SEQ ID NO: 13133 - protein, 253 aa, Eutrema parvulum
MLLKTVSSSAFSLVNFHGGIKDISPLLSSVSSPVDSSSSLRVSPGKSGNLSFSVRASKGSTTDALSGVVFEPFEEVKKELDLVPTSSHLSLARHKYSDDCEAAINEQINVEYNLSYVYHAMYAYFDRDNIALKGLAKFFKESSVEEREHAEKLMEYQNKRGGRVKLQSIVVPLSEFEHVDKGDALYGMELALSLEKLVNEKLLNLHSVASKNGDVHLADFIESEFLTEQVEAIKKISEYVAQLRRLGKGHGTR

SEQ ID NO: 13134 - protein, 383 aa, Brassica napus
MAMRRITGAIRASCVSSSSSGYFARQFHASSGDSKKIVGVFYKANEYASKNPNFLGCVENALGIRNWLESQGHHYIVTDDKEGPNCELEKHIPDLHVLISTPFHPAYVTAERIKKAKNLQLLLTAGIGSDHIDLQAAAAAGLTVAEVTGSNVVSVAEDELMRILILMRNFVPGYNQVVNGEWNVAGIAYRAYDLEGKTVGTVGAGRIGKLLLQRLKPFGCNLLYHDRLQMGPEMEKETGAKYVESLDEMLPKCDVVVVNTPLTEKTRGMFNKEMIGKMKKGVLIVNNARGAIMDRQAVVEAVESGHIGGYSGDVWDPQPAPKDHPWRYMPNQAMTPHISGTTIDAQLRYAAGTKDMLEKYFKGEDFPAQNYIVKDGELAPQYR

SEQ ID NO: 13135 - protein, 384 aa, Unknown
  Sequence found in Organisms: Brassica napus, Brassica rapa
MAMRRVTRAAIRASCVSSSSSGYFARKFNASSGDSKKIVGVFYKANEYASKNPNFLGCVENALGIRNWLESQGHHYIVTDDKEGPNCELEKHIPDLHVLISTPFHPAYVTAERIKKAKNLQLLLTAGIGSDHIDLQAAAAAGLTVAEVTGSNVVSVAEDELMRILILMRNFVPGYNQVVNGEWNVAGIAYRAYDLEGKTVGTVGAGRIGKLLLQRLKPFGCNLLYHDRLQMGPEMEKETGAKYVESLDEMLPKCDVVVVNTPLTEKTRGMFNKEMIGKMKKGVLIVNNARGAIMDRQAVVEAVESGHIGGYSGDVWDPQPAPKDHPWRYMPNQAMTPHISGTTIDAQLRYAAGTKDMLEKYFKGEDFPAQNYIVKDGELAPQYR

SEQ ID NO: 13136 - protein, 383 aa, Eutrema parvulum
MAMRRATGAAIRACVSSSSSGYFARQFHASSGDSKKVVGVFYKANEYASKNPNFLGCVENALGIRDWLESQGHHYIVTDDKEGPDCELEKHIPDLHVLISTPFHPAYVTAERIKKAKNLQLLLTAGIGSDHIDLQAAAAAGLTVAEVTGSNVVSVAEDELMRILILMRNFVPGYNQVINGEWNVAGIAYRAYDLEGKTIGTVGAGRIGKLLLQRLKPFGCNLLYHDRLQMEPELEKEIGAKYMENLNEMLPKCDVVVVNTPLTEKTRGMFNREMIGKMKKGVLIVNNARGAIMDRQAVVDAVESGHIGGYSGDVWDPQPAPKDHPWRYMPNQAMTPHISGTTIDAQLRYAAGTKDMLERYFKGEDFPAQNYIVKDGELAPQYR

SEQ ID NO: 13137 - protein, 383 aa, Eutrema halophilum
MALRRATRAAIRACVSSSSSGYFARQLHASSGDSKKIVGVFYKANEYASKNPNFLGCVENALGIRNWLESQGHQYIVTDDKEGPDCELEKHIPDLHVLISTPFHPAYVTAERIKKAKNLQLLLTAGIGSDHIDLQAAAAAGLTVAEVTGSNVVSVAEDELMRILILMRNFLPGYNQVINGEWNVAGIAYRAYDLEGKTVGTVGAGRIGRLLLQRLKPFGCNLLYHDRLQMEPELEKEIGAKYVENLNEMLPKCDVVVVNTPLTEKTRGMFNREMIGKMKSGVLIVNNARGAIMDRQAVVEAVESGHIGGYSGDVWDPQPAPKDHPWRYMPNQAMTPHISGTTIDAQLRYAAGTKDMLERYFKGEDFPAQNYIVKDGELAPQYR

SEQ ID NO: 13138 - protein, 384 aa, Arabidopsis lyrata
MAMRQATKAAIRACVSSSSSGYFARRQFNASSGDSKKIVGVFYKANEYATKNPNFLGCVENALGIRDWLESQGHQYIVTDDKEGPDCELEKHIPDLHVLISTPFHPAYVTAERIKKAKNLKLLLTAGIGSDHIDLQAAAAAGLTVAEVTGSNVVSVAEDELMRILILMRNFVPGYNQVVKGEWNVAGIAYRAYDLEGKTIGTVGAGRIGKLLLQRLKPFGCNLLYHDRLQMAPELEKEIGAKFVEDLNEMLPKCDVVVINMPLTEKTRGMFNKELIGKLKKGVLIVNNARGAIMDRQAVVEAVESGHIGGYSGDVWDPQPAPKDHPWRYMPNQAMTPHTSGTTIDAQLRYAAGTKDMLERYFKGEDFPAQNYIVKDGELAPQYR

SEQ ID NO: 13139 - protein, 383 aa, Brassica napus
MAMRRFTGAAIRACSSSSSSGYFARHLHASSGESKKIVGVFYKANEYASKNPNFLGCVENSLGIRNWLESQGHQYIVTNDKEGPDCELEKHIPDLHVLISTPFHPAYVTAERIKKAKNLQLLLTAGIGSDHIDLQAAAAAELTVAEVTGSNVVSVAEDELMRILILMRNFVPGYNQVVNGEWNVAGIAYRAYDLEGKTIGTVGAGRIGKLLLQRLKPFGCNLLYHDRLQMEPELEKEIGANYVENLNEMLPKCDVVVLNMPLTEKTRGMFNKEMIGKMKKGVLIVNNARGAIMDRQAVVEAMESGQIGGYSGDVWDPQPAPKDHPWRYMPNQAMTPHISGTTMDAQIRYAAGTKDMLEKYFKGEDFLAQNYIVKDGVIAPQYM

SEQ ID NO: 13140 - protein, 383 aa, Eutrema parvulum
MAMQLATKRAIRTCISSFSSGHFTRHVHANSGETKKIVGVFYKANEYASKNPNFLGCVENALGIREWLESQGHQYTVTDDKEGPNCELEKHIPDLHVLISTPFHPAYMNAERIKKAKNLKLLLTAGIGSDHVDLHAAAAAGLTVAEVTGSNVVSVAEDELMRILILMRNFVTGYNQVVNGEWNVAGIAYRAYDLQGKTIGTVGAGRIGKLLLQRLKPFGCNLLYHDRLQMEPELEKEIGAKHMENLNEMITKCDVVVINMPLTEKTRGMFNKEMIGKMKRGVLIVNNARAAITERQAVVEAMESGHIGGYSGDVWDPQPADKDHPWRYMPNQAMTPHISGTTIDAQLRYAAGTKDMLEKYFKGEDFPIENYIVKDGELAPQYK

SEQ ID NO: 13141 - protein, 378 aa, Eutrema halophilum
MAMQRATGAMVRACASSFSSGYLARHFHASSGDTKKIVGVFYKANKYASKNPNFLGCVENALGIRDWLESQGHQYIVTDDKEGPNCELEKHIPDLHVLISTPFNPAYVTAERIKKAKNLQLLLRAGIGSDHIDLKAAAAAGLTVAEVTGSNVVSVAEDELMRILILMRNFVPGHQQIINGEWNVAGIAHRAYDLEGKTVGTVGAGRIGRLLLQRLKPFGHDRLQMEQELEEEIGAKHMENLNEMVTKCDVIVINTPLTEKTRGMFNKEMIGRMKKGVLIVNNARAAIMERQAVVEAAESGHIGGYSGDVWDPQPAPKDHPWRYMPNQAMTPHISGTTIDAQLRYAAGTKDMLDRFFKGEDFPAQNYIVKDGEIAPQYV

SEQ ID NO: 13142 - protein, 384 aa, Mesembryanthemum crystallinum
MAMKRATASAIRAMVASSTNSSTILSRNLHASSDSKKIVGVFYKANEYAAMNPNFVGCVEGALGIREWLESQGHQYIVTDDKDGPDSELEKHIPDLHVLISTPFHPAYVTAERIKRAKNLQLLLTAGIGSDHIDLQAAAAAGLTVAEVTGSNVVSVAEDELMRILILVRNFVPGYHQVINGEWNVAGIAYRAYDLEGKTIGTVGAGRIGKLLLQRLKPFNCNLLYHDRIKMDPELENQTGAKYEEDLEKMLPKCDVVVMNMPLTEKTKGMFNKEMIAKMKKGVLIVNNARGALMDTQAVVDACSSGHIAGYSGDVWYPQPAPKDHPWRYMPNQAMTPHISGTTIDAQLRYAAGVKDMLDRYFKGEAFPPQHYIVNEGELAPQYR

SEQ ID NO: 13143 - protein, 73 aa, Fraxinus spp
MAMKRVTTSAIRALTSSILTRELHATPGSKKIVGVFYKANEYASMTQIFWDASRMHWVYVIVGITRSPVHSYS

SEQ ID NO: 13144 - protein, 382 aa, Phalaenopsis aphrodite
MWRAASKQVIRTVGSSLSDLSPLRKQLHASPGKKKIVGVFYKGNEYAAKNPNFLGTVERALGIREWLESQGHQYIVTDDKDGPNSELEKHIPDLHVLITTPFHPAYVTAERIKKAKNLQLLLTAGIGSDHIDLKAAADAKLTVAEVTGSNVVSVAEDELMRILILVRNFVPGYQQVINGDWNVAAISYRAYDLEGKTVGTVGAGRIGKLLLQRLKPFNCNLLYHDRLKIDPELEKEIGAKFEEDLDVMLPKCDVVVINTPLTEKTKGLFDKERISKLKKGVLIVNNARGAIMDTQAVVDACNSGHIAGYSGDVWNPQPAPKDHPWRYMPNQAMTPHVSGTTIDGQLRYAAGVKDMLDKYFKGEDFPQQNYIVKEGKLASQYL

SEQ ID NO: 13145 - protein, 444 aa, Brassica napus
MGADAIQTNGGDPAKLTVVEGIKRLRCAVKNYEWGKLGHDSLVARLHEANSGNRVDPAVPHAELWMGTHESGPSHVVKEEELGSGHGGSECMVTLKSWVSDNPDVLGSRAVDKWGCDLPFLFKLLSVTKALSIQAHPNRALAEKLHREEPLLYRDANHKPEIALAITPFQALCGFVSLKELKEVIANVPEITELVGSKAADQIFTVNEKDGDESIKSVVRLIFTQLMSASNNETKRVISEMKMRLITETNHRELSEKEKLILELEKQYPGDVGVISAFFFNYVKLNPGEALYLDADEPHAYISGDCVECMAASDNVVRAGLTPKHRDVQTLCSMLTYKLGYPEILKGFPLTPYITRYLPPFDEFEVDHCDLPTGKSTIFPAIPGPSVYLVIEGTGKLQTGSSQLLVNRGDVLFVPAHNEIQVTGESDVIKLYRAGVSSRFFQTL

SEQ ID NO: 13146 - protein, 442 aa, Brassica napus
ADAIQTNGGDPAKLTVVEGIKRLRCAVKNYEWGKLGHDSLVARLHEANSGNRVDPAVPHAELWMGTHESGPSHVVKEEELGSGHGGSECMVTLKSWVSDNPDVLGSRAVDKWGCDLPFLFKLLSVTKALSIQAHPNRALAEKLHREEPLLYRDANHKPEIALAITPFQALCGFVSLKELKEVIANVPEITELVGSKAADQIFTVNEKDGEESVKSVVRLIFTQLMSATNNETKRVISEMKMRLITETNHRELSEKEKLVLELEKQYPGDVGVISAFFFNYVKLNPGEALYLDADEPHAYISGDCVECMAASDNVVRAGLTPKHRDVQTLCSMLTYKLGYPEILKGFPLTPYITRYLPPFDEFEVDHCDLPTGKSTIFPAIPGPSVYLVIEGTGKLQTGSSQLLVNRGDVLFVPAHNEIQVTGESDVIKLYRAGVSSRFFQTL

SEQ ID NO: 13147 - protein, 442 aa, Eutrema parvulum
MGADAIPMNGRDPAKLTVVEGIQRLRCAVKNYEWGKLGPDSLVARLHEANSGQRVDSMVPHAELWMGTHESGPSHVVKEDEFGSGHDVSVTLKSWVSDNPDLLGSRVVDQWGFDLPFLFKVLSVTKALSIQAHPNKALAETLHREDPLLYRDANHKPEIALAVTPFQALCGFVSLKELKEVIATVPEITELVGSKAADQIFTVNEKDGDESIKSVVRLIFTQLMSASNNETKQVISQMKIRLISETKHRELSEKEKLVLELEKQYPGDIGVISAFFFNYVKLKPGEALYLDANEPHAYISGDCVECMAASDNVVRAGLTPKHRDVQTLCSMLTYKLEYPKILKGFLLTPYITRYLPPFDEFEVDHCDLPTGNSTIFPAIPGPSVYLVIEGQGKLQTGLSQLLVNRGDVLFVPAHNEIHLTTGQSDVMKLYRAGVSSRFFQTL

SEQ ID NO: 13148 - protein, 445 aa, Eutrema halophilum
MGADAIQTNGHDPAKLTAARGIQRLRCAVKNYEWGKLGPDSLVARLHEANSGDRVDPVVPHAELWMGTHESAPSYVVKEEEFGSGRNGSECMVTLKSWVLDYPNLLGSRVVDKWGCDLPFLFKVLSVTKALSIQAHPNKALAEKLHREDPLLYRDANHKPEIALAITPFQALCGFVSLNELKEAIANVPEITELVGSKAADQIFKVNEHDGDETSVKSVVRLIFTQLMSANINDTKQVISQMKIRLISETNHRELSEKEKLVLELEKQYPGDVGVISAFFFNHVKLNPGEALYLDANEPHAYISGDCVECMAASDNVVRAGLTPKHRDVQTLCSMLTYKLGYPEILKGFPLTPYITRYLPPFDEFEVDHCDLPREKSTVFPAIPGPSVYLVIEGKGTLKTGSSQLLVKRGDVLFVPAHNEIHVTGESDVMKLYRAGVSSRFFQTM

SEQ ID NO: 13149 - protein, 442 aa, Arabidopsis lyrata
MGADAIQTNGHDQTKLTGGEEIQRLRCFVKNYEWGKLGPDSLVARLQEANTGQRVDPEIPHAEFWMGTHESGPSHVEFGSLGHGGSDKCMVTLKSWVLDNPDLLGSKVVDKWGCDLPFLFKVLSVTKALSIQAHPNKALAEKLHREDPLLYRDNNHKPEIALAVTPFQALCGFVPLKELKEVITNVPEITELVGSKAADQIFNVHEHDEDERVKSVVRLIFTQLMSASNNETKQVVSRMKNRLISETKHRELSEKENLVLELEKQYSGDIGVISAFFFNYVKLNRGEALYLDANDPHAYISGDCVECMAASDNVVRAGLTPKHRDVQTLCSMLTYKLGYPEILKGFPLTPYVTRYLPPFDEFEVDHCDLPGGNSTVFPAVPGPSVYLVIEGQGKLQTGSSQLLVNRGDVLFVPAHNEVHVTGESDVMKLYRAGVSSRFFQTL

SEQ ID NO: 13150 - protein, 441 aa, Arabidopsis thaliana
MGADAIQTNGHDQAKLTGGEEIQRLRCFVKNYEWGKLGPESLVARLQEANTGQRVDSEIPYAEFWMGTHESGPSHVEFGSGHGVSDKCMVTLKSWVLDNPNLLGSKVVDKWGCDLPFLFKVLSVTKALSIQAHPNKALAEKLHREDPLLYRDNNHKPEIALAVTPFQALCGFVTLKELKEVITNVPEITELVGSKAADQIFNVHEHDEDERIKSVVRLIFTQLMSASNNETKQVVSRMKNRLLLETKHRELSEKEKLVLELEKQYTGDIGVISAFFFNYVKLNPGEALYLDANEPHAYISGDCVECMAASDNVVRAGLTPKHRDVQTLCSMLTYKLGYPEILKGFPLTPYVTRYLPPFDEFEVDHCDLPRGKSTVFPAVPGPSVYLVIEGKGQLRTGSSKVLVNRGDVLFVPADIEIHVTGESDVMKLYRAGVSSRFFQTL

SEQ ID NO: 13151 - protein, 483 aa, Brassica napus
MDRITMFLLAATLAAVRCGCDANYTRNDFPHDFAFGSGTSAYQWEGAYDEDGKKPSVWDTYVHSRNLDNGDITCDGYHKYKEDVQLMVETGLDAFRFSISWSRLIPNRRGPVNPKGLQFYKNFIHELVSHGIEPHVTLYHYDHPQSLEDEYGGWLNRRIIKDFTAYADVCFREFGNHVKLWTTINEANIFTIGGYDGGGTPPGRCSTCSSGNSSTEPYIVAHNLLLAHASASRLYKQKYKDTQGGSVGFSIFAIGFRPSTNSNDDELAIQRFKDFFYAWMLGPLTYGDYPDGMKRIIGTRLPVFSEEESELVKGSSDFVGVIHYLAASVSDAQSKPFLPGDSKFFADMGVLLTYVGNFTAFEYEIAPWAMEGVLEYIKQSYGNPPVYILENGKPMKQDLQLQREDTPRIEFVHAYMGAVLKAVRNGSDTRGYFVWSFMDLYELLSGYEYSFGIYSVNFSDPHRKRSPKLSAHWYSAFLKGNTT

SEQ ID NO: 13152 - protein, 516 aa, Brassica napus
MVYTSHAWSQPRKRGMDRITMFLLAATLAAVRCGCDANYTRNDFPHDFAFGSGTSAYQWEGAYDEDGKKPSVWDTYVHSRNLDNGDITCDGYHKYKEDVQLMVETGLDAFRFSISWSRLIPNRRGPVNPKGLQFYKNFIHELVSHGIEPHVTLYHYDHPQSLEDEYGGWLNRRIIKDFTAYADVCFREFGNHVKLWTTINEANIFTIGGYDGGGTPPGRCSTCSSGNSSTEPYIVAHNLLLAHASASRLYKQKYKDTQGGSVGFSIFAIGFRPSTNSNDDELAIQRFKDFFYAWMLGPLTYGDYPDGMKRIIGTRLPVFSEEESELVKGSSDFVGVIHYLAASVSDAQSKPFLPGDSKFFADMGVLLTYVGNFTAFEYEIAPWAMEGVLEYIKQSYGNPPVYILENGKPMKQDLQLQREDTPRIEFVHAYMGAVLKAVRNGSDTRGYFVWSFMDLYELLSGYEYSFGIYSVNFSDPHRKRSPKLSAHWYSAFLKGNTTFLDSQDIMSNLSSSATSL

SEQ ID NO: 13153 - protein, 593 aa, Brassica rapa
MAMAFPLSYTPVSVKPVTHSRRSKLVVFSSSSNGRDPSPSEEKSVPNGVKSIEKLQEEKRRAELSARIASGAFTVRKSSFPSTVKNGLSKLGVPSNVLDFMFDWTGANEDYLKVPEAKGSIQAVRNEAFFIPLYELFLTYGGIFRLTFGPKSFLIVSDPSIAKHILKDNAKAYSKGILAEILDFVMGKGLIPADGEIWRRRRRAIVPALHMKYVAAMISLFGEASDRLCQKLDTAASTGEDVEMESLFSRLTLDIIGKAVFNYDFDSLTNDTGVIEAVYTVLREAEDRSVSPIPVWDIPIWKDISPRQRKVATSLKLINDTLNDLIATCKRMVEEEELQFHEEYMNERDPSILHFLLASGDDVSSKQLRDDLMTMLIAGHETSAAVLTWTFYLLTTNPKVVAKLQEEVDSVIGDRFPTLEDMKKLKYTTRVMNESLRLYPQPPVLIRRSLENDKLGPYPIKRGEDIFISVWNLHRSPLHWDDAEEFNPERWPLDGPNPNETNQNFSYLPFGGGPRKCIGDMFASFENVVAIAMLIRRFNFQTAPGAPPVKMTTGATIHTTEGLKLTVTKRTPPLSVPILPMEAPRDEVSSARS

SEQ ID NO: 13154 - protein, 597 aa, Eutrema halophilum
MAMAFPLSYTPVSVKPVTHPRRPKLVVFSSTSNGRDPSEEKSVPNGVKSFEKLQEEKRRAELSARIASGAFTVRKSSFPSTVKSGLSKLGIPSNVLDFMFDWTGTNEDYPKVPEAKGSIQAVRNEAFFIPLYELFLTYGGIFRLTFGPKSFLIVSDPSIAKHILKDNAKAYSKGILAEILDFVMGKGLIPADGEIWRRRRRAIVPALHQKYVAAMISLFGEASDRLCQKLDSAASTGEVVEMESLFSRLTLDIIGKAVFNYDFDSLTNDTGVIEAVYTVLREAEDRSVSPIPVWDLPIWKDISPRQRKVATSLKLINDTLDDLIATCKRMVEEEELQFHEEYMNERDPSILHFLLASGDDVSSKQLRDDLMTMLIAGHETSAAVLTWTFYLLTTEPSVVAKLQEEVDSVIGDRFPTIEDMKKLKYTTRVMNESLRLYPQPPVLIRRSLENDTLGPYPIKRGEDIFISVWNLHRSPLHWDDAEKFNPERWPLDGPNPNETNQNFSYLPFGGGPRKCIGDMFASFENVVAIAMLIRRFNFQTAPGAPPVKMTTGATIHTTEGLKLTVTKRTKPLDVPSVQILPMEAPRDEVSSASSALS

SEQ ID NO: 13155 - protein, 597 aa, Eutrema parvulum
MAMAFPLSYTPISVKPVTYSRRQKLVVFSSTSNGRDPSEEKSVPNGVKSIEKLQEEKRRAELSARIASGAFTVRKTSFPSTIKNGLSKLGVPSNVLDFMFDWTGSDQDYPKVPEAKGSIQAVRNEAFFIPLYELFLTYGGIFRLTFGPKSFLIVSDPSIAKHILKDNAKGYSKGILAEILDFVMGKGLIPADGEIWRRRRRAIVPALHQKYVAAMISLFGEASDRLCQKLDSAASAGEEVEMESLFSRLTLDIIGKAVFNYDFDSLTNDTGVIEAVYTVLREAEDRSVSPIPVWDIPIWKDISPRQRKVATSLKLINDTLDDLIATCKRMVEEEELQFHEEYMNERDPSILHFLLASGDDVSSKQLRDDLMTMLIAGHETSAAVLTWTFYLLTKNPSVVAKLQEEVDSVIGDRFPTIEDMKKLRYTTRVMNESLRLYPQPPVLIRRSLEKDILGQYPIKRGEDIFISVWNLHRSPLHWDAAEKFNPERWPLDGPNPNETNQNFSYLPFGGGPRKCIGDMFASFENVVAIAMLIRRFNFQTAPGAPPVKMTTGATIHTTEGLKVTVTRRTKPLNIPSVPILPMEAPLDEVSPASSALS

SEQ ID NO: 13156 - protein, 560 aa, Brassica napus
MAMAFPLSYTPVSVKPVTHSRRSKLVVFSSSSNGRDPSPSEEKSVPNGVKSIEKLQEEKRRAELSARIASGAFTVRKSSFPSTVKNGLSKLGVPSNVLDFMFDWTGANEDYLKVPEAKGSIQAVRNEAFFIPLYELFLTYGGIFRLTFGPKSFLIVSDPSIAKHILKDNAKAYSKGILAEILDFVMGKGLIPADGEIWRRRRRAIVPALHMKYVAAMISLFGEASDRLCQKLDTAASTGEEVEMESLFSRLTLDIIGKAVFNYDFDSLTNDTGVIEAVYTVLREAEDRSVSPIPVWDIPIWKDISPRQRKVATSLKLINDTLNDLIATCKRMVEEEELQFHEEYMNERDPSILHFLLASGDDVSSKQLRDDLMTMLIAGHETSAAVLTWTFYLLTTNPKVVAKLQEEVDSVIGDRFPTLEDVKKLKYTTRVMNESLRLYPQPPVLIRRSLENDKLGPYPIKRGEDIFISVWNLHRSPLHWDDAEEFNPERWPLDGPNPNETNQNFSYLPFGGGPRKCIGDMFASFEVGLGLFNRNRIPNRIRPEMDRFGSVSDKAYLTDG

SEQ ID NO: 13157 - protein, 511 aa, Arabidopsis lyrata
MVYLRLGIPSNVLDFMFDWTGSDEDYLKVPEAKGSIQAVRNEAFFIPLYELFLTYGGIFRLTFGPKSFLIVSDPSIAKHILKDNAKAYSKGILAEILDFVMGKGLIPADGEIWRRRRRAIVPALHQKYVAAMISLFGEASDRLCQKLDAAALKGEEVEMESLFSRLTLDIIGKAVFNYDFDSLTNDTGVIEAVYTVLREAEDRSVSPIPVWDIPIWKDISPRQRKVATSLKLINDTLDDLIATCKRMVEEEELQFHEEYMNERDPSILHFLLASGDDVSSKQLRDDLMTMLIAGHETSAAVLTWTFYLLTTEPSVVAKLQEEVDSVIGDRFPTIEDMKKLKYTTRVMNESLRLYPQPPVLIRRSLENDMLGQYPIKRGEDIFISVWNLHRSPLHWDDAEKFNPERWPLDGPNPNETNQNFSYLPFGGGPRKCIGDMFASFENVVAIAMLIRRFDFQTAPGAPPVKMTTGATIHTTEGLRLTVTKRTKPLDIPPVPILPIEASRDEVSSALS

SEQ ID NO: 13158 - protein, 583 aa, Brassica napus
MAFKVTLVSTSPIDGQKPGTSGLRKKVKVFKQPNYLENFVQATFNALTPEKVKGATLVVSGDGRYYSKDAVQIIIKMAAANGVRRVWVGKNTLMSTPAVSAVIRERSGADGSKATGAFILTASHNPGGPTEDFGIKYNMENGGPAPESITDKIYENTKTIKEYPIAEDLPNVDISAVGVTSFEGPEGKFDVEVFDSADDYVKLMKSIFDFESIRKLLSSPQFTFCYDALHGVAGAYAHRIFVEELGAQESALLNCVPKEDFGGGHPDPNLTYAKELVARMGLGKSDTGGEPPEFGAAADGDADRNMILGKRFFVTPSDSVAIIAANAIEAIPYFSSGLKGVARSMPTSAALDVVAKSLNLKFFEVPTGWKFFGNLMDAGMCSVCGEESFGTGSDHIREKDGIWAVLAWMSILAHKNKDSIDGDTKLVTVEDIVRQHWATYGRHYYTRYDYENVDAGKAKELMEHLVKLQSSIPEVNKIVKGIRSDVANVSSADEFEYKDPVDGSISKHQGIRYLFEDGSRLVFRLSGTGSEGATIRLYIEQYEKDASKIGRESQEALSPLVDIALKLSKMEEFTGRSAPTVIT

SEQ ID NO: 13159 - protein, 583 aa, Brassica napus
MAFKVTLVSTSPIDGQKPGTSGLRKKVKVFKQPNYLENFVQATFNALTPEKVKGATLVVSGDGRYYSKDAVQIIIKMAAANGVRRVWVGKNTLMSTPAVSAVIRERSGADGSKATGAFILTASHNPGGPTEDFGIKYNMENGGPAPESITDKIYENTKTIKEYPIAEDLPNVDVSAIGVTSFEGPEGKFDVEVFDSADDYVKLMKSIFGFESIRKLLSSPKFTFCYDALHGVAGAYAHRIFVEELGAQESALLNCVPKEDFGGGHPDPNLTYAKELVARMGLGKSDTGGEPPEFGAAADGDADRNMILGKRFFVTPSDSVAIIAANAIEAIPYFSSGLKGVARSMPTSAALDVVAKSLNLKFFEVPTGWKFFGNLMDAGMCSVCGEESFGTGSDHIREKDGIWAVLAWMSILAHKNKDSIDGDTKLVTVEDIVRQHWATYGRHYYTRYDYENVDAGKAKELMEHLVKLQSSIPEVNKIVKGIRSDVANVSSADEFEYKDPVDGSISKHQGIRYLFEDGSRLVFRLSGTGSEGATIRLYIEQYEKDASKIGRESQEALSPLVDIALKLSKMEEFTGRSAPTVIT

SEQ ID NO: 13160 - protein, 583 aa, Brassica napus
MAFKVTLVSTSPIDGQKPGTSGLRKKVKVFKQPNYLENFVQATFNALTPEKVKGATLVVSGDGRYYSKDAVQIIIKMAAANGVRRVWVGKNTLMSTPAVSAVIRERSGADGSKATGAFILTASHNPGGPTEDFGIKYNMENGGPAPESITDKIYENTKTIKEYPIAEDLPNVDISAVGVTSFEGPEGKFDVEVFDSADDYVKLMKSIFDFESIRKLLSSPQFTFCYDALHGVAGAYAHRIFVEELGAQESALLNCVPKEDFGGGHPDPNLTYAKELVARMGLSKSDTGGEPPEFGAAADGDADRNMILGKRFFVTPSDSVAIIAANAIEAIPYFSSGLKGVARSMPTSAALDVVAKSLNLKFFEVPTGWKFFGNLMDAGMCSVCGEESFGTGSDHIREKDGIWAVLAWMSILAHKNKDSIDGDTKLVTVEDIVRQHWATYGRHYYTRYDYENVDAGKAKELMEHLVKLQSSIPEVNKIVKGIRSDVANVSSADEFEYKDPVDGSISKHQGIRYLFEDGSRLVFRLSGTGSEGATIRLYIEQYEKDASKIGRESQEALSPLVEIALKLSKMEEFTGRSAPTVIT

SEQ ID NO: 13161 - protein, 582 aa, Eutrema halophilum
MVFKVSLVSTSPIDGQKPGTSGLRKKVKVFKQPNYLENFVQATFNALTPEKVKGATLVVSGDGRYYSKDAVQIIIKMAAANGVRRVWVGKNTLLSTPAVSAVIRERSGADGSKATGAFILTASHNPGGPTEDFGIKYNMENGGPAPESITDKIYENTKTIKEYPIADLPNVDISSVGVTSFEGPEGKFDVEVFDSADDYVKLMKSIFDFESIRKLLSSPKFTFCYDALHGVAGAYAHRIFVEELGAQESALLNCIPKEDFGGGHPDPNLTYAKELVARMGLGKSDTGVEPPEFGAAADGDADRNMILGKRFFVTPSDSVAIIAANAIGAIPYFSSGLKGVARSMPTSAALDVVAKSLNLKFFEVPTGWKFFGNLMDAGMCSVCGEESFGTGSDHIREKDGIWAVLAWMSILAHKNKENLDGNTKLVTVEDIVRQHWATYGRHYYTRYDYENVDAGKAKDLMEHLIKLQSSIPEVNKIVKGIRSDVANVSSADEFEYKDPVDGSISKHQGIRYLFEDGSRLVFRLSGTGSEGATIRLYIEQYERDASKTGRESHEALSPLVELALKLSKMEEFTGRSAPTVIT

SEQ ID NO: 13162 - protein, 583 aa, Eutrema parvulum
MVFKVSLVSTSPIDGQKPGTSGLRKKVKVFKQPNYLENFVQATFNALTPEKVKGATLVVSGDGRYYSKDAVQIIIKMAAANGVRRVWVGKNTLLSTPAVSAVIRERAGADGSKATGGFILTASHNPGGPTEDFGIKYNMENGGPAPESITDKIYENTKTIKEYPIAEDLPNVDISAIGVTSFEGAEGKFDVEVFDPADDYVKLMKSIFDFESIRKLLSSPKFTFCYDALHGVAGAYAHRIFVEELGAQENSLLNCVPKEDFGGGHPDPNLTYAKELVARMGLGKSDTGVEPPEFGAAADGDADRNMILGKRFFVTPSDSVAIIAANAVGAIPYFSSGLKGVARSMPTSAALDVVAKSLNLKFFEVPTGWKFFGNLMDAGMCSVCGEESFGTGSDHIREKDGIWAVLAWMSILAHKNKENIEGNTKLVTVEDIVRQHWATYGRHYYTRYDYENVDAAKAKELMEHLVKLQSSIPEVNKIVKGIRSDVANVSSADEFEYKDPVDGSISKHQGIRYLFEDGSRLVFRLSGTGSEGATIRLYIEQYEKDSSKTGRESQEALSPLVDLALKLSKMEEFTGRSTPTVIT

SEQ ID NO: 13163 - protein, 583 aa, Arabidopsis thaliana
MVFKVSTVSTSPIDGQKPGTSGLRKKVKVFKQPNYLENFVQATFNALTAEKVKGATLVVSGDGRYYSKDAVQIIIKMAAANGVRRVWVGKNTLLSTPAVSAVIRERSGADGSKATGAFILTASHNPGGPTEDFGIKYNMENGGPAPESITDKIYENTKTIKEYPIAQDLPNVDISAVGVTSFEGPEGKFDVEVFDPADDYVKLMKSIFDFEAIRKLLSSPKFTFCYDALHGVAGAYAHRIFVEELGAQESALLNCTPKEDFGGGHPDPNLTYAKELVARMGLGKSDTGGEPPEFGAAADGDADRNMILGKRFFVTPSDSVAIIAANAIGAIPYFSSGLKGVARSMPTSAALDVVAKSLNLKFFEVPTGWKFFGNLMDAGMCSVCGEESFGTGSDHIREKDGIWAVLAWMSILAHKNKGNIDGNAKLVSVEDIVRQHWATYGRHYYTRYDYENVDAGKAKELMEHLVKLQSSIPEVNKIVKGIRSDVASVASADEFEYKDPVDGSISKHQGIRYLFEDGSRLVFRLSGTGSEGATIRLYIEQYEKDASKTGRESQEALSPLVDLALKLSKMEEFTGRSAPTVIT

SEQ ID NO: 13164 - protein, 583 aa, Arabidopsis lyrata
MVFKVSTVSTSPIDGQKPGTSGLRKKVKVFKQPNYLENFVQATFNALTAQKVKGATLVVSGDGRYYSKDAVQIIIKMAAANGVRSVWVGKNTLLSTPAVSAVIRERSGADGSKATGAFILTASHNPGGPTEDFGIKYNMENGGPAPESITDKIYENTKTIKEYPIADDLPNVDISTIGVTSFEGPDGKFDVEVFDSADDYVKLMKSIFDFESIRKLLSSPKFTFCYDALHGVAGAYAHRIFVEELGAQESALLNCTPKEDFGGGHPDPNLTYAKELVARMGLSKSDTGGEPPEFGAAADGDADRNMILGKRFFVTPSDSVAIIAANAIGAIPYFSSGLKGVARSMPTSAALDVVAKSLNLKFFEVPTGWKFFGNLMDAGMCSVCGEESFGTGSDHIREKDGIWAVLAWMSILAHKNKGNIDGNAKLVSVEDIVRQHWATYGRHYYTRYDYENVDAGKAKELMEHLVKLQSSIPEVNKIVKGIRSHVANVASADEFEYKDPVDGSISKHQGIRYLFEDGSRLVFRLSGTGSEGATIRLYIEQYEKDASKTGRESQEALSPLVDLALKLSKMEEFTGRSAPTVIT

SEQ ID NO: 13165 - protein, 583 aa, Unknown
  Sequence found in Organisms: Brassica napus, Brassica rapa
MVFKVSLVSTSPIDGQKPGTSGLRKKVKVFKQPNYLHNFVQSTFNALTPEKVKGATLVVSGDGRYYSNDAVQIIIKMAAANGVRRVWVGKNTLLSTPAVSAVIRERSGADGSKATGGFILTASHNPGGPTEDFGIKYNMENGGPAPESITDKIYENTKTIKEYPIAEDLPIVDISAIGVSSFEGPEGKFDVEVFDSADDYVKLMKSIFDFESIRKLLSSPKFSFCYDAMHGVAGAYAHRIFVEELGAQESSLLNCVPKEDFGGGHPDPNLTYAKELVARMGLGKSDTGVEPPEFGAAADGDADRNMILGKRFFVTPSDSVAIIAANAVGAIPYFSTGLKGVARSMPTSAALDVVAKSLNLKFFEVPTGWKFFGNLMDAGMCSVCGEESFGTGSDHIREKDGIWAVLAWLSILAHKNKETLDGDAKLVTVEDIVRKHWATYGRHYYTRYDYENVDAGKAKELMEHLVKLQSSIPEVNKMVKGIRSDVANVSSADEFEYKDPVDGSISKHQGIRYLFEDGSRLVFRLSGTGSEGATIRLYIEQYEKDASKTGRESHEALSPLVDIALKLSKMEEFTGRSAPTVIT

SEQ ID NO: 13166 - protein, 583 aa, Brassica napus
MVFKVSLVSTSPIDGQKPGTSGLRKKVKVFKQPNYLHNFVQSTFNALTPEKVKGATLVVSGDGRYYSNDAVQIIIKMAAANGVRRVWVGKNTLLSTPAVSAVIRERSGADGSKATGGFILTASHNPGGPTEDFGIKYNMENGGPAPESITDKIYENTKTIKEYPIAEDLPIVDISAIGVSSFEGPEGKFDVEVFDSADDYVKLMKSIFDFESIRKLLSSPKFSFCYDAMHGVAGAYAHRIFVEELGAQESSLLNCVPKEDFGGGHPDPNLTYAKELVARMGLGKSDTGLEPPEFGAAADGDADRNMILGKRFFVTPSDSVAIIAANAVGAIPYFSTGLKGVARSMPTSAALDVVAKSLNLKFFEVPTGWKFFGNLMDAGMCSVCGEESFGTGSDHIREKDGIWAVLAWLSILAHKNKETLDGDAKLVTVEDIVRKHWATYGRHYYTRYDYENVDAGKAKELMEHLVKLQSSIPEVNKMVKGIRSDVANVSSADEFEYKDPVDGSISKHQGIRYLFEDGSRLVFRLSGTGSEGATIRLYIEQYEKDASKTGRESHEALSPLVDIALKLSKMEEFTGRSAPTVIT

SEQ ID NO: 13167 - protein, 583 aa, Brassica napus
MVFKVSLVSTSPIDGQKPGTSGLRKKVKVFKQPNYLQNFVQSTFNALTPAKVKGATLVVSGDGRYYSNDAVQIIIKMAAANGVRRVWVGKNTLLSTPAVSAVIRERSGADGSKATGGFILTASHNPGGPTEDFGIKYNMENGGPAPESITDKIYENTKTIKEYPIAEDLPIVDISAIGVSSFEGPEGKFDVEVFDSADDYVKLMKSIFDFESIRKLLSSPKFSFCYDAMHGVAGAYAHRIFVEELGSQENSLLNCVPKEDFGGGHPDPNLTYAKELVARMGLGKSDTGVEPPEFGAAADGDADRNMILGKRFFVTPSDSVAIIAANAVGAIPYFSTGLKGVARSMPTSAALDVVAKSLNLKFFEVPTGWKFFGNLMDAGMCSVCGEESFGTGSDHIREKDGIWAVLAWLSILAHKNKETLDGDAKLVTVEDIVRKHWATYGRHYYTRYDYENVDAGKAKELMEHLVKLQSSIPEVNKMVKGIRSDVANVSSADEFDYKDPVDGSISKHQGIRYLFEDGSRLVFRLSGTGSEGATIRLYIEQYEKDASKTGRESHEALSPLVDIALKLSKMEEFTGRSAPTVIT

SEQ ID NO: 13168 - protein, 583 aa, Brassica napus
MVFKVSLVSTSPIDGQKPGTSGLRKKVKVFKQPNYLQNFVQSTFNALTPAKVKGATLVVSGDGRYYSNDAVQIIIKMAAANGVRRVWVGKNTLLSTPAVSAVIRERSGPDGSKATGGFILTASHNPGGPTEDFGIKYNMENGGPAPESITDKIYENTKTIKEYPIAEDLPIVDISAIGVSSFEGPEGKFDVEVFDSADDYVKLMKSIFDFESIRKLLSSPKFSFCYDAMHGVAGAYAHRIFVEELGSQENSLLNCVPKEDFGGGHPDPNLTYAKELVARMGLRQSDTGVEPPEFGAAADGDADRNMILGKRFFVTPSDSVAIIAANAVGAIPYFSTGLKGVARSMPTSAALDVVAKSLNLKFFEVPTGWKFFGNLMDAGMCSVCGEESFGTGSDHIREKDGIWAVLAWLSILAHKNKETLDGDAKLVTVEDIVRKHWATYGRHYYTRYDYENVDAGKAKELMEHLVKLQSTIPEVNKMVKGIRSDVANVSSADEFEYKDPVDGSISKHQGIRYLFEDGSRLVFRLSGTGSEGATIRLYIEQYEKDASKTGRESHEALSPLVDIALKLSKMEEFTGRSAPTVIT

SEQ ID NO: 13169 - protein, 584 aa, Eutrema halophilum
MVSFKVSVVSTSPIDGQKPGTSGLRKKVKVFKQPNYLENFVQATFNALTPEKVKGATLVVSGDGRYYSEEAIQIIIKLAAANGVRRVWVGQNSLLSTPAVSAVIRERVGNDGSKATGAFILTASHNPGGPTEDFGIKYNMENGGPAPESITDKIYENTKTIKEYPIAEDLPSVDISAIGTTSFEGPEGKFDVEVFDSADDYVKLMKSIFDFESIKKLLSSPKFTFCYDALHGVAGAYAHRIFVEELGAQESSLLNCTPKKDFGGGHPDPNLTYAKELVARMGLSKIDPGVEPPEFGAAADGDADRNMILGKRFFVTPSDSVAIIAANAVGAIPYFSSGLKGVARSMPTSAALDVVAKNLNLKFFEVPTGWKFFGNLMDAGMCSVCGEESFGTGSDHIREKDGIWAVLAWLSILAHKNKETLDGNAKLVTVEDIVRQHWATYGRHYYTRYDYENVDAAAAKELMALLVKLQSSLPEVNKIVKEIHPNVANVASADEFEYKDPVDGSVSKHQGIRYLFEDGSRLVFRLSGTGSEGATIRLYIEQYEKDASKTGRDSQDALAPLVDVALKLSKMQEFTGRSSPTVIT

SEQ ID NO: 13170 - protein, 585 aa, Arabidopsis lyrata
MVSFKVSVVSTSPIDGQKPGTSGLRKKVKVFKQPNYLENFVQATFNALTPEKVKGATLVVSGDGRYYSEQAIQIIVKMAAANGVRRVWVGQNSLLSTPAVSAIIRERVGADGSKATGAFILTASHNPGGPTEDFGIKYNMENGGPAPESITDKIYENTKTIKEYPIAEDLPRVDISTIGITSFEGPEGKFDVEVFDSADDYVKLMKSIFDFESIKKLLSSPKFTFCYDALHGVAGAYAHRIFVEELGAEESSLLNCVPKEDFGGGHPDPNLTYAKELVARMGLSKTDDAGGEPPEFGAAADGDADRNMILGKRFFVTPSDSVAIIAANAVGAIPYFCSGLKGVARSMPTSAALDVVAKNLGLKFFEVPTGWKFFGNLMDAGMCSVCGEESFGTGSDHIREKDGIWAVLAWLSILAHKNKETLDGNAKLVTVEDIVRQHWATYGRHYYTRYDYENVDATKAKELMGLLVKLQSSLPEVNKIIKGIHPEVANVASADEFEYKDPVDGSVSKHQGIRYLFEDGSRLVFRLSGTGSEGATIRLYIEQYEKDASKIGRDSQDALAPLVDVALKLSKMQEFTGRSSPTVIT

SEQ ID NO: 13171 - protein, 585 aa, Arabidopsis thaliana
MVSFKVSLVSTSPIDGQKPGTSGLRKKVKVFKQPNYLENFVQATFNALTTEKVKGATLVVSGDGRYYSEQAIQIIVKMAAANGVRRVWVGQNSLLSTPAVSAIIRERVGADGSKATGAFILTASHNPGGPTEDFGIKYNMENGGPAPESITDKIYENTKTIKEYPIAEDLPRVDISTIGITSFEGPEGKFDVEVFDSADDYVKLMKSIFDFESIKKLLSYPKFTFCYDALHGVAGAYAHRIFVEELGAPESSLLNCVPKEDFGGGHPDPNLTYAKELVARMGLSKTDDAGGEPPEFGAAADGDADRNMILGKRFFVTPSDSVAIIAANAVGAIPYFSSGLKGVARSMPTSAALDVVAKNLGLKFFEVPTGWKFFGNLMDAGMCSVCGEESFGTGSDHIREKDGIWAVLAWLSILAHKNKETLDGNAKLVTVEDIVRQHWATYGRHYYTRYDYENVDATAAKELMGLLVKLQSSLPEVNKIIKGIHPEVANVASADEFEYKDPVDGSVSKHQGIRYLFEDGSRLVFRLSGTGSEGATIRLYIEQYEKDASKIGRDSQDALGPLVDVALKLSKMQEFTGRSSPTVIT

SEQ ID NO: 13172 - protein, 584 aa, Eutrema parvulum
MVSFKVSLVSTSPIDGQKPGTSGLRKKVKVFKQPNYLENFVQATFNALTAEKVKGATLVVSGDGRYYSEEAIQIMLKLAAANGVRRVWVGQNTLLSTPALSAIIRERVGNDGSKANGGFILTASHNPGGPTEDFGIKYNMENGGPAPESITDKIYENTKTIKEYPIAEDLPSVDISATGVTSFDGPEGKFDVEVFDSADDYVKLMKSIFDFESIKKLLSSPKFTFCYDAMHGVAGAYAHRIFVEELGAQESSLLNCTPKKDFGGGHPDPNLTYAKELVARMGLSKTDAGVEPPEFGAAADGDADRNMILGKRFFVTPSDSVAIIAANAVGAIPYFSSGLKGVARSMPTSAALDVVAKNLDLKFFEVPTGWKFFGNLMDAGMCSICGEESFGTGSDHIREKDGIWAVLAWLSILAHKNKETLDGNANLVTVEDIVRQHWATYGRHYYTRYDYENVDAAAAKELMALLVKLQSSLPEVNKIVKGLHPEVANVASADEFEYKDPVDGSVSKHQGIRYLFEDGSRLVFRLSGTGSEGATIRLYIEQYEKDAAKTGRDSQDALSPLVDVALTLSKMQELTGRSSPTVIT

SEQ ID NO: 13173 - protein, 374 aa, Cucumis melo
MARFNVTKKLTSPIDGQKPGTSGLRKKVKVFIQPNYLENFVQSTFNALTTEKVRGATLVVSGDGRYYSKDAIQIIIKMAAANGVRRIWVGQNGLLSTPAVSAVIRERVGVDGSRASGAFILTASHNPGGPHEDFGIKYNMENGGPAPEGITDKIYENTKTIKEYLIAEDLPNVDISAIGVSSFGGPEGQFDVEVFDSASDYVKLMKSIFDFESIRKLLTSPKFSFCYDALHGVAGAYAKRIFVEELGAQESSLLNCVPKEDFGGGHPDPNLTYAKELVDRMGLGKSSSGEPPEFGAAADGDADRNMVLGKRFFVTPSDSVAIIAANAVEAIPYFSAGLKGVARSMPTSAALDVVAKNLKLKFFEVPTGWKFLVI

SEQ ID NO: 13174 - protein, 583 aa, Citrullus lanatus
MVRFNVTRKLTSPIDGQKPGTSGLRKKVKVFIQPNYLENFVQSTFNALTAEKVRGATLVVSGDGRYYSKDAIQIIVKMAAANGVRRIWVGQNGLLSTPAVSAVIRERVGVDGSRASGAFILTASHNPGGPNEDFGIKYNMENGGPAPEGITDKIYENTKSIKEYLIAEDLPNVDISAIGVSSFGGPEGQFDVEVFDSASDYVKLMKSIFDFESIRKLLSSPKFSFCYDALHGVAGAYAKRIFVEELGAQESSLLNCVPKEDFGGGHPDPNLTYAKELVARMGLGKSSSGEEPPEFGAAADGDADRNMVLGKRFFVTPSDSVAIIAANAVEAIPYFSAGLKGVARSMPTSAALDVVAKNLNLKFFEVPTGWKFFGNLMDAGMCSVCGEESFGTGSDHIREKDGIWAVLAWLSILAYKNKGNLDGGKLVTVEDIVRQHWATYGRHYYTRYDYENVDAGAAKELMANLVKLQSSLAEVNGIVQGIRSDVSKVVHGDEFEYKDPVDGSISKHQGIRYLFEDGSRLVFRLSGTGSEGATIRLYIEQYEKDPSKTGRDSQEALAPLVEVALKLSKMQEFTGRSAPTVIT

SEQ ID NO: 13175 - protein, 582 aa, Manihot esculenta
MVVFKVSRVETTPFDGQKPGTSGLRKKVKVFIQPNYLENFVQSTFNALTAEKVRGATLVVSGDGRYYSKTAIQIIIKMAAANGVRRVWVGQNGLLSTPAVSAVIRERVGIDGSKATGAFILTASHNPGGPHEDFGIKYNMENGGPAPEGITDKIYENTTSIKEYLIADLPDVDIAAIGVTNFGGPEGQFDVEVFDSASDYVKLMKSIFDFESIRKLLSSPKFTFCYDALHGVAGAYAKRIFVEELGAQESSLLNCVPKEDFGGGHPDPNLTYAKELVARMGLSKSNSQVEPPEFGAAADGDADRNMILGKRFFVTPSDSVAIIAANAVEAIPYFSAGLKGVARSMPTSAALDVVAKHLNLKFFEVPTGWKFFGNLMDAGLCSVCGEESFGTGSDHIREKDGIWAVLAWLSILAYKNKENLNGGKLVTVEDIVRNHWATYGRHYYTRYDYENVDASAAKELMANLVKLQPSLGEVNEIVKGIRSDVSKVVHADEFEYKDPVDGSISKHQGIRYLFEDGSRLVFRLSGTGSEGATIRLYIEQYEKDSSKTGRDSQEALAPLVDVALKLSKMQEFTGRSAPTVIT

SEQ ID NO: 13176 - protein, 582 aa, Castanea mollissima
MVFKVSRVETKPIDGQKPGTSGLRKKVKVFIQPHYLHNFVQSTFNALTPEKVRGATLVVSGDGRYYSKDAIQIITKMSAANGVRRVWVGQNGLLSTPAVSAVIRERVGVDGSRASGAFILTASHNPGGPHEDFGIKYNMENGGPAPEGITDKIYENTKTIKEYFIAEDLPDVDISAEGVTSFAGPEGQFDVEVFDSASDYVKLMKSIFDFESIRKLISSPKFTFCYDALHGVAGAYAKRIFVEELGAQESSLLNCIPKEDFGGGHPDPNLTYAKELVARMGLGKSSSQGEPPEFGAAADGDADRNMILGKRFFVTPSDSVAIIAANAVESIPYFSAGLKGVARSMPTSAALDVVAKNLNLKFFEVPTGWKFFGNLMDAGLCSVCGEESFGTGSDHIREKDGIWAVLAWLSILAHKNKENLGGEKLVSVEDIVRQHWTTYGRHYYTRYDYENVDAGAAKELMAYLVKLQSSLPEVNEIVKGTRSDVSKVVNADEFEYKDPVDGSISKHQGIRYLFEDGSRLVFRLSGTGSEGATIRLYIEQYEKDPSKTGRDSQDALAPLVEVALKLSKMQEFTGRTAPTVIT

SEQ ID NO: 13177 - protein, 582 aa, Manihot esculenta
MVVFKVSRVETQPIDGQKPGTSGLRKKVKVFIQPHYLQNFVQSTFNALTAEKVRGATLVVSGDGRYYSKDAIQIIIKMAAANGVRRVWVGQNGLLSTPAVSAVIRERVGVDGSKATGAFILTASHNPGGPQEDFGIKYNMENGGPAPEGITDKIYENTKTIKEYLTADLPDVDITTIGVTNFGGPEGQFDVEVFDSASDYVKLMKSIFDFESIRKLLSSPKFTFCYDALHGVAGAYAKRIFVEELGAQESSLLNCVPKEDFGGGHPDPNLTYAKELVARMGLSKSSSQVEPPEFGAAADGDADRNMVLGKRFFVTPSDSVAIIAANAVEAIPYFSSGLKGVARSMPTSAALDVVAKHLKLKFFEVPTGWKFFGNLMDAGLCSVCGEESFGTGSDHIREKDGIWAVLAWLSILAYKNKENLNGGKLVTVEDIVRNHWATYGRHYYTRYDYENVDASSAKELMAHLVKLQSSLGEVNEIVKGIRSDVSKVVNADEFEYKDPVDGSISKHQGIRYLFEDGSRLVFRLSGTGSEGATIRLYIEQYEKDSSKTGRDSQEALAPLVEVALKLSKMQEFTGRSAPTVIT

SEQ ID NO: 13178 - protein, 583 aa, Citrus sinensis
MVMFNVTRKETAPIDGQKPGTSGLRKKVKVFTQPNYLHNFVQSTFNALSAEKVRGATLVVSGDGRYYSKDAIQIITKMAAANGVRRVWIGQNGLLSTPAVSAVIRERVGSDGSKATGAFILTASHNPGGPNEDFGIKYNMDNGGPAPEGITDKIYENTKTINEYSIAEDLPDVDISAAGVTSFGGPEGQFDVEVFDSASDYVKLMKSIFDFEAIRKLLSSPKFTFCYDALHGVAGAYAKRIFVEELGAQESSLLNCTPKEDFGGGHPDPNLTYAKELVARMGLGKSNTQDEPPEFGAAADGDADRNMILGKRFFVTPSDSVAIIAANAVESIPYFSAGLKGVARSMPTSAALDVVAKNLNLKFFEVPTGWKFFGNLMDAGLCSICGEESFGTGSDHIREKDGIWAVLAWLSILAHKNKENLDGGKLVTVEDIVRKHWATYGRHYYTRYDYENVDAGAAKELMANLVKMQSSLPEVNDIVKGIRSDVSKVVNADEFEYKDPVDGSISKHQGIRYLFEDGSRLVFRLSGTGSEGATIRLYIEQYEKDPSKIGRDSQEALAPLVEVALKLSKMEQFTGRSAPTVIT

SEQ ID NO: 13179 - protein, 582 aa, Gossypium hirsutum
MVFKVSKVSTTPIDGQKPGTSGLRKKVKVFIQPHYLQNFVQSTFNALTPEKVRGATLVVSGDGRYFSKDAIQIIIKMSAANGVRRVWVGQNGLLSTPAVSAVIRERVGVDGSKATGAFILTASHNPGGPHEDFGIKYNMENGGPAPEAITDKIFENTKTITEYLIAEDLPNIDISTIGVANFSGPEGQFDVEVFDSASDYVKLMKSIFDFELIRKLLSSSKFTFCYDALHGVAGAYAHRIFVEELGAQESSLLNCVPKEDFGGGHPDPNLTYAKELVARMGLGKSDSAVDPPEFGAAADGDADRNMILGKRFFVTPSDSVAIIAANAVNAIPYFSSGLKGVARSMPTSAALDVVAKNLNLKFFEVPTGWKFFGNLMDAGLCSICGEESFGTGSDHIREKDGIWAVLAWLSILAFKNKENLNGDKLVTVEDIVRQHWAIYGRHYYTRYDYENVDAGAAKDLMAYLVKLQSSLDEINSSVKGARSDVSNVVNADEFEYKDPVDGSVSKHQGIRFLFEDGSRLVFRLSGTGSEGATIRLYIEQYEKDSSKTGRDSQEALAPLVEVALKLSKMLEFTGRSAPTVIT

SEQ ID NO: 13180 - protein, 582 aa, Quercus alba
MVFKVSRVETKPIDGQKPGTSGLRKKVKVFIQPHYLHNFVQSTFNALTPEKVRGATLVVSGDGRYYSKDAIQIITKMSAANGVRRVWVGQNGLLSTPAVSAVIRERVGVDGSRASGAFILTASHNPGGPNEDFGIKYNMENGGPAPEGITDKIYENTKTIKEYFISEDLPDVDISAVGVTSFAGPEGQFDVEVFDSASDYVKLMKSIFDFESIRKLISSPKFTFCYDALHGVAGAYAKRIFVEELGAQESSLLNCTPKEDFGGGHPDPNLTYAKELVARMGLGKSSSQGEPPEFGAAADGDADRNMILGKRFFVTPSDSVAIIAANAVESIPYFSAGLKGVARSMPTSAALDVVAKHLNLKFFEVPTGWKFFGNLMDAGLCSVCGEESFGTGSDHIREKDGIWAVLAWLSILAHKNKENLGEEKLVSVEDIVRQHWTTYGRHYYTRYDYENVDAGAAKELMAYLVKLQSSLPEVNEIVKGTRSDVSKVVNADEFEYKDPVDGSISKHQGIRYLFEDGSRLVFRLSGTGSEGATIRLYIEQYEKDPSKTGRDSQDALAPLVEVALKLSKMQEFTGRTAPTVIT

SEQ ID NO: 13181 - protein, 583 aa, Tropaeolum majus
MVMFKVSRVETTPIDGQKPGTSGLRKKVKVFKEPHYLENFVQATFNALTVEKVRGATLVVSGDGRYYSEDAIQIIIKMAAANGVRRIWVGQKGLLSTPAVSAVIRERVGADGSKATGAFILTASHNPGGPTEDFGIKYNMENGGPAPEGITDKIYENTKTIKEYLIAEDLPNVDITSTGVTNFGGAEGQFDVEVFDSASDYVKLMKSIFDFESIRALLSSPTFTFCYDALHGVAGAYAKRIFVEELGAQESSLLNCTPKEDFGGGHPDPNLTYAKELVARMGLSKSDSGVEPPEFGAAADGDADRNMILGKRFFVTPSDSVAIIAANAVETIPYFSAGLKGVARSMPTSAALDVVAKNLNLKFFEVPTGWKFFGNLMDAGLCSVCGEESFGTGSDHIREKDGIWAVLAWLSILAHKNKENLNGGKLVTVEDIVRQHWATYGRHYYTRYDYENVDATGAKDLMSYLVKLQSSLPEVNEIVKGVRSDVANVINADEFEYKDPVDGSVSKNQGVRYMFEDGSRLIFRLSGTGSEGATIRLYIEQYEKDSSKTGRDSQEALGPLVEAALKLSKMQEFTGRSAPTVIT

SEQ ID NO: 13182 - protein, 582 aa, Theobroma cacao
MVFKVSKVPTTPYDGQKPGTSGLRKKVKVFVQPHYLQNFVQSTFNALTPEKVRGATLVVSGDGRYFSKDAIQIIIKMAAANGVRRIWVGQNGLLSTPAVSAVIRERIGVDGSKATGAFILTASHNPGGPHEDFGIKYNMENGGPAPEAITDKIFENTKTITEYLIAEDLPNVDISAIGVTSFGGPEAQFDVEVFDSASDYVKLMKSIFDFELIRQLLSSPKFTFCYDALHGVAGAYAHRIFVEELGAKESSLLNCVPKEDFGGGHPDPNLTYAKELVARMGLGKSNSGVEPPEFGAAADGDADRNMILGKRFFVTPSDSVAIIAANAVDAIPYFSSGLKGVARSMPTSAALDVVAKNLELKFFEVPTGWKFFGNLMDAGLCSVCGEESFGTGSDHIREKDGIWAVLAWLSILAYKNKENLDGDKLVTVEDIVRQHWATYGRHYYTRYDYENVDAGAAKDLMAYLVKLQSSLGDVNTIVNEAHSDVSNVVNADEFEYKDPVDGSVSKHQGIRFLFEDGSRLVFRLSGTGSEGATIRLYIEQYEKDPSKTGRDSQEALAPLVEVALKLSKMQEFTGRSAPTVIT

SEQ ID NO: 13183 - protein, 581 aa, Ricinus communis
MVFEVSRVSTTPFDGQKPGTSGLRKKVKVFTQPNYLHNFVQSTFDALTAEKVRGATLVVSGDGRYFSKDAIQIIIKMSAANGVRRVWVGQNGLLSTPAVSAVIRERVGLDGSKATGAFILTASHNPGGPHEDFGIKYNMENGGPAPEGITDKIYENTKTIKEYLISDLPDVDISAIGVTNFSGPEGQFDVDVFDSADDYVKLMKSIFDFESIKKLISSPNFTFCYDALHGVAGAYAKRIFVEELCAQESSLLNCVPKEDFGGGHPDPNLTYAKELVARMGLGKSNSEVEPPEFGAAADGDADRNMILGKRFFVTPSDSVAIIAANAVEAIPYFSAGLKGVARSMPTSAALDIVAKHLNLKFFEVPTGWKFFGNLMDAGLCSVCGEESFGTGSDHIREKDGIWAVLAWLSILAYKNKENLNGGKLVSVEDIVRNHWATYGRHYYTRYDYENVDAGAAKELMAHLVKLQSSLGEVNEIVKGIRSDVAKVVHGDEFEYKDPVDGSISSHQGIRYLFEDGSRLVFRLSGTGSEGATIRLYIEQYEKDSSKTGRDSQEALAPLVEVALKLSKMQEFTGRSAPTVIT

SEQ ID NO: 13184 - protein, 344 aa, Cucumis sativus
MARFSVTKKLTSPIDGQKPGTSGLRKKVKVFIQPNYLENFVQSTFNALTAENVRGATLVVSGDGRYYSKDAIQIITKMAAANGVRRIWVGQNGLLSTPAVSAVIRERVGVDGSRASGAFILTASHNPGGPHEDFGIKYNMENGGPAPEGITDKIYENTKTIKEYLIAEDLPNVDISTIGVSSFGGPEGQFDVEVFDSASDYVKLMKSIFDFESIRKLLTSPKFSFCFDALHGVGGAYAKRIFVEELGAQESSLLNCVPKEDFGGGHPDPNLTYAKELVARMGLGKSSSGEPPEFGAAADGDADRNMVLGKRFFVTPSDSVAIIAANAVEAIPYFSAGLKGVARC

SEQ ID NO: 13185 - protein, 583 aa, Citrus clementina
MVMFNVTRKETAPIDGQKPGTSGLRKKVKVFTQPNYLHNFVQSTFNALSAEKVRGATLVVSGDGRYYSKDAIQIITKMAAANGVRRVWIGQNGLLSTPAVSAVIRERVGSDGSKATGAFILTASHNPGGPNEDFGIKYNMDNGGPAPEGITDKIYENTKTINEYSIAEDLPDVDISAAGVTSFGGPEGQFDVEVFDSASDYVKLMKSIFDFEAIRKLLSSPKFTFCYDALHGVAGAYAKRIFVEELGAQESSLLNCTPKEDFGGGHPDPNLTYAKELVARMGLGKSNTQDEPPEFGAAADGDADRNMILGKRFFVTPSDSVAIIAANAVESIPYFSAGLKGVARSMPTSAALDVVAKNLNLKFFEVPTGWKFFGNLMDDGLCSICGEESFGTGSDHIREKDGIWAVLAWLSILAHKNKENLGGGKLVTVEDIVRKHWATYGRHYYTRYDYENVDAGAAKELMANLVKMQSSLPEVNDIVKGICSDVSKVVNADEFEYKDPVDGSISKHQGIRYLFEDGSRLVFRLSGTGSEGATIRLYIEQYEKDPSKTGRDSQEALAPLVEVALKLSKMEQFTGRSAPTVIT

SEQ ID NO: 13186 - protein, 582 aa, Gossypium hirsutum
MVFEVMKVPTTPFEGQKPGTSGLRKKVKVFVQPHYLQNFVQATFNALTPEKVKGATLVVSGDGRYFSKDAVQIIIKMSAANGVRRVWVGQNGLLSTPAVSAVIRERVGADGSKATGAFILTASHNPGGPNEDFGIKYNMENGGPAPEALTDKIFENTKTIKEYLIADELREVDISTIGVTNFSGPDGPFDVEVFDSASDYVKLMKSIFDFELIRKLLSSPKFTFCYDALHGVAGAYANRIFVEELGAQQSSLLNCTPKEDFGGGHPDPNLTYAKELVERMGLGKSNSGVEPPEFGAAADGDADRNMILGKRFFVTPSDSVAIIAANAVGAIPYFSSGLKGVARSMPTSAALDVVAKSLNLKFFEVPTGWKFFGNLMDAGQCSICGEESFGTGSDHIREKDGIWAVLAWLSILAYKNKDNINGDKLVTVEDIVRQHWATYGRHYYTRYDYENVDAGGAKDLMANMVKMMSSLDEVNTIVKGARSDVSKVVNADEFEYKDPVDGSVSKHQGIRFLFEDGSRLVFRLSGTGSEGATIRLYIEQYEKDPSKIGRDSQEALAPLVEVALKLSKMQEFTGRSAPTVIT

SEQ ID NO: 13187 - protein, 582 aa, Arachis hypogaea
MVVFKVSRVQTSPFDGQKPGTSGLRKKVKVFVQPNYLHNFVQATFNALTAEKVRGATLVVSGDGRYFSKDAIQIITKMAAANGVRRVWVGQNGLLSTPAVSCVIRERVGPDGSKATGAFILTASHNPGGPHEDFGIKYNMENGGPAPEGITDKIYKNTTTITEYLIAEDLPDVDISALGVTNFTGPEGPFDVEVFDSATDYVKLMKSIFDFESIRKLLTSPKFSFCYDALHGVAGAYAKRIFVDELGAQENSLLNCVPKEDFGGGHPDPNLTYAKELVARMGLGNSETQGEPPEFGAAADGDADRNMILGKRFFVTPSDSVAIIAANAVEAIPYFSAGLKGVARSMPTSAALDVVAKHLNLKFFEVPTGWKFFGNLMDAGLCSICGEESFGTGSDHIREKDGIWAVLAWLSILAYKNKDKLQDKLVTVEDIVRNHWATYGRHYYTRYDYENVDAGAAKELMAYLVKLQSSLPEVNKIVKGVRSDVSNVVNADEFEYKDPVDGSISSHQGIRYLFEDGSRLIFRLSGTGSEGATIRLYIEQYEKDPSKTGRLSHEALAPLVDVALKLSKMQEYTGRSAPTVIT

SEQ ID NO: 13188 - protein, 583 aa, Euonymus alatus
MVMFKVSRVETTPYDGQKPGTSGLRKKVKVFIQPHYLHNFVQSTFNALSAEKVRGATLVVSGDGRYFSKDAIQIITKMAAANGVRRVWIGQNGLLSTPAVSAVIRERVGVDGSRGTGAFILTASHNPGGPHEDFGIKYNMENGGPAPEGITDKIYENTKTIKEYLIAEDLPDVDIGAIGVTSFSGPEGQFNVEVFDSASDYVKLMKSIFDFESIRKLLASPKFTFCYDALHGVGGAYAKPIFVEELGANESSLLNCTPKEDFGGGHPDPNLTYAKELVARMGLGKLDSKGEPPEFGAAADGDADRNMILGKRFFVTPSDSVAIIAANAVEAIPYFSAGLKGVARSMPTSAALDVVAKHLNLKFFEVPTGWKFFGNLMDAGLCSVCGEESFGTGSDHIREKDGIWAVLAWLSILAHKNKGKLDGDKLVSVEDIVRQHWGTYGRHYYTRYDYENVDAGAAKELMAHLVKLQSSLSEVNDIVKGIRSDVAKVVHADEFEYKDPVDGSISRHQGIRYLFEDGSRLVFRLSGTGSEGATIRLYIEQYEKDPSKTGRESHEALAPLVEVALKLSKLKEFTGRSAPTVIT

SEQ ID NO: 13189 - protein, 582 aa, Flaveria ramosissima
MATFKVNRVESSPIEGQKPGTSGLRKKVKVFTQPHYLHNFVQSTFNALSAEKVKGSTLVVSGDGRYYSKDAIQIIIKMAAANGVRRVWVGQNGLLSTPAVSAVVRERVGADGSKANGAFILTASHNPGGPNEDFGIKYNMENGGPAPEGITDKIYENTKTIKEYFIAEGLPDVDISAIGISSFSGPDGQFDVDVFDSSSDYVKLMKSIFDFQSIKKLIASPQFSFCYDALHGVAGAYAKRIFVEELGAKESSLLNCVPKEDFGGGHPDPNLTYAKELVARMGLGKNPESNPPEFGAAADGDADRNMILGKRFFVTPSDSVAIIAANAVQSIPYFSSGLKGVARSMPTSAALDVVAKSLNLKFFEVPTGWKFFGNLMDAGLCSVCGEESFGTGSDHIREKDGIWAVLAWLSILAHKNKDNLNGGKLVTVEDIVTRHWATFGRHYYTRYDYENVDAGAAKELMAHLVKLQSSISDVNKIIKETRSDVANVASADEFEYKDPVDGSISKNQGIRYLFEDGSRLVFRLSGTGSEGATIRLYIEQYEKDATKIGRDSQEALAPLVEVALKLSKMQEFTGRSAPTVIT

SEQ ID NO: 13190 - protein, 583 aa, Eucalyptus grandis
MVTFQVSRVETAPFDGQKPGTSGLRKKVKVFVQPHYLQNFVQSTFYALSAEKVQGATLVVSGDGRYFSKDAIQIIIKMSAANGVRRVWVGQNGLLSTPAVSAVIRERVGHDGSKATGAFILTASHNPGGPHEDFGIKYNMENGGPAPEAITDKMYENTKTIKEYLIAENLPDVDIAAIGVTSFTGPEGQFDVEVLDSASDYVKLMKSIFDFQAIRKLLSSPNFTFCYDALHGVAGAYANRIFVEELGAQESSLLNCTPKEDFGGGHPDPNLTYAKELVARMGLGKSSPQHEPPEFGAAADGDADRNMVLGKRFFVTPSDSVAIIAANAVEAIPYFSGGLKGVARSMPTSAALDVVAKHLNLKFFEVPTGWKFFGNLMDAGLCSVCGEESFGTGSDHIREKDGIWAVLAWLSILAYKNKENINGGKLVSVEDIVHQHWATYGRHYYTRYDYENVDAGAAKELMAYLVRLQSSLGEVNEIVKGVCSDVSNVVHADEFEYKDPVDGSISKHQGIRYLFEDGSRLIFRLSGTGSEGATIRLYIEQYEKDPSKTGRDSQEALAPLVDVALKLSKMEEFTGRSAPTVIT

SEQ ID NO: 13191 - protein, 582 aa, Flaveria ramosissima
MATFKVNRVESSPIEGQKPGTSGLRKKVKVFTQPHYLHNFVQSTFNALSAEKVKGSTLVVSGDGRYYSKDAIQIIIKMAAANGVRRVWVGQNGLLSTPAVSAVVRERVGADGSKANGAFILTASHNPGGPNEDFGIKYNMENGGPAPEGITDKIYENTKTIKEYFIAEGLPDVDISAIGISSFSGPDGQFDVDVFDSSSDYVKLMKSIFDFQSIKKLIASPQFSFCYDALHGVAGAYAKRIFVEELGANESSLLNCVPKEDFGGGHPDPNLTYAKELVARMGLGKNPDSNPPEFGAAADGDADRNMVLGKRFFVTPSDSVAIIAANAVQSIPYFSSGLKGVARSMPTSAALDVVAKSLNLKFFEVPTGWKFFGNLMDAGLCSVCGEESFGTGSDHIREKDGIWAVLAWLSILAHKNKDNLNGGKLVTVEDIVTLHWATFGRHYYTRYDYENVDAGAAKELMAHLVKLQSSISDVNKIIKETRSDVANVASADEFEYKDPVDGSISKNQGIRYLFEDGSRLVFRLSGTGSEGATIRLYIEQYEKDATKIGRDSQEALAPLVEVALKLSKMQEFTGRSAPTVIT

SEQ ID NO: 13192 - protein, 582 aa, Flaveria ramosissima
MATFKVIRVESSPIEGQKPGTSGLRKKVKVFTQPHYLHNFVQSTFNALSAEKVKGSTLVVSGDGRYYSKDAIQIIIKMAAANGVRRVWVGQNGLLSTPAVSAVVRERVGADGSKANGAFILTASHNPGGPNEDFGIKYNMENGGPAPEGITDKIYENTKTIKEYFIAEGLPDVDISAIGISSFSGPDGQFDVDVFDSSSDYVKLMKSIFDFQSIKKLITSPQFSFCYDALHGVAGAYAKRIFVEELGAKESSLLNCVPKEDFGGGHPDPNLTYAKELVARMGLGKNPDSNPPEFGAAADGDADRNMILGKRFFVTPSDSVAIIAANAVQSIPYFSSGLKGVARSMPTSAALDVVAKSLNLKFFEVPTGWKFFGNLMDAGLCSVCGEESFGTGSDHIREKDGIWAVLAWLSILAHKNKDNLNGGKLVTVEDIVTLHWATFGRHYYTRYDYENVDAGAAKELMAHLVKLQSSISDVNKIIKETRSDVANVANADEFEYKDPVDGSISKNQGIRYLFEDGSRLVFRLSGTGSEGATIRLYIEQYEKDATKIGRDSQEALAPLVEVALKLSKMQEFTGRSAPTVIT

SEQ ID NO: 13193 - protein, 582 aa, Aquilegia formosa
MVFKVSRVETSPIDGQKPGTSGLRKKVKVFKQPHYLHNFVQATFNALSADKVRGATLVVSGDGRYYSKDAIQIIIKMAAANGVRGVWIGQNGLLSTPAVSAVIRERVDANGSKASGGFILTASHNPGGPNEDFGIKYNMENGGPAPEGITDKIYENTKTITEYFIAEDLPDVDISSIGVTSFGGPEGQFDVDVFDSASDYVKLMKSIFDFQSIQKLVTSPKFTLCYDALHGVGGAYANRIFVEELGAQESSLINCTPKEDFGGGHPDPNLTYAKELVARMGLDKSKPQSDPPEFGAAADGDADRNMILGKRFFVTPSDSVAIIAANAVEAIPYFSSGLKGVARSMPTSAALDVVAKHLNLKFFEVPTGWKFFGNLMDAGMCSVCGEESFGTGSDHIREKDGIWAVLAWLSILAFKNKDNLDGKDLVTVEDIVRQHWATFGRHYYTRYDYENVDAGAAKELMANLVKLQSSLPDVNKIIEGIRSDVSEVVQADEFEYKDPVDGSISKHQGIRYLFKDGSRLVFRLSGTGSEGATIRLYIEQYEKDSSKIGRESSEALAPLVEVALKLSKMQEFTGRSAPTVIT

SEQ ID NO: 13194 - protein, 583 aa, Euonymus alatus
MVMFKVSRVESTPYDGQKPGTSGLRKKVKVFIQPHYLQNFVQSTFNALSAEKVRGATLVVSGDGRYFSKDAIQIITKMAAANGVRRVWIGQNGLLSTPAVSAVIRERVGVDGSRGTGAFILTASHNPGGPHEDFGIKYNMENGGPAPEGITDKIYENTKTIKEYLIAEDLPDVDIGTVGVTSFRGPEGQFDVEVFDSASDYVKLMKSIFDFESIRKLLTSPKFSFCYDAMHGVGGAYAEPIFVEELGAQESSLLNCTPKEDFGGGHPDPNLTYAKELVARMGLGKSDSQGEPPEFGAASDGDADRNMILGKRFFVTPSDSVAIIAANAVEAIPYFSAGLKGVARSMPTSAALDVVAKHLNLKFFEVPTGWKFFGNLMDAGLCSVCGEESFGTGSDHIREKDGIWAVLAWLSILAHKNKGKLDGEKFVSVEDIVRQHWATYGRHYYTRYDYENVDAGAAKELMAHLVKLQSSLSEVNDIVKGISSDVSKVVHADEFEYKDPVDGSISKHQGIRYLFEDGSRLVFRLSGTGSEGATIRLYIEQYEKDPSKTGRESHEALAPLVEVALKLSKMLEFTGRSAPTVIT

SEQ ID NO: 13195 - protein, 583 aa, Chelidonium majus
MVMFKVTKVGTTPFVGQKPGTSGLRKKVKVFKQPHYLHNFVQATFNALPADEVKGATIVVSGDGRYFSKDAIQIIIKMAAANGVRGVWVGQNGLLSTPAVSAVIRERVGADGSKASGAFILTASHNPGGPTEDFGIKYNMGNGGPAPEGITDKIYANTTAIKEYFIAEDLPDVDISTVGVTKFGGPEGEFDVDVFDSASDYVKLMKSIFDFESIQKLLASPKFTFCYDALHGVAGAYANRIFVQELGAQESSLINCTPKEDFGGGHPDPNLTYAKELVVRMGLSKDNPQDNPPEFGAAADGDADRNMILGKRFFVTPSDSVAIIAANAVQAIPYFSSGLKGVARSMPTSAALDVVAKHLNLKFFEVPTGWKFFGNLMDAGLCSVCGEESFGTGSDHIREKDGIWAVLAWLSILAFKNKDNLGGDNLVTVEDIVRQHWATFGRHYYTRYDYENVDAGAAKELMANLVNLQSSIPDVNKIIKGIRSDVSDVVQADEFEYKDPVDGSISKHQGIRYLFADGSRLVFRLSGTGSEGATIRLYIEQYEKDSSKIGRESQEALSPLVEVALKLSKMEEFTGRSTPTVIT

SEQ ID NO: 13196 - protein, 582 aa, Helianthus annuus
MANFTVNRVETSPIEGQKPGTSGLRKKVKVFTQPHYLHNFVQSTFNALSAENVKGSTLVVSGDGRYYSKDAIQIIIKMAAANGVRRVWVGQNGLLSTPAVSAVVRERVGADGSKANGAFILTASHNPGGPNEDFGIKYNMGNGGPAPEGITDKIFENTKTIKEYFIAEGLPDVDISAIGVSNFSGPDGQFDVDVFDSSSDYVKLMKSIFDFQSIQKLITSPQFSFCYDALHGVAGAYAKRIFVEELGAKESSLLNCVPKEDFGGGHPDPNLTYAKELVARMGLGKNPDSNPPEFGAAADGDADRNMILGKRFFVTPSDSVAIIAANAVQSIPYFSSGLKGVARSMPTSAALDVVAKSLNLKFFEVPTGWKFFGNLMDAGLCSVCGEESFGTGSDHIREKDGIWAVLAWLSILAHKNKDNLNSGTLVTVEDIVKQHWATFGRHYYTRYDYENVDAGAAKELMAHLVKLQSSISDINETIKGIRSDVANVASADEFEYKDPVDGSISKHQGIRYLFEDGSRLVFRLSGTGSEGATIRLYIEQYEKDSSKTGRDSQEALAPLVEVALKLSKMQEFTGRSAPTVIT

SEQ ID NO: 13197 - protein, 583 aa, Platanus occidentalis
MVMFKVSRVETAPIDGQKPGTSGLRKKVKVFKHPNYLHNFVQSTFNALSADKVKGATIVVSGDGRYFSKDAIQIIIKMAAANGVRRVWVGQNGLLSTPAVSAVIRERVGADGSKATGAFILTASHNPGGPHEDFGIKYNMENGGPAPEAITDKIYENTKSIKEYFIAEDLPDVDISTIGVTSFGGSEGQFDIDVFDSATDYVKLMKSIFDFESIQKLLASPKFTFCYDALHGVAGAYAKRIFVEELGADESSLMNCTPKEDFGGGHPDPNLTYAKELVARMGLGKTSPQHEPPEFGAAADGDADRNMVLGKRFFVTPSDSVAIIAANAVQAIPYFSAGLKGVARSMPTSAALDVVAKHLNLKFFEVPTGWKFFGNLMDAGLCSVCGEESFGTGSDHIREKDGIWAVLAWLSILALKNKDNLNGEKLVTVEEIVCQHWGTYGRHYYTRYDYENVDADAAKELMAYLVKLQSSLPDVNKIIKGIRPDVSDVVQADEFEYKDPVDGSISKHQGIRYLFKDGSRLVFRLSGTGSEGATIRLYIEQYEKDSSKTGRDSQEALAPLVEVALKLSKMQEFTSRSAPTVIT

SEQ ID NO: 13198 - protein, 582 aa, Flaveria ramosissima
MANFKVTRVESSPIEGQKPGTSGLRKKVKVFTQPHYLHNFVQSTFNALSAEKVKGSTLVVSGDGRYYSKEAIQIIIKMAAANGVRRVWVGQNGLLSTPAVSAVVRERVGADGSKANGAFILTASHNPGGPNEDFGIKYNMENGGPAPEGITDKIFENTKTIKEYFISEDLPDVDISAIGISNFSGPDGQFDVDVFDSASDYVKLMKSIFDFQSIQKLIASPQFSFCYDALHGVAGAYAKRIFVEELGAKESSLLNCVPKEDFGGGHPDPNLTYAKELVARMGLGKNPDSNPPEFGAAADGDADRNMILGKRFFVTPSDSVAIIAANAVQAIPYFSSGLKGVARSMPTSAALDVVAKSLNLKFFEVPTGWKFFGNLMDAGLCSVCGEESFGTGSDHIREKDGIWAVLAWLSILAYKNKDNLNGGNLVTVEDIVKQHWATFGRHYYTRYDYENVDAGAAKEVMAHLVKLQSSISDVNNTIKGMRSDVADVVSADEFEYKDPVDGSVSKNQGIRYLFEDGSRLVFRLSGTGSEGATIRLYIEQYEKDSSKTGRDSQEALAPLVDVALKLSKMKEYTGRSAPTVIT

SEQ ID NO: 13199 - protein, 584 aa, Lippia dulcis
MVMFTVSRVETTPFDGQKPGTSGLRKKVKVFKEPHYLQNFVQATFNALGADKVRGATLVVSGDGRYFSKDAVQIIIKMSAANGVRRIWVGQNGLLSTPAVSAVIRERVGADGSKANGAFILTASHNPGGPTEDFGIKYNMENGGPAPEGITNKIFENTTTIKEYLIAEGLPDVDISTIGVTSFAGPEGQFDVDVFDSASDYVKLMKSIFDFQSIQKLLSSPKFTFCYDALHGVAGAYAKRIFVEELGAQESSLLNCVPKEDFGGGHPDPNLTYAKELVARMGLSKEKSEQDPPEFGAAADGDADRNMILGKRFFVTPSDSVAIIAANAVEAIPYFSGGLKGVARSMPTSAALDVVAKSLNLKFFEVPTGWKFFGNLMDAGMCSICGEESFGTGSDHIREKDGIWAVLAWLSILAYKNKDSLGGGEKLVSVEDIVRSHWSRYGRHYYTRYDYENVDAGAAKELMAYLVKLQSDLAEVNDIIKGIRSDVSKVVNADEFEYKDPVDGSISKHQGIRYLFEDGSRLVFRLSGTGSEGATIRLYIEQYENDASKTGRDSQEALAPLVDVALKLSKMQEFTGRSTPTVIT

SEQ ID NO: 13200 - protein, 582 aa, Trigonella foenum-graecum
MVLFNVSRIETTPFDGQKPGTSGLRKKVKVFVQPHYLENFVQASFNALTEEKVRGATLVVSGDGRYYSEQAIQIITKMAAANGVRRIWVGLNGMLSTPAVSAVIRERVGVDGSKATGAFILTASHNPGGPNEDFGIKYNMENGGPAPEGITNKIYEYTTTIKEYLIAPDLPNVDITTAGVTNFTGPEGPFDVEVFDSASDYIKLMKSIFDFGSIRKLLSSPKFTFCYDALHGVAGAYAKRIFVDELGAQESSLLNCVPKEDFGGGHPDPNLTYAKELVARMGLGKSESQGEPPEFGAAADGDADRNMILGKRFFVTPSDSVAIIAANAVEAIPYFSAGLKGVARSMPTSAALDVVAKHLNLKFFEVPTGWKFFGNLMDAGLCSVCGEESFGTGSDHIREKDGIWAVLAWLSILAYKNKDNLEDKLVTVEDIVRQHWAKYGRHYYTRYDYENVDAGAAKELMAHLVKLQSSLSEVNGIVKGASSDVSNVVHGDEFEYNDPVDGSISSHQGIRYLFEDGSRLIFRLSGTGSEGATIRLYIEQYEKDPSKIGRLSHEALAPLVEAALKLSKMEEFTGRSAPTVIT

SEQ ID NO: 13201 - protein, 583 aa, Vitis vinifera
MVMFKVSRVTTSPFDGQKPGTSGLRKKVKVFKQQNYLHNFVQSTFNALSQDKIRGMTLVVSGDGRYFSKDAIQIIIKMAAANGVRSVWVGQNGLLSTPAVSAVIRERVGKDGTKASGAFILTASHNPGGPNEDFGIKYNMENGGPAQEAITDKIYENTKSIKEYIIAEDLPDVDISAIGITNFTGPEGQFDVEVFDSAFDYVKLMKSIFDFQSIQKLLSSPKFTFCYDALHGVGGAYAKRIFVEELGAQESSLLNCVPKEDFGGGHPDPNLTYAKELVACMGLGKSDAKNEPPEFGAASDGDADRNMILGKRFFVTPSDSVAIIAANAVDAIPYFSAGLKGVARSMPTSAALDVVAKHLNLKFFEVPTGWKFFGNLMDAGLCSICGEESFGTGSDHIREKDGIWAVLAWLSILAYENKENLGGAKLVTVEEIVRNHWATYGRHYYTRYDYENVDAGAAKELMAYLVKLQSSLPEVNKIIKGIHSDVSNVAKADEFEYKDPVDGSISKHQGIRYMFEDGSRLIFRLSGTGSEGATIRVYIEQYEKDSSKTGRDSQEALGPLVEVALKLSKMQEFTGRSAPTVIT

SEQ ID NO: 13202 - protein, 582 aa, Amsonia hubrichtii
MVFKVVRVETKPFDGQKPGTSGLRKKVKVFTQPHYLQNFVQSTFNALGADKVRGATLVVSGDGRYYSKDAIQIIIKMSAANGVRRVWVGQNGLLSTPAVSCVVRERVGADGSKATGAFILTASHNPGGPHEDFGIKYNMENGGPAPESVTNKIYENTTTIKEYLIAEELPDVDISTIAVSSFAGPEGQFDVDVFDSTSDYVKLMKSIFDFQSIQKLLSSSNFTFCYDALHGVAGVYAKRIFVEELGAQESSLLNCVPKEDFGGGHPDPNLTYAKELVECMGLGKTNNGKEPPEFGAAADGDADRNMILGKRFFVTPSDSVAIIAANAVEAIPYFSGGLKGVARSMPTSAALDVVAQHLKLKFFEVPTGWKFFGNLMDAGMCSVCGEESFGTGSDHIREKDGIWAVLAWLSILAYKNKDSLGGGKLVSVEDIVRQHWATYGRHYYTRYDYEGVDAGGAKELMAHLVKLQSSLSEVNKIIKGIRSDVANVVNADEFEYKDPVDGSISKNQGIRYMFEDGSRLVFRLSGTGSEGATIRLYIEQYEKDSSKIGRDSQDALAPLVEVALKLSKMQEFTGRSAPTVIT

SEQ ID NO: 13203 - protein, 582 aa, Cirsium arvense
MATFKVTRVETSPIEGQKPGTSGLRKKVKVFMQPHYLHNFVQSTLNALSAEKVKGSTLVVSGDGRYYSKDAVQIIIKMAAANGVRRVWVGLNSLMATPAVSAIVRERVGADGSKANGAFILTASHNPGGPNEDFGIKYNMGNGGPAPEGVTDKIFENTKTIKEYFIAEGLPDVNISAVGISNFSGPDGQFDVDVFDSADDYVKLLKSIFDFQSIKKLVTSPQFSFCYDALSGVAGAYAKRIFVEELGAKESSLLNCVPKEDFGGGHPDPNLTYAKELVARMGLGKTPDSNPPEFGAAADGDADRNMILGKRFFVTPSDSVAIIAANAVQAIPYFSSGLKGVARSMPTSAALDVVAKHLNLKFFEVPTGWKFFGNLMDAGLCSVCGEESFGTGSDHIREKDGIWAVLAWLSILAFKNKDSLSGGKLVTVEDIVKQHWATFGRHYYTRYDYENVDAGAAKDLMAHLVKLQSSISDVNKTIKGIRSDVANVASADEFEYKDPVDGSVSKNQGIRYLFEDGSRLVFRLSGTGSEGATIRLYIEQYEKDSSKTGRDSQEALGPLVDVALKLSKMQEFTGRSAPTVIT

SEQ ID NO: 13204 - protein, 581 aa, Valeriana officinalis
MVMFKVSRVETAPIDGQKPGTSGLRKKVKVFTQPHYLHNFVQATLNALSADKVRGATLVVSGDGRYYSKDAIQIIIKMAAANGVRRVWVGLNGLMSTPAVSAVIRERVGHDGSKANGAFILTASHNPGGPNEDFGIKYNMENGGPAPEGITDKIYENTTTIKEYFLAEDLPDVDISAVGVTSFQGPEGQFDVDVFDSAIEYVKLMKSIFDFQSIQKLLSSPKFTFCYDALHGVAGAYAKRIFVEELGAKESSLLNCVPKEDFGGGHPDPNLTYAKELVQRMGLGKSAEQDPPEFGAAADGDADRNMVLGKRFFVTPSDSVAIIAANAVQAIPYFSSGLKGVARSMPTSAALDVVAKHLNLKFFEVPTGWKFFGNLMDAGMCSVCGEESFGTGSDHIREKDGIWAVLAWLSIIAYKNKASLSSDSKLVTVEDIVRQHWAKYGRHYYTRYDYENVDAGAAKELMTNLIQQQSSLGEVNKTIKGIRSDVSNVASADEFEYKDPVDGSVSKHQGVRYLFEDGSRLVFRLSGTGSEGATIRLYIEQFEKDPSGRESQDVLAPLVEVALKLSKMQELTGRSAPTVIT

SEQ ID NO: 13205 - protein, 582 aa, Mimulus guttatus
MVMFKVSRVETTPFDGQKPGTSGLRKKVKVFVQPHYLENFVQSTFNALGADKVTGATLVVSGDGRYYSKDAIQIIIKMAAANGVRRIWVGQNGLLSTPAVSAVIRERVGADGSKATGAFILTASHNPGGPTEDFGIKYNMENGGPAPEGITDKIYSNTTTIKEYLIAEGLPDVDISITGVTSFAGPEGQFDVDVFDSASDYVKLMKSIFDFQAIQKLISSPKFSFCYDALHGVGGAYAKPIFVDELGAQESSLLNCVPKEDFGGGHPDPNLTYAKELVARMGLGKTSTEEPPEFGAAADGDADRNMVLGKRFFVTPSDSVAIIAANAVQSIPYFSGGLKGVARSMPTSAALDVVAKNLNLKFFEVPTGWKFFGNLMDAGMCSVCGEESFGTGSDHIREKDGIWAVLAWLSILAYKNKDNLGGEKLVSVEDIVRQHWSTYGRHYYTRYDYENVDAASAKELMAYLVKLESSLSEVNDIIKGIRSDVSKVVHADEFEYKDPVDGSISKHQGIRYLFEDGSRLVFRLSGTGSEGATIRLYIEQYEQDPSKIGRESQDALAPLVEVALKLSKMQEFTGRSAPTVIT

SEQ ID NO: 13206 - protein, 583 aa, Triphysaria pusilla
MVVFKVARVETTPFDGQKPGTSGLRKKVKVFKQPHYLENFVQATLNALGADKVRGATLVVSGDGRYYSKDAIQIIIKMAAANGVRRIWVGLNGLMSTPAVSAVIRERVGADGSKANGSFILTASHNPGGPNEDFGIKYNMENGGPAPEGITDKIYANTTTIKEYLIAEGLPDVDISITGVTTFSGPEGQFDVDVFDSANDYVKLMKSIFDFQSIQKLIASPKFSFCYDALHGVAGAYAKRIFVEELGADENSLLNCVPKEDFGGGHPDPNLTYAKELVARMGLGKTNSADEPPEFGAAADGDADRNMVLGKRFFVTPSDSVAIIAANAVQAIPYFSGGLKGVARSMPTSAALDVVAKNLNLKFFEVPTGWKFFGNLMDAGMCSVCGEESFGTGSDHIREKDGIWAVLAWLSILAYKNKDNLGGDKLVSVEDIVRQHWSTYGRHYYTRYDYENVDAGKAKDLMAYLVQLQSNLSEVNNIIKGIRPDVAKVVNADEFEYKDPVDGSISKHQGIRYLFEDGSRLVFRLSGTGSEGATIRLYIEQYEQDPSKIGRDSQEALAPLVEVALKLSKMQEYTGRSAPTVIT

SEQ ID NO: 13207 - protein, 582 aa, Ambrosia trifida
MANFTVKRVDTSPIEGQKPGTSGLRKKVKVFTQPHYLHNFVQSTFNALSAEKVKGSTLVVSGDGRYYSKDAIQIIIKMAAANGVRRVWVGQNGLLSTPAVSAVVRERVGADGSKANGAFILTASHNPGGPNEDFGIKYNMGNGGPAPEGITDKIFENTKTIKEYFIAEGLPDVDISAIGVSNFSGPAGQFDVDVFDSASDYVKLMKSIFDFQSIKKLIASPQFSFCFDALHGVGGAYAKRMFVEELGAKESSLLNCVPKEDFGGGHPDPNLTYAKELVARMGLGSNPDSNPPEFGAAADGDADRNMILGKRFFVTPSDSVAIIAANAVQAIPYFSSGLKGVARSMPTSAALDVVAKSLNLKFFEVPTGWKFFGNLMDAGLCSICGEESFGTGSDHIREKDGIWAVLAWLSILAHKNKDNLDGGKLVTVEDIVKQHWATFGRHYYTRYDYENVDAGAAKEVMTHLVDLQSSISGVNTTIKGIRSDVADVISADEFEYKDPVDGSVSKNQGIRYLFEDGSRLVFRLSGTGSEGATIRLYIEQYEKDSSKTGRDSQEALAPLVDVALKLSKMLEYTGRSAPTVIT

SEQ ID NO: 13208 - protein, 582 aa, Centaurea maculosa
  misc_feature (421)..(421): Xaa can be any naturally occurring amino acid
MATFKVNRVETTPIEGQKPGTSGLRKKVKVFMQPHYLHNFVQSTLNALSAEKVKGSTLVVSGDGRYYSKDAIQIIIKMAAANGVRRVWVGLNGLMATPAVSAIVRERVGADGSKANGAFILTASHNPGGPTEDFGIKYNMGNGGPAPEGVTDKIFENTKTIKEYFIAEGLPDVNISAVGISNFSGPDGQFDVDVFDSADDYVKLLKSIFDFESIKKLIASPQFSFCYDALSGVAGAYAKRIFVEELGAKESSLLNCVPKEDFGGGHPDPNLTYAKELVARMGLGKTPDSNPPEFGAAADGDADRNMILGKRFFVTPSDSVAIIAANAVQAIPYFSSGLKGVARSMPTSAALDVVAKHLNLKFFEVPTGWKFFGNLMDAGLCSVCGEESFGTGSDHIREKDGIWAVLAWLSILAFKNKDSLXGGKLVTVEDIVKQHWATFGRHYYTRYDYENVDAGAAKDLMAHLVKLQSSLSDVNKTIKGIRSDVANVASADEFEYKDPVDGSVSKNQGIRYLFEDGSRLVFRLSGTGSEGATIRLYIEQYEKDSSKTGRESQEALGPLVEVALKLSKMQEFTGRSAPTVIT

SEQ ID NO: 13209 - protein, 582 aa, Populus trichocarpa
MVLFNVSRVETTPFDGQKPGTSGLRKKVKVFKQPNYLENFVQSTFNALTPQKVRGATLVVSGDGRYFSKDAIQIIMKMAAGNGVRRVWVGQNGLLSTPAVSAVIRERVGVDGSRATGAFILTASHNPGGPNEDFGIKYNMENGGPAPEGITDEIYENTKAIKEYLTADLPAVDITAIGVTSFGGPDGQFDVEVFDSASDYVKLMKSIFDFESIQKLLSSPNFTFCYDALHGVAGAYAKRIFVEELGAQESSLMNCVPKEDFGGGHPDPNLTYAKELVARMGLGKSNSEVEPPEFGAAADGDADRNMILGKRFFVTPSDSVSIIAANAVEAIPYFSAGLKGVARSMPTSSGLDIVAKNLNLKFFEVPTGWKFFGNLMDAGLCSICGEESFGTGSDHIREKDGIWAVLAWLSILAFKNKENLGGGELVTVEDIVRNHWATYGRHYYTRYDYENVDAGAAKELMAYLVKLQSSLAEVNEIVGGIRSDVSKVVHADEFEYKDPIDGSISKHQGIRYLFEDGSRLVFRLSGTGSEGATIRLYIEQYEKDPSKTGRDSQDALAPLVAVALGLSKMQEFTGRSAPTVIT

SEQ ID NO: 13210 - protein, 582 aa, Arnica chamissonis
MASFKVNRVESSPIEGQKPGTSGLRKKVKVFTQPHYLQNFVQSTFNALSAEKVKGSTLVVSGDGRYYSKDAIQIIIKMAAANGVRRVWVGQNGLLSTPAVSAVVRERVGADGSKADGAFILTASHNPGGPSEDFGIKYNMGNGGPAPEGITDKIFENTKTIKEYFIAEGLPEVDISAIGISNFSGPDGQFDVDVFDSSSDYVKLMKSIFDFQSIQKLIASPQFSFCYDALHGVAGAYAKCIFVEELGAKENSLLNCVPKEDFGGGHPDPNLTYAKELVARMGLGKNPDSNPPEFGAAADGDADRNMILGKRFFVTPSDSVAIIAANAVQSIPYFSSGLKGVARSMPTSAALDVVAKSLNLKFFEVPTGWKFFGNLMDAGLCSVCGEESFGTGSDHIREKDGIWAVLAWLSILAYKNKDNLNGGNLVTVEDIVKQHWATFGRHYYTRYDYENVDAGAATELMAHLVKLQSSISDVNQTIKGIRSDVANIASADEFEYKDPVDGSISKNQGIRYLFEDGSRLVFRLSGTGSEGATIRLYIEQYEKDSSKTGRDSQDALAPLVEVALKLSKMQEFTGRSAPTVIT

SEQ ID NO: 13211 - protein, 582 aa, Cynara scolymus
  misc_feature (410)..(410): Xaa can be any naturally occurring amino acid
MATFKVNRVESSPIEGQKPGTSGLRKKVKVFTQPHYLHNFVQSTFNALSAEKVKGSTLVVSGDGRYFSKDAIQIIIKMAAANGVRRVWVGLNGLMATPAVSAIVRERVGADGSKANGAFILTASHNPGGPNEDFGIKYNMGNGGPAPEGITDKIFENTKTIKEYFIAEGLPDVDISAIGISNFSGPDGQFDVDVFDSASDYVKLLKSIFDFQFIQKLVTSPQFSFCYDALSGVAGAYAKRIFVEELGAKESSLLNCVPKEDFGGGHPDPNLTYAKELVARMGLGKNPDSNPPEFGAAADGDADRNMILGKRFFVTPSDSVAIIAANAVQAIPYFSSGLKGVARSMPTSAALDVVAKHLNLKFFEVPTGWKFFGNLMDAGLCSVCGEESFGTGSDHIREKDGIWAVLAWLXILAFKNKDSLNGGKLVTVEDIVKQHWATFGRHYYTRYDYENVDAGAAKELMAHLVKLQSSLGEVNKTIKGIRSDVANVANADEFEYKDPVDGSVSKNQGIRYLFEDGSRLVFRLSGTGSEGATIRLYIEQYEKDSSKTGRDSQEALGPLVEVALKLSKMQEFTGRSAPTVIT

SEQ ID NO: 13212 - protein, 582 aa, Glycine max
MVLFNVSRVETTPFDGQKPGTSGLRKKVKVFVQPHYLHNFVQSTFNALTVEKVRGATLVVSGDGRYFSKEAIQIITKMSAANGVRRVWIGQNGLLSTPAVSAVIRERVGADGSRATGAFILTASHNPGGPHEDFGIKYNMENGGPAPEGITDKIYENTTTINEYLIASDLPDVDITTTGVTSFTGPEGPFDVEVFDSASDYIKLMKSIFDFESIRKLLSSPKFTFCYDALHGVGGAYAKSIFVDELGAQESSLLNCTPKEDFGGGHPDPNLTYAKELVARMGLGKSEPQDDPPEFGAASDGDADRNMILGKRFFVTPSDSVAIIAANAVEAIPYFSAGLKGVARSMPTSAALDVVAKHLNLKFFEVPTGWKFFGNLMDAGLCSVCGEESFGTGSDHIREKDGIWAVLAWLSILAYKNKDKLEDKLVTVEDIVRQHWATYGRHYYTRYDYENVDAGAAKELMAYLVKLQSSLSEVNQIIKGIRSDVSNVVHGDEFEYNDPVDGSISSHQGIRYLFEDGSRLIFRLSGTGSEGATIRLYIEQYEKDPSKIGRLSNEALAPLVEVALKLSKMEEFTGRSAPTVIT

SEQ ID NO: 13213 - protein, 579 aa, Ambrosia trifida
MANFTVNRVETSPIEGQKPGTSGLRKKVKVFTQPHYLHNFVQSTFNALSAESVKGSTLVVSGDGRYYSKDAIQIIIKMAAANGVRSVWVGQNGLLSTPAVSAVVRERVGADGAKANGAFILTASHNPGGPNEDFGIKYNMGNGGPAPEGITDKIFENTKTIKEYFIAEGLPDVDISAIGISNFSGPDGQFDVDVFDSSSDYVKLMKSIFDFQSIQKLITSPQFSFCYDALHGVAGAYANRIFVEELGAKESSLLNCVPKEDFGGGHPDPNLTYAKELVARMGLGKNPDSNPPEFGAAADGDADRNMILGKRFFVTPSDSVAIIAANAVQSIPYFSSGLKGVARSMPTSAALDVVAKSLNLKFFEVPTGWKFFGNLMDAGLCSVCGEESFGTGSDHIREKDGIWAVLAWLSILAHKNKDNLNGGNLVTVEDIVKQHWATFGRHYYTRYDYENVDAGAAKELMAHLVELQSSISDVNKIIKEIRPDVANVASADEFEYKDPVDGSISKHQGIRYLFEDGSRLVFRLSGTGSEGATIRLYIEQYEKDSSKTGRDSQEALAPLVEVALKLSKMQEFTGRSAPM

SEQ ID NO: 13214 - protein, 582 aa, Vinca minor
MVFKVVRVETKPFDGQKPGTSGLRKKVKVFTQPHYLENFVQSTFNALGADKVRGATLVVSGDGRYYSKDAIQIIIKMSAANGVRRVWVGQNGLLSTPAVSCVVRERVGADGSKGTGAFILTASHNPGGPHEDFGIKYNMENGGPAPESVTNKIYENTTTIKEYLIAEGLPDVDICTIAVSDFAGPEGQFDVDVFDSASDYLKLMKSIFDFQSIQKFLSSPNFTFCFDALHGVAGAYAKRIFVEELGAKESSLLNCVPKEDFGGGHPDPNLTYAKELVQCMGLGKTDGGKEPPEFGAAADGDADRNMVLGKRFFVTPSDSVAIIAANAVDTIPYFSSGLKGVARSMPTSAALDVVAKHLDLKFFEVPTGWKFFGNLMDAGMCSVCGEESFGTGSDHIREKDGIWAVLAWLSILAYKNKDNLGGGKLVTVEDIVRQHWATYGRHYYTRYDYEGVDAGGAKELMAHLVKLQSSLSEVNKMIKDIRPDVANVASADEFEYKDPVDGSISKNQGIRYMFEDGSRLVFRLSGTGSEGATIRLYIEQYEKDSSKTGRDSQDALAPLVEVALKLSKMQEFTGRSSPTVIT

SEQ ID NO: 13215 - protein, 582 aa, Vinca minor
MVFKVVRVETKPFDGQKPGTSGLRKKVKVFTQPHYLENFVQSTFNALGADKVRGATLVVSGDGRYYSKDAIQIIIKMSAANGVRRVWVGQNGLLSTPAVSCVVRERVGADGSKATGAFILTASHNPGGPNEDFGIKYNMENGGPAPESVTNKIYENTTTINEYLIAEGLPDVDISTIAVSNFAGPEGQFDVDVFDSANDYLKLMKSIFYFQSIQKLLSSPNFTFCYDALHGVAGAYAKRIFVEELGAKESSLLNCVPKEDFGGGHPDPNLTYAKELVECMGLGKTYSGKEPPEFGAAADGDADRNMVLGKRFFVTPSDSVAIIAANAVEAIPYFSSGLKGVARSMPTSAALDVVAKNLDLKFFEVPTGWKFFGNLMDAGMCSVCGEESFGTGSDHIREKDGIWAVLAWLSILAYKNKDNLGGGKLVTVEEIVRQHWATYGRHYYTRYDYEGVDAGGAKELMVHLVKLQSSLSEVNKMIKDVRPDVANVATADEFEYKDPVDGSISKNQGIRYMFEDGSRLVFRLSGTGSEGATIRVYIEQYEKDSSKIGRDSQDALAPLVEVALKLSKMQEFTGRSAPTVIT

SEQ ID NO: 13216 - protein, 582 aa, Lactuca sativa
MATFKVKRVESSPIEGQKPGTSGLRKKVKVFTQPHYLHNFVQSTFNALSAEKIKGSTLVVSGDGRYYSKDAIQIIIKMAAANGARRIWVGQNGLLSTPAVSAVVRERVGADGSKANGAFILTASHNPGGPNEDFGIKYNMENGGPAPEGVTDKIFENTKTIKEYFIAEGLPDVDISAIGVSSFSGPDGQFDVDVFDAASDYVKLMKSIFDFQAIQKLIACPQFSFCYDALHGVAGAYASRIFVEELGAKESSLLNCVPKEDFGGGHPDPNLTYAKELVARMGLGKTPDSNPPEFGAAADGDADRNMVLGKRFFVTPSDSVAIIAANAVQSIPYFSSGLKGVARSMPTSAALDVVAKSLNLKFFEVPTGWKFFGNLMDAGLCSVCGEESFGTGSDHIREKDGIWAVLAWMSILAYKNKDNLTSGKLVTVEDIVKQHWAKFGRHYYTRYDYENVDAGAAKELMAHLVKLQSSLGEVNKLIKGVRSDVANVASADEFEYKDPVDGSVSKNQGIRYLFEDGSRLVFRLSGTGSEGATIRLYIEQYEKDSSKTGRDSQEALSPLVEVALKLSKMQEFTGRDAPTVIT

SEQ ID NO: 13217 - protein, 582 aa, Prunus persica
MQSGQVKRVETTPFEGQKPGTSGLRKKVKVFTQPHYLQNFVQSTFNALPADKVKGARIVVSGDGRYYSKEAIQIIIKMAAGNGVRSVWVGQNGLLSTPAVSAVVRERVGADGSKASGAFILTASHNPGGPNEDFGIKYNMENGGPAPESITDKIYENTTKIKEYLTVELPDVDIAKVGVTTFSVDGGTFDVDVFDSASDYVKLMKSIFDFEFIRKLLSSPKFTFCYDALHGVAGAYAKRIFVEELGAKESSLLNCVPKEDFGGGHPDPNLTYAKELVARMGLGKSTTQDEPPEFGAAADGDADRNMILGKRFFVTPSDSVAIIAANAVEAIPYFSAGLKGVARSMPTSAALDVVAQHLNLKFFEVPTGWKFFGNLMDAGLCSVCGEESFGTGSDHIREKDGIWAVLAWLSILAYKNKENLGGEKLVSVEDIVRQHWATFGRHYYTRYDYENVDAGAAKELMASLVKLQSSLSEVNQIVKGIRSDVSSVVNADEFEYKDPVDGSISKHQGIRYLFEDGSRLVFRLSGTGSEGATIRLYIEQYEKDPSKIGRESQEALGPLVEVALKLSKMQEFTGRSAPTVIT

SEQ ID NO: 13218 - protein, 582 aa, Glycine max
MVLFNVSRVETTPFDGQKPGTSGLRKKVKVFVQPHYLHNFVQSTFNALTVEKVRGATLVVSGDGRYFSKEAIQIITKMSAANGVRRVWIGQNGLLSTPAVSAVIREKLGADGSRATGAFILTASHNPGGPNEDFGIKYNMENGGPAPEGITDKIYENTTTINEYLIASDLPDVDITSTGVTSFTGPGGPFDVEVFDSASDYIKLMKSIFDFESIRKLLSSPKFTFCYDALHGVGGAYAKSIFVDELGAQESSLLNCTPKEDFGGGHPDPNLTYAKELVARMGLGKSEPQEEPPEFGAASDGDADRNMVLGKRFFVTPSDSVAIIAANAVEAIPYFSAGLKGVARSMPTSAALDVVAKHLNLKFFEVPTGWKFFGNLMDAGLCSVCGEESFGTGSDHIREKDGIWAVLAWLSILAYKNKDKLEDKLVTVEDIVRQHWATYGRHYYTRYDYENVDAGAAKELMAYLVKLQSSLSEVNQIVKGIRSDVSNVVHGDEFEYNDPVDGSISSHQGIRYLFEDGSRLIFRLSGTGSEGATIRLYIEQYEKDPSKIGRLSNEALAPLVEVALKLSKMEEFTGRSAPTVIT

SEQ ID NO: 13219 - protein, 582 aa, Vigna unguiculata
MVLFNVSRVDTTPFDGQKPGTSGLRKKVKVFVQPHYLHNFVQASFNALTEEKVRGATLVVSGDGRYFSKEAIQIITKMSAANGVRRVWIGQNGLLSTPAVSAVIRERVGADGSKATGAFILTASHNPGGPDEDFGIKYNMENGGPAPEGITNKIYEFTTTIKEYLIAADLPDVDITTTGVTNFTGPEGPFDVEVFDSASDYIKLMKSIFDFESIKKLLSSPKFTFCYDALHGVAGAYAKSIFVDELGAQESSLLNCTPKEDFGGGHPDPNLTYAKELVARMGLGKSEPQDEPPEFGAAADGDADRNMVLGKRFFVTPSDSVAIIAANAVDAIPYFSTGLKGVARSMPTSAALDVVAKHLNLKFFEVPTGWKFFGNLMDAGLCSVCGEESFGTGSDHIREKDGIWAVLAWLSILAYKNKDKLEDKLVTVEDIVRQHWATYGRHYYTRYDYENVDAGAAKELMAYLVKLQSSLSEVNEIINGVRSDVSKVSNADEFEYKDPVDGSVSSHQGIRYLFEDGSRLIFRLSGTGSEGATIRLYIEQYEKDPSKIGRLSNEALAPLVEVALKLSKMEEFTGRSAPTVIT

SEQ ID NO: 13220 - protein, 582 aa, Medicago truncatula
MVLFNVSRIETTPFDGQKPGTSGLRKKVKVFVQTHYLENFVQASFNALTEEKVRGATLVVSGDGRYYSEQAIQVITKMAAANGVRRIWVGLNGLLSTPAVSAVIRERVGVDGSKATGAFILTASHNPGGPNEDFGIKYNMENGGPAPEGITNKIYEYTTTIKEYLIAPDLPNVDITTVGVTNFTGPEGPFDVEVFDSASDYIKLMKSIFDFGSIRKLLSSPKFTFCFDGLHGVAGAYAKRIFVDELGAQESSLLNCVPKEDFGGGHPDPNLTYAKELVARMGLGKSESEGEPPEFGAAADGDADRNMILGKRFFVTPSDSVAIIAANAVEAIPYFSAGLKGVARSMPTSAALDVVAKHLNLKFFEVPTGWKFFGNLMDAGLCSVCGEESFGTGSDHIREKDGIWAVLAWLSILAYKNKDNIEDKLVTVEDIVRQHWAKYGRHYYTRYDYENVDAGAAKELMAHLVKLQSSLSEANGIVKGASSDVSNVVHGDEFEYNDPVDGSISSHQGIRYLFEDGSRLIFRLSGTGSEGATIRLYIEQYEKNPSKIGRLSHEALAPLVEAALKLSKMEEFTGRSAPTVIT

SEQ ID NO: 13221 - protein, 578 aa, Cirsium arvense
KVNRVESSPIEGQKPGTSGLRKKVKVFMQPHYLHNFVQSTFNALSAEKVKGSTLVVSGDGRYFSKDAIQIIIKMAAANGVRRIWVGLNGLMATPAVSAIVRERVGADGSKANGAFILTASHNPGGPTEDFGIKYNMGNGGPAPEGITDKIFENTKTIKEYFIAEGLPDVNISAIGISNFSGPDGQFDVDVFDSAIDYVKLLKSIFDFQSIQKLITSPQFSFCYDALSGVAGAYAKRIFVEELGAKESSLLNCVPKEDFGGGHPDPNLTYAKELVARMGLGKTPDSNPPEFGAAADGDADRNMILGKRFFVTPSDSVAIIAANAVQAIPYFSSGLKGVARSMPTSAALDVVAKHLNLKFFEVPTGWKFFGNLMDAGLCSVCGEESFGTGSDHIREKDGIWAVLAWLSILAFKNKDSLNGGKLVTVEDIVKQHWATFGRHYYTRYDYENVDAGAAKDLMAHLVKLQSNLSEVNKTIKGIRSDVANVASADEFEYKDPVDGSVSKNQGIRYLFEDGSRLVFRLSGTGSEGATIRLYIEQYEKDPSKTGRDSQEALGPLVEVALKLSKMQEFTGRSAPTVIT

SEQ ID NO: 13222 - protein, 583 aa, Eucalyptus grandis
MVTFTVSRVETAPIDGQKPGTSGLRKKVKVFVQPHYLQNFVQSTFYALSAEKVRGATLVVSGDGRYYSKDAIQIILKMAAANGVRRVWVGQNGLLSTPAVSAVIRERTGHDGARASGAFILTASHNPGGPHEDFGIKYNMENGGPAPEGITDKIYENTKTIKEYLIAEDLPNVDITTLGVTSFTGPEEPFDVEVFDSAVDYVKLMKSIFDFQLISKLLSCPKFSFCYDALHGVAGAYAKRIFVEELGANEGFLLNCTPKEDFGGGHPDPNLTYAKELVARMGLGKSAPENEPPEFGAAADGDADRNMILGKRFFVTPSDSVAIIAANAVEAIPYFSGGLKGVARSMPTSAALDVVAQHLNLKFFEVPTGWKFFGNLMDAGLCSVCGEESFGTGSDHIREKDGIWAVLAWLSILAYKNKENLSGEKLVSVEDIVRQHWVTYGRHYYTRYDYENVDSGAAKELMGYLVQLQSSLSEVNQIVKGVCPDASNVVHADEFEYKDPVDGSISKHQGIRYLFEDGSRLVFRLSGTGSEGATIRLYIEQYEKDPAKTGRDSQEALAPLVEVALKLSKMQEFTGRSAPTVIT

SEQ ID NO: 13223 - protein, 574 aa, Flaveria ramosissima
VESSPIEGQKPGTSGLRKKVKVFTQPHYLHNFVQSTFNALSAEKVKGSTLVVSGDGRYYSKEAIQIIIKMAAANGVRRVWVGQNGLLSTPAVSAVVRERVGADGSKANGAFILTASHNPGGPNEDFGIKYNMENGGPAPEGITDKIFENTKTINEYFIAEDLPDVDISAVGISNFSGPDGQFDVDVFDSASDYVKLMKSIFDFQSIQRLIASPQFSFCYDALHGVAGAYARRIFVEELGAKESSLLNCVPKEDFGGGHPDPNLTYAKELVARMGLGKNPDSNPPEFGAAADGDADRNMILGKRFFVTPSDSVAIIAANAVQAIPYFSSGLKGVARSMPTSAALDVVAKSLNLKFFEVPTGWKFFGNLMDAGLCSVCGEESFGTGSDHIREKDGIWAVLAWLSILAHKNKDNLNGGNLVTVEDIVKQHWATFGRHYYTRYDYENVDAGAAKEVMTHLVKLQSSISDVNNTIKGMRSDVADVVSADEFEYKDPVDGSVSKNQGIRYLFEDGSRLVFRLSGTGSEGATIRLYIEQYEKDSSKTGRDSQEALAPLVDVALKLSKMKEYTGRSAPTVIT

SEQ ID NO: 13224 - protein, 582 aa, Cichorium intybus
MATFKVKRVESSPIEGQKPGTSGLRKKVKVFTQPHYLHNFVQSTFNALSAEKIKGSTLVVSGDGRYYSKDAIQIIIKMAAANGARRIWVGQKGLLSTPAVSAVVRERVGADGSKANGAFILTASHNPGGPNEDFGIKYNMENGGPAPEGVTDKIFENTKTIKEYFIAEGLPDVDISAIGVSSFSGPDGQFDVDVFDCASDYVKLMKSIFDFQSIKKLIACPQFSFCYDALHGVGGAYASRIFVEELGAKESSLLNCVPKEDFGGGHPDPNLTYAKELVARMGLGKTPDSNPPEFGAAADGDADRNMILGKRFFVTPSDSVAIIAANAVQSIPYFSSGLKGVARSMPTSAALDVVAKSLNLKFFEVPTGWKFFGNLMDAGLCSVCGEESFGTGSDHIREKDGIWAVLAWLSIIAYKNKDNLTSGKLVTVEDIVKQHWATYGRHYYTRYDYENVDAGAAKELMAHLVKLQSSLSEVNKMIKGIRSDVANVANADEFEYKDPVDGSVSKNQGIRYLFEDGSRLVFRLSGTGSEGATIRLYIEQYEKDSSKTGRDSQDALAPLVEVALKLSKMQEFTGRNAPTVIT

SEQ ID NO: 13225 - protein, 582 aa, Pisum sativum
MALFTVSRIQTTPFDGQKPGTSGLRKKVKVFVQPHYLENFVQASFNALTEGKVRGATLVVSGDGRYYSEQAIQIITKMAAANGVRRIWIGQNGLLSTPAVSAVIRERVGVDGSKATGSFILTASHNPGGPNEDFGIKYNMENGGPAPEGITNKIYENTTTIKEYLIAPDLPNVDITTVGVTNFTGPEGPFDIEVFDSASDYIKLMKSIFDFESIRKLLTSPKFSFCYDALHGVAGAYAKRIFVDELGAQENSLINCVPKEDFGGGHPDPNLTYAKELVARMGLGKSEPEGEVPEFGAAADGDADRNMVLGKRFFVTPSDSVAIIAANAVEAIPYFSAGLKGVARSMPTSAALDVVAKHLNLKFFEVPTGWKFFGNLMDAGLCSVCGEESFGTGSDHIREKDGIWAVLAWLSILAYKTKDNLESKLVSVEDIVRQHWATYGRHYYTRYDYENVDAGAAKELMAHLVKLQSSLPEVNEIIKGASSDVSKVVHGDEFEYNDPVDGSISSHQGIRYLFEDGSRLIFRLSGTGSEGATIRLYIEQYEKDPSKIGRLSHEALAPLVEAALKLSKMEEFTGRSAPTVIT

SEQ ID NO: 13226 - protein, 578 aa, Fragaria vesca
MSIKRVQTTPFDGQKPGTSGLRKKVKVFIQPNYLQNFVQSTFNALPADQVKGARLVVSGDGRYYSKEAIQIIIKMAAGNGVKSVWVGTNGLLSTPAVSAVVRERVGADGSKASGAFILTASHNPGGPNEDFGIKYNMGNGGPAPESITNKIYENTTQIKEYLTVDLPEVDITKPGVTSFEVEGGTFTVDVFDSASDYVKLLKSIFDFDSIRKLLSSPKFTFCFDALHGVGGAYAKHIFVEELGAKEDSLLNCVPKEDFGGGHPDPNLTYAKELVARMGLGKSDTQDPPEFGAAADGDADRNMILGKRFFVTPSDSVAIIAANAVEAIPYFSSGLKGVARSMPTSAALDVVAKHLNLKFFEVPTGWKFFGNLMDAGLCSICGEESFGTGSDHIREKDGIWAVLAWLSILAYKNKDNIGGDKLVTVEDIVRNHWSTYGRHYYTRYDYENVDAGKAKELMASLVNLQSSIPEVNKIVKGVCSDVANVAGGDEFEYKDPVDGSISSHQGIRYLFEDGSRLVFRLSGTGSEGATIRLYIEQYEKDPSKISRESSEALAPLVAVALKLSKMQEFTGRSAPTVIT

SEQ ID NO: 13227 - protein, 582 aa, Tabernaemontana elegans
MVFKVVCVETKPFDGQKPGTSGLRKKVKVFTQPHYLQNFVQSTFNALGADKVRGATLVVSGDGRYFSKDAIQIIIKMSAASGVRRVWVGQNGLLSTPAVSCVVRERVGADGSKATGAFILTASHNPGGPNEDFGIKYNMENGGPAPESVTNKIYENTTTIKEYLIADGLPDVDISTIAVSSFAGPEGQFDVDVFDSTSDYVKLMKSIFDFQSIQKLLSSPNFTFCYDALHGVAGVYAKRIFVEELGASESSLLNCEPKEDFGGGHPDPNLTYAKELVARMGLGKTDTGKEPPEFGAAADGDADRNMVLGKRFFVTPSDSVAIIAANAVEAIPYFSDGLKGVARSMPTSAALDVVAKHLNLKFFEVPTGWKFFGNLMDAGMCSICGEESFGTGSDHIREKDGVWAVLAWLSILAYKNKDHLGGGNLVTVEDIVRKHWATYGRHYYTRYDYEGVDAGGAKELMAHLVQLQSSLSEVNKVIKDTRSDVANVVNADEFEYKDPVDGSISKNQGIRYMFEDGSRLVFRLSGTGSEGATIRVYIEQYEKDSTKTGRDSQDALAPLVEVALKLSKMQEFTGRSAPTVIT

SEQ ID NO: 13228 - protein, 582 aa, Catharanthus roseus
MVFKVVRVETKPFDGQKPGTSGLRKKVKVFTQPHYLQNFVQSTFNALGADKVRGATLVVSGDGRYFSKDAIQIIIKMSAANGVRRVWVGQNGLLSTPAVSCVVRERVAADGSKATGAFILTASHNPGGPHEDFGIKYNMENGGPAPESVTNKIYENTTTIKEYLTAEGLPDVDISTVAVSSFPGPEGQFDVDVFDSTSDYVKLMKSIFDFQSIQKLLSSPNFSFCFDALHGVAGVYAKRIFVEELGANEGSLLNCVPKEDFGGGHPDPNLTYAKELVAVMGLGKTNTGKEPPEFGAAADGDADRNMVVGKRFFVTPSDSVAIIAANAVESIPYFSGGLKGVARSMPTSAALDVVATHLNLKFFEVPTGWKFFGNLMDAGMCSVCGEESFGTGSDHIREKDGIWAVLAWLSILAYKNKDNLGGGKLVTVEDIVRQHWATYGRHYYTRYDYEGVDASGAKELMAHLVKLQSSLSEVNKIIKGIRSDVPNVVNADEFEYKDPVDGSISKNQGIRYMFEDGSRLVFRLSGTGSEGATIRVYIEQYEKDSSKTGRDSQDALAPLVEVALKLSKMQEFTGRSAPTVIT

SEQ ID NO: 13229 - protein, 582 aa, Malus domestica
MSSGKVKKVETTPFDGQKPGTSGLRKKVKVFTQPHYLQNFVQSTFNALPSDQVKGARIIVSGDGRYFSKDAIQIIIKMAAGNGVRSVWVGQNGLLSTPAVSAVVRERVGADGSKSSGAFILTASHNPGGPNEDFGIKYNMGNGGPAPESITDKIYENTTKIKEYFTVDLPDVDITKVGVTTFSVEGGTFDVDVFDSASDYVKLMKSIFDFESIRNLLSSPKFSFCYDALHGVAGAYAKRIFVEELGAKESSLLNCVPKEDFGGGHPDPNLTYAKELVARMGLSKSNTADEPPEFGAAADGDADRNMVLGKRFFVTPSDSVAIIAANAVEAIPYFKTGLKGVARSMPTSAALDVVAKHLNLKFFEVPTGWKFFGNLMDAGLCSVCGEESFGTSSDHIREKDGIWAVLAWLSILAYKNKENLGGEKLVSVEDIVRKHWATFGRHYYTRYDYENVDAGKAKELMASLVKLQSDLSEVNKIVKGIRSDVCNVVTADEFEYKDPVDGSISKHQGIRYLFEDGSRLVFRLSGTGSEGATIRLYIEQYEKDPSKIGRESSEALGPLVEVALKLSKMQEFTGRSAPTVIT

SEQ ID NO: 13230 - protein, 582 aa, Oryza sativa
MVLFSVTKKATTPFDGQKPGTSGLRKKVTVFQQPHYLQNFVQSTFNALPADKVKGATIVVSGDGRYFSKDAVQIITKMAAANGVRRVWVGQNSLMSTPAVSAVIRERVGADGSKATGAFILTASHNPGGPTEDFGIKYNMENGGPAPESVTDKIFSNTTTITEYLIAEDLPDVDISVVGVTTFSGPEGPFDVDVFDSTIDYIKLMKTIFDFESIKKLLASPKFTFCYDALHGVAGTYATRIFVEELGAAESSLLNCVPKEDFGGGHPDPNLTYAKELVDRMGLGKSSNAEPPEFGAAADGDADRNMILGKRFFVTPSDSVAIIAANAVQSIPYFSSGLKGVARSMPTSAALDVVAKNLNLKFFEVPTGWKFFGNLMDAGMCSICGEESFGTGSDHIREKDGIWAVLAWLSILAFKNKDNLGGDKLVTVEDIVRQHWGTYGRHYYTRYDYENVDAGAAKELMANLVSMQSSLSDVNKLIKEIRSDVSDVVAADEFEYKDPVDGSVSKHQGVRYLFGDGSRLVFRLSGTGSVGATIRVYIEQYEKDSSKTGRDSQDALAPLVDVALKLSKMQEYTGRSAPTVIT

SEQ ID NO: 13231 - protein, 584 aa, Panicum virgatum
MGLFTVTKKATTPFEGQKPGTSGLRKKVTVFQQPHYLQNFVQSTFNALPAEDVKGATIVVSGDGRYFSKDAVQIITKMAAANGARRVWVGLNSLMSTPAVSAVIRERVGADGSKATGAFILTASHNPGGPTEDFGIKYNMGNGGPAPESVTDKIFSNTTTISEYLIAEDLPDVDISVAGVTSFSGPEGPFDVDVFDSSVDYIKLMKTIFDFEAIKKLLTSPKFTFCYDALHGVAGAYAKHIFVEELGADESSLLNCVPKEDFGGGHPDPNLTYAKELVERMGLGKSSSNVEPPEFGAAADGDADRNMILGKRFFVTPSDSVAIIAANAVQSIPYFASGLKGVARSMPTSAALDVVAKNLNLKFFEVPTGWKFFGNLMDAGMCSICGEESFGTGSDHIREKDGIWAVLAWLSILAFKNKDNLEGDNKLVSVEDIVRQHWATYGRHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSSKTGRDSQDALAPLVDVALKLSKMQEYTGRSAPTVIT

SEQ ID NO: 13232 - protein, 584 aa, Panicum virgatum
MGLFTVTKKATTPFEGQKPGTSGLRKKVTVFQQPHYLQNFVQSTFNALPAEEVKGATIVVSGDGRYFSKDAVQIITKMAAANGARRVWVGLNSLMSTPAVSAVIRERVGADGSKATGAFILTASHNPGGPTEDFGIKYNMGNGGPAPESVTDKIFSNTTTISEYLIAEDLPDVDISVVGVTSFSGPEGPFDVDVFDSSIDYIKLMKTIFDFEAIKKLLTSPKFTFCYDALHGVAGAYAKHIFVEELGADESSLLNCVPKEDFGGGHPDPNLTYAKELVERMGLGKSSSNVEPPEFGAAADGDADRNMILGKRFFVTPSDSVAIIAANAVQSIPYFASGLKGVARSMPTSAALDVVAKNLNLKFFEVPTGWKFFGNLMDAGMCSICGEESFGTGSDHIREKDGIWAVLAWLSILAFKNKDNLEGDNKLVSVEDIVRQHWATYGRHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSSKTGRDSQDALAPLVDVALKLSKMQEYTGRSAPTVIT

SEQ ID NO: 13233 - protein, 581 aa, Pennisetum glaucum
MFSVTKKATTPFEGQKPGTSGLRKKVTVFQQPHYLQNFVQSTFNALPAEEVKGATIVVSGDGRYFSKDAVQIITKMAAANGVRRVWVGQNSLMSTPAVSAVIRERTGQDGSKATGAFILTASHNPGGPTEDFGIKYNMGNGGPAPESVTDKIFTNTTTISEYLISEDLPDVDISAIGVSSFSGPEGPFDVEVFDSSVDYIKLMKTIFDFEAIKKLLTSPKFTFCYDGLHGVAGAYAKHIFVEELGADESSLLNCVPKEDFGGGHPDPNLTYAKELVERMGLGKSSSNVEPPEFGAAADGDADRNMILGKRFFVTPSDSVAIIAANAVQSIPYFASGLKGVARSMPTSAALDVVAKNLNLKFFEVPTGWKFFGNLMDAGMCSICGEESFGTGSDHIREKDGIWAVLAWLSILAFKNKDNLGGDKLVSVEDIVRQHWATYGRHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSAKIGRESSDALAPLVDVALKLSKMQEYTGRSAPTVIT

SEQ ID NO: 13234 - protein, 582 aa, Helianthus annuus
MANFTVNRVETSPIEGQKPGTSGLRKKVKVFTQPHYLHNFVQSTFDALSAESVKGSTLVVSGDGRYYSKVAIQIIIKMAAANGVRRVWVGQNGLLSTPAVSAVVRERIGADGSKANGAFILTASHNPGGPNEDFGIKYNMGNGGPAPEGITDKIFENTKTIKEYFIAEGLPDVDISVTGISNFSGPNGQFDVDVFDSASDYVKLMKSIFDFQSIQKLIASPQFSFCFDALHGVGGAYAKRMFVEELGAKESSLLNCVPKEDFGGGHPDPNLTYAKELVARMGLGNNADSNPPEFGAAADGDADRNMILGKRFFVTPSDSVAIIAANAVQAIPYFSSGLKGVARSMPTSAALDVVANSLSLKFFEVPTGWKFFGNLMDAGLCSICGEESFGTGSDHIREKDGIWAVLAWLSILAHKNKDNLDGGKLVTVEDIVKQHWATFGRHYYTRYDYENVDAGAAKDVMAHLVKLQSSISDINTTLKGIRSDVADVVAADEFEYKDPVDGSVSKNQGIRYLFEDGSRLVFRLSGTGSEGATIRLYIEQYEKDSSKTGRDSQEALAPLVDVALKLSKMQEFTGRSAPTVIT

SEQ ID NO: 13235 - protein, 583 aa, Solanum tuberosum
MANFKVSRVETTPFEGQKPGTSGLRKKVKVFIQPHYLQNFVQATFNALGADRVEGATLVVSGDGRYYSKDAIQIITKMAAANGVRRVWIGQNGLLSTPAVSAVVRERVGADGSKATGAFILTASHNPGGPHEDFGIKYNMENGGPAPEGITNKIYENTTTIKEYLIAEGLPDVDISTTGVSSFEGPKGKFDVDVFDSTSDYLKLLKSIFDFPAIQKLLSSPKFSFCYDALHGVAGVHAKRIFVEELGANESSLVNCVPKEDFGGGHPDPNLTYAKELVARMGLSKTHSEPNPPEFGAAADGDGDRNMVLGKRFFVTPSDSVAIIAANAVQAIPYFSGGLKGVARSMPTSAALDIVAKHLNLKFFEVPTGWKFFGNLMDAGMCSICGEESFGTGSDHIREKDGIWAVLAWLSILAYKNKDNLGEGNLVSVEDIVRQHWAIYGRHYYTRYDYENVNADGAKDLMAHLVKLQSSIDEVNKLIKGIRSDVSNVVHADEFEYKDPVDGSVSKHQGIRYLFEDGSRLVFRLSGTGSEGATIRLYIEQYEKDSSKIGRDSQEALAPLVEVALKLSKMQEYTSRSAPTVIT

SEQ ID NO: 13236 - protein, 583 aa, Zea mays
MGLFTVTKKATTPFEGQKPGTSGLRKKVTVFQQPHYLQNFVQSTFNALPADQVKGATIVVSGDGRYFSKDAVQIITKMAAANGVRRVWVGQNSLMSTPAVSAVIRERIGADGSKATGAFILTASHNPGGPTEDFGIKYNMGNGGPAPESVTDKIFSNTTTISEYLISEDLPDVDISVVGVTSFSGPEGPFDVDVFDSSVNYIKLMKTIFDFEAIKKLLTSPKFTFCYDALHGVAGAYAKHIFVEELGADESSLLNCVPKEDFGGGHPDPNLTYAKELVERMGLGKSSSNVEPPEFGAAADGDADRNMILGKRFFVTPSDSVAIIAANAVQSIPYFASGLKGVARSMPTSAALDVVAKNLNLKFFEVPTGWKFFGNLMDAGMCSICGEESFGTGSDHIREKDGIWAVLAWLSIIAFKNKDNLGGDKLVTVEDIVRQHWATYGRHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSSKTGRDSQEALAPLVDVALKLSKMQEYTGRSAPTVIT

SEQ ID NO: 13237 - protein, 583 aa, Solanum lycopersicum
MANFKVSRVETTPFEGQKPGTSGLRKKVKVFIQPHYLQNFVQATFNALGADRVEGATLVVSGDGRYYSKDAIQIITKMAAANGVRRVWIGQNGLLSTPAVSAVVRERVGADGSKATGAFILTASHNPGGPHEDFGIKYNMENGGPAPEGITNKIYENTTTIKEYLIAEGLPDVIISTTGVSSFEGPKGKFDVDVFDSTSDYLKLLKSIFDFPAIQKLLSSPKFSFCYDALHGVAGVHAKRIFVEELGANETSLVNCVPKEDFGGGHPDPNLTYAKELVARMGLSKTHSEPNPPEFGAAADGDGDRNMVLGKRFFVTPSDSVAIIAANAVQAIPYFSGGLKGVARSMPTSAALDIVAKHLNLKFFEVPTGWKFFGNLMDAGMCSICGEESFGTGSDHIREKDGIWAVLAWLSILAYKNKDNLGEGNLVSVEDIVRQHWATYGRHYYTRYDYENVNADGAKDLMAHLVKLQSSIDEVNKLIKGIRSDVSNVVHADEFEYKDPVDGSVSKHQGIRYLFEDGSRLVFRLSGTGSEGATIRLYIEQYEKDSSKIGRDSQEALAPLVEVALKLSKMQEYTSRSAPTVIT

SEQ ID NO: 13238 - protein, 583 aa, Zea mays
MGLFTVTKKATTPFDGQKPGTSGLRKKVTVFQQPHYLQNFVQSTFNALPVDQVRGATIVVSGDGRYFSKDAVQIITKMAAANGVRRVWVGQNSLMSTPAVSAVIRERVGADGSKATGAFILTASHNPGGPKEDFGIKYNMGNGGPAPESVTDKIFSNTTTISEYLISEDLPDVDISVVGVTSFSGPEGPFDVDVFDSSVDYIKLMKTIFDFEAIKKLLTSPKFTFCYDALHGVAGAYAKHIFVEELGADESSLLNCVPKEDFGGGHPDPNLTYAKELVERMGLGKSSSNVEPPEFGAAADGDADRNMILGKRFFVTPSDSVAIIAANAVQSIPYFASGLKGVARSMPTSAALDVVAKNLNLKFFEVPTGWKFFGNLMDAGMCSICGEESFGTGSDHIREKDGIWAVLAWLSIIAFKNKDNLGGDKLVTVEDIVRQHWATYGRHYYTRYDYENVDAGAAKELMANLVSMQSSLSDVNKLVKEIRSDVSEVVAADEFEYKDPVDGSVSKHQGIRYLFGDGSRLVFRLSGTGSVGATIRVYIEQYERDSSKTGRDSQDALAPLVDVALKLSKMQEYTGRSAPTVIT

SEQ ID NO: 13239 - protein, 583 aa, Sorghum bicolor
MGLFTVTKKATTPFEGQKPGTSGLRKKVTVFQQPHYLQNFVQSTFNALPADQVKGATIVVSGDGRYFSKDAVQIITKMAAANGARRVWVGLNSLMSTPAVSAVIRERVGADGSKATGAFILTASHNPGGPTEDFGIKYNMGNGGPAPESVTDKIFSNTTTISEYLISEDLPDVDISVVGVTSFSGPEGPFDVDVFDSSVDYIKLMKTIFDFEAIKKLLTSPKFTFCYDALHGVAGAYAKHIFVEELGADESSLLNCVPKEDFGGGHPDPNLTYAKELVERMGLGKSSSNVEPPEFGAAADGDADRNMILGKRFFVTPSDSVAIIAANAVQSIPYFASGLKGVARSMPTSAALDVVAKNLNLKFFEVPTGWKFFGNLMDAGMCSICGEESFGTGSDHIREKDGIWAVLAWLSIIAFKNKDNLGGDKLVSVEDIVRQHWATYGRHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSSKIGRDSQDALAPLVDVALKLSKMQEYTGRSAPTVIT

SEQ ID NO: 13240 - protein, 583 aa, Cephalotaxus harringtonia
MTIFSVVRKETSPFDGQKPGTSGLRKKVKVFKQENYLHNFVQATFNALSADKIKGSTIVVSGDGRYYSKEAIQIIVKMAAANGVRRIWVGQNGLLSTPAVSGVIRERVGVNGDKASGAFILTASHNPGGPHEDFGIKYNMENGGPAPEGITDKIYENTKTIKEYFIAEDLPDVDISTIGITRFSGPEGPFDVDVFDSAEDYVKLMKTIFDFEAIQKLLTCPKFTFCYDALHGVAGAYAKRIFVEELSADESSLINCIPKEDFGGGHPDPNLTYAKELVLRMGLGKEAPALEPPEFGAAADGDADRNMILGKRFFVTPSDSVAIIAANAVEAIPYFSSGLKGVARSMPTSAALDVVAKNLNLKFFEVPTGWKFFGNLMDAGMCSVCGEESFGTGSDHIREKDGIWAVLAWLSILALKNKDNLDGGELVSVEDIVHSHWASYGRHYYTRYDYENVDAAAAKELMAHLVKLQSSLPEVNKIIKDVRPDVSVVVHADEFEYKDPVDGSVSKHQGIRYLFEDGSRLVFRLSGTGSEGATIRLYIEQYEADPSKTGRKSQDALAPLVEVALHLSKMEEFTGRSSPTVIT

SEQ ID NO: 13241 - protein, 583 aa, Nicotiana tabacum
  misc_feature (403)..(403): Xaa can be any naturally occurring amino acid
  misc_feature (410)..(410): Xaa can be any naturally occurring amino acid
  misc_feature (415)..(415): Xaa can be any naturally occurring amino acid
MVMFKIIRVETTPFEGQKPGTSGLRKKVKVFIQPHYLQNFVQATFNALGADRVKGATLVVSGDGRYYSKDAIQIITKMAAANGVRRVWIGQNGLLSTPAVSAVVRERVGADGSKATGAFILTASHNPGGPHEDFGIKYNMENGGPAPEGITNKIYENTTTLKDYLIAEGLPDVDISTTGVSSFEGPEGKFDVDVFDSTSDYLKLLKSIFDFPSIQKLLSSPNFSFCYDALHGVAGVHAKRIFVAELGANESSLVNCVPKEDFGGGHPDPNLTYAKELVARMGLSTTHSEPNPPEFGAAADGDGDRNMILGKRFFVTPSDSVAIIAANAVQAIPYFSGGLKGVARSMPTSAALDVVAKHLNLKFFEVPTGWKFFGNLMDAGMCSICGEESFGTGSDHIREKDGXWAVLAWXSILAXKNKDNLGGEKLVSVEDIVRQHWATYGRHYYTRYDYENVDAAGAKELMAHLVKLQSSLDEVNKIIKGIHSDVSNVVHGDEFEYKDPVDSSISKHQGIRYLFEDGSRLVFRLSGTGSEGATIRVYIEQYEKDPSKIGRDSQEALAPLVEVAIKLSKMQEFTGRSAPTVIT

SEQ ID NO: 13242 - protein, 583 aa, Solanum lycopersicum
MANFKVSRVETTPFEGQKPGTSGLRKKVKVFIQPHYLQNFVQATFNALGADRVEGATLVVSGDGRYYSKDAIQIITKMAAANGVRRVWIGQNGLLSTPAVSAVVRERVGADGSKATGAFILTASHNPGGPHEDFGIKYNMENGGPAPEGITNKIYENTTIIKEYLIAEGLPDVIISTTGVSSFEGPKGKFDVDVFDSTSDYLKLLKSIFDFPAIQKLLSSPKFSFCYDALHGVAGVHAKRIFVEELGANETSLVNCVPKEDFGGGHPDPNLTYAKELVARMGLSKTHSEPNPPEFGAAADGDGDRNMVLGKRFFVTPSDSVAIIAANAVQAIPYFSGGLKGVARSMPTSAALDIVAKHLNLKFFEVPTGWKFFGNLMDAGMCSICGEESFGTGSDHIREKDGIWAVLAWLSILAYKNKDNLGEGNLVSVEDIVRQHWATYGRHYYTRYDYENVNADGAKDLMAHLVKLQSSIDEVNKLIKGIRSDVSNVVHADEFEYKDPVDGSVSKHQGIRYLFEDGSRLVFRLSGTGSEGATIRLYIEQYEKDSSKIGRDSQEALAPLVEVALKLSKMQEYTSRSAPTVIT

SEQ ID NO: 13243 - protein, 582 aa, Festuca arundinacea
MVFSVTKKETTPFDGQKPGTSGLRKKVTVFQQPHYLANFVQSTFNALPAEEVKGATIVVSGDGRYFSKDAVQIITKMAAANGVRRVWVGQDTLLSTPAVSAIIRERIAADGSKATGAFILTASHNPGGPTEDFGIKYNMGNGGPAPESVTDKIFSNTKTINEYLIAEDLPDVDVSALGVTTFTGPEGPFDVDVFDSATDYIKLMKSIFDFESIKKLLASPKFSFCFDGLHGVAGAYAKRMFVDELGASESSLLNCVPKEDFGGGHPDPNLTYAKELVERMGLGKSSSNVEPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWLSILAYKNKDNLGGDKLVTVEDIVLQHWATYGRHYYTRYDYENVDSEAAKELMANLVKLQSSLSDVNKLIKEIQPNVADVVSADEFEYKDPVDGSVSKHQGIRYLFGDGSRLVFRLSGTGSVGATIRIYIEQYENDSSKTGRESSDALSPLVDVALKLSKIQEYTGRSAPTVIT

SEQ ID NO: 13244 - protein, 583 aa, Saccharum officinarum
MGLFTVTKKVTTPFEGQKPGTSGLRKKVTVFQQPHYLQNFVQSTFNALPADQVKGATIVVSGDGRYFSKDAVQIITKMAAANGVRRVWVGLNSLMSTPAVSAVIRERIGADGSKATGAFILTASHNPGGPTEDFGIKYNMGNGGPAPESVTDKIFSNTTTISEYLISEDLPDVDISVVGVTSFSGPDGPFDVDVFDSSVDYIKLMKTIFDFEAIKKLLTSPKFTFCYDALHGVAGAYAKHIFVEELGADESSLLNCVPKEDFGGGHPDPNLTYAKELVERMGLGKSSSNVEPPEFGAAADGDADRNMILGKRFFVTPSDSVAIIAANAVQSIPYFASGLKGVARSMPTSAALDVVAKNLNLKFFEVPTGWKFFGNLMDAGMCSICGEESFGTGSDHIREKDGIWAVLAWLSIIAFKNKDNLGGDKLVSVEDIVRQHWATYGRHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSSKTGRDSQDALAPLVDVALKLSKMQEYTGRSAPTVIT

SEQ ID NO: 13245 - protein, 581 aa, Hordeum vulgare
MVFSVTKRDTTPYEGQKPGTSGLRKKVTVFQQPHYLANFVQSTFNALPADQVKGATIVVSGDGRYFSKDAVQIIAKMAAANGVRRVWVGQDSLLSTPAVSAIIRERISADGAKATGAFILTASHNPGGPTEDFGIKYNMENGGPAPESVTDKIFSNTKTITEYLIAEDLPDVDISVTGVTSFTGPEGPFDVDVFDSATDYIKLMKTIFDFESIKKLLASPKFSFCFDGLHGVAGAYAKRIFVDELGASESSLLNCVPKEDFGGGHPDPNLTYAKELVDRMGLGKTSNGEPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWLSILAYKNKDNLGGDKLVTVEDIVLQHWGTYGRHYYTRYDYENVDAEAAKELMANLVKMQASLPDVNKSIKEIQPAVADVVSADEFEYKDPVDGSVSKHQGIRYLFGDGSRLVFRLSGTGSVGATIRIYIEQYEKDSSKTGRESSDALSPLVDVALKLSKIQEYTGRSAPTVIT

SEQ ID NO: 13246 - protein, 583 aa, Mesembryanthemum crystallinum
MATFKVSRVETKPYDGQKPGTSGLRKKVKVFAQPHYLENFVQSTFDALTADKIKGKTLVVSGDGRYYSEQAIQTIIKMSAANGVKSVWVGQDGLLSTPAVSAVIRERVGKDGSKASGAFILTASHNPGGPNEDFGIKYNMENGGPAQEGVTNKIYENTTTIKEYLIAKELPNVNISKTGVTSFSGPDGQFDVEVFDATETYVKLMKSIFDFQAIKKLLSIPSFTFCYDALHGVAGVYAKRIFVDELGANESSLLNCTPKEDFGGGHPDPNLTYAKELVERMGLGKSNTQGEPPEFGAAADGDADRNMILGKRFFVTPSDSVAIIAANAVEAIPYFSGGLKGVARSMPTSAALDVVAKHLNLKFFEVPTGWKFFGNLMDAGVCSICGEESFGTGSDHVREKDGIWAVLAWLSILAHKNKDNLNGEKLVTVEDIVCQHWATYGRHYYTRYDYENVDAGGAKELMAYLVNLQSDLSKVNNIVKGVHSGVANVIAADEFEYKDPVDGSVSKHQGIRYMFEDGSRLIFRLSGTGSEGATIRLYIEQYEKDSSKTGRDSQEALKPLVDVALKLSKMQEFSGRSEPTVIT

SEQ ID NO: 13247 - protein, 573 aa, Malus domestica
MSSGQVRKVETTPFDGQKPGTSGLRKKVKVFTQPHYLQNFVQSTFNALPSDQVKGARLVVSGDGRYFSKDAIQIIIKMAAGNGVRSVWVGQNGLLSTPAVSAIVRERVGADGSKASGAFILTASHNPGGPNEDFGIKYNMGNGGPAPESITDKIYENTTKIKEYFTVDLPDVDITEVGVTTFSVDGGTFDVDVFDSASDYVKLMMSIFDFESIRKLLSSPKFSFCYDALHGVAGAYAKRIFVEELGAKESSLLNCVPKEDFGGGHPDPNLTYAKELVARMGLGKSNTADEPPEFGAAADGDADRNMVLGKRFFVTPSDSVAIIAANAVDAIPYFKTGLKGVARSMPTSAALDVVAKHLNLKFFEVPTGWKFFGNLMDAGLCSVCGEESFGTGSDHIREKDGIWAVLAWLSILAYKNKENLGGEKLVSVEDIVRKHWATFGRHYYTRYDYENVDAGKAKELMASLVKLQSDLSEVNKIVKGLHSDVSNVVNADEFEYKDPVDGSISKHQGIRYLFEDGSRLVFRLSGTGSEGATIRLYIEQYEKDPSKISRESSEALSPLVEVALKLSKMQEFT

SEQ ID NO: 13248 - protein, 581 aa, Triticum aestivum
MVFSVTKKETKPYEGQKPGTSGLRKKVTVFQQPHYLANFVQATFNALPADQVKGATIVVSGDGRYFSKDAVQIIAKMAAANGVRRVWVGQDSLLSTPAVSAIIRERISADGAKATGAFILTASHNPGGPTEDFGIKYNMGNGGPAPESVTDKIFSNTKTITEYLIAEDLPNVDISVTGVTSFTGPEGPFDVDVFDSATDYIKLMKTIFDFESIKKLLASPKFSFCFDGLHGVAGAYAKRMFVDELGASESSLLNCVPKEDFGGGHPDPNLTYAKELVERMGLGKTSNADPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWLSILAYKNKDNLGGDKLVTVEDIVLQHWATYGRHYYTRYDYENVDAEAAKELMANLVKMQSSLSDVNKSIKEIQPTVADVVSADEFEYKDPVDGSVSKHQGIRYLFGDGSRLVFRLSGTGSVGATIRIYIEQYEKDSSKTGRESSDALSPLVDVALKLSKIQEYTGRSAPTVIT

SEQ ID NO: 13249 - protein, 581 aa, Triticum aestivum
MVFSVTKKETKPYEGQKPGTSGLRKKVTVFQQPHYLANFVQSTFNALPADQVKGATIVVSGDGRYFSKDAVQIIAKMAAANGVRRVWVGQDSLLSTPAVSAIIRERISADGAKATGAFILTASHNPGGPTEDFGIKYNMGNGGPAPESVTDKIFSNTKTITEYLIAEDLPNVDISVIGVTSFTGPEGPFDVDVFDSATDYIKLMKTIFDFESIKKLLASPKFSFCFDGLHGVAGAYAKRMFVDELGASESSLLNCVPKEDFGGGHPDPNLTYAKELVDRMGLGKTSNVEPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWLSILAYKNKDNLGGDKLVTVEDIVLQHWATYGRHYYTRYDYENVDAEAAKELMANLVKMQSSLSDVNKSIKEIQPTVADVVSADEFEYKDPVDGSVSKHQGIRYLFGDGSRLVFRLSGTGSVGATIRIYIEQYEKDSSKTGRASSDALSPLVDVALKFSKIKEYTGRSAPTVIT

SEQ ID NO: 13250 - protein, 82 aa, Flaveria ramosissima
MVQSLKIREFVIYRRRVTPGFRLSGTGSEGATIRLYIEQYEKVHTKTGRDSQEALAPCDVQLKLYKDRKNYTWSVLRPDCDH

SEQ ID NO: 13251 - protein, 583 aa, Picea glauca
  misc_feature (95)..(95): Xaa can be any naturally occurring amino acid
MVIFSVNKKETSPYDGQKPGTSGLRKKVTVFKQQNYLHNFVQATFDALSVEKIKGSTIVVSGDGRYFSEEAIQIIIKMAAANGVRRVWVGQNGLXSTPAVSAVIRNRIGADGEKASGSFILTASHNAGGPNEDFGIKYNMENGGPAPEGITDKIYENTKTIKEYFTAEDLPDVDISTIGITTFGGPEGPFAVDVFDPTEDYVKLMKTIFDFEAIQKLLTCPKFTFCYDALHGVAGIYAKRIFVEELSASESSLLNCTPKDDFGGGHPDPNLTYAKELVARMGLGKQAPGSEPPEFGAAADGDADRNMILGKRFFVTPSDSVAIIAANAVEAIPYFSSGLKGVARSMPTSAALDVVAKSLNLRFFEVPTGWKFFGNLMDAGMCSICGEESFGTGSDHIREKDGVWAVLAWFSILAYKNKDNLDGGKLVTVEDIVRNHWASYGRHYYTRYDYENVDAGDAKELMAHLIKLQSSLPEVNKLIKEVSPDVSDVVHADEFEYKDPVDGSVSKHQGVRYLFEDGSRLVFRLSGTGSVGATIRLYIEQYEADSTKIGRDSQEALGPLVEVALQLSKMEEFTGRSSPTVIT

SEQ ID NO: 13252 - protein, 583 aa, Podocarpus macrophillus
MVIFSVTRKQTTPYDGQKPGTSGLRKKVKVFKQENYLHNFVQATFGALSPEKVKGATIVVSGDGRYFSEEAIQIIIKMAAANGVRNVWVGQNGLLSTPAVSAVIRNRIGADGEKASGAFILTASHNPGGPHEDFGIKYNMENGGPAPEGITDKIYQNTTTIEEYFISEDLPDVDISIIGKSSFGGPEGPFSVDVFDSTEDYVKLMKTIFDFETIRKLLTCQKFTFCYDALHGVAGIYATRIFVEELSADESSLINCVPKEDFGGGHPDPNLTYAKELVQRMGLGKEGTASEPPEFGAAADGDADRNMILGKRFFVTPSDSVAIIAANAVESIPYFSSGLKGVARSMPTSAALDVVAKSLNLKFFEVPTGWKFFGNLMDAGLCSVCGEESFGTGSDHIREKDGIWAVLAWLSILAYKNKDNLDGGKLVTVEDIVRKHWASYGRHYYTRYDYENVDAAAAKELMAYLVKLQSSLSEVNKIIKEVRPEISDIVHADEFEYKDPVDDSVSKHQGIRYLFQDGSRLVFRLSGTGSVGATIRLYIEQYEADSTKIGRDSQEALAPLVEVALYLSKMEEFTGRSSPTVIT

SEQ ID NO: 13253 - protein, 581 aa, Zostera marina
MVFQVSKKETVPIEGQKPGTSGLRKKVVVFKEPNYLHNFVQSTFDALPADQVKGATIVVSGDGRYFSEDAIQIIVKMAAANGVRSIWIGENGLLSTPAVSAIIRERIAADGSKASGAFILTASHNPGGPLEDFGIKYNMGNGGPAPESITDKIYANTKTITEYLIAEDLPDVNISVSGVTSFDGPDGKFDIDVFDSADEYVKLMKKIFDFASIRNLLSSPKFTFCYDSLHGVAGAYASRIFVEELGAKESSLINCIPKEDFGGGHPDPNLTYAKELVARMGLGKSPSQDEPPEFGAAADGDADRNMILGKRFFVTPSDSVAIIAANAVQAIPYFSSGLKGVARSMPTSAALDVVAKNLNLKFFEVPTGWKFFGNLMDAGMCSVCGEESFGTGSDHIREKDGIWAVLAWLSIIAYKNKDNDGGKLVTVEDIVLQHWATYGRHYYTRYDYENVDSDAAKNLMAHLVKLQSSLPEVNKMIKETRPEVADVVEADEFEYKDPVDGSISKHQGIRFLFEDGSRLVLRLSGTGSQGATIRVYIEQYENDPLKTGRDSQEALAPLVEVALKLSNMQGFTGRSEPTVIT

SEQ ID NO: 13254 - protein, 583 aa, Brachypodium distachyon
MVLFTVSKKDTKPFDGQKPGTSGLRKKVTVFQQPHYLANFVQSTFNALPADRVKGATIVVSGDGRYFSKDAVQIITKMAAANGVRRVWVGQDSLLSTPAVSAIIRERIAADGSKATGAFILTASHNPGGPTEDFGIKYNMENGGPAPESVTDKIFSNTKTITEYLISDDLPDVDISVIGVTTFSGPEGPFDVDVFDSATDYIKLMKTIFDFESIKKLLASPKFSFCFDGLHGVAGAYAKRIFVDELGASESSLLNCLPKEDFGGGHPDPNLTYAKELVDRMGLGKSTSNVEPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWLSILAYKNKDNLGGDKLVTVEDIVLQHWGTYGRHYYTRYDYENVDAEAAKELMANLVKMQSSLSDVNKLIKEIQPHVSDVVSADEFEYKDPVDGSVSKHQGIRYLFGDGSRLVFRLSGTGSVGATIRIYIEQYEKDSSKTGRESKDALSPLVDVALKLSKIQEYTGRSAPTVIT

SEQ ID NO: 13255 - protein, 544 aa, Flaveria ramosissima
NFVQSTFNALSAEKVKGSTLVVSGDGRYYSKDAIQIIIKMAAANGVRRVWVGQNGLLSTPAVSAVVRERVGADGSKANGAFILTASHNPGGPNEDFGIKYNMENGGPAPEGITDKIYENTKTIKEYFIAEGLPDVDISAIGISSFSGPDGQFDVDVFDSSSDYVKLMKSIFDFQSIKKLIASPQFSFCYDALHGVAGAYAKRIFVEELGAKESSLLNCVPKEDFGGGHPDPNLTYAKELVARMGLGKNPDSNPPEFGAAADGDADRNMILGKRFFVTPSDSVAIIAANAVQSIPYFSSGLKGVARSMPTSAALDVVAKSLNIKFFEVPTGWKFFGNLMDAGLCSVCGEESFGTGSDHIREKDGIWAVLAWLSILAHKNKDNLNGGKLVTVEDIVTLHWATFGRHYYTRYDYENVDAGAAKELMAHLVKLQSSISDVNKIIKETRSDVANVASADEFEYKDPVDGSISKNQGIRYLFEDGSRLVFRLSGTGSEGATIRLYIEQYEKDATKIGRDSQEALAPLVEVALKLSKMQEFTGRSAPTVIT

SEQ ID NO: 13256 - protein, 582 aa, Avena sativa
MVFSVTKKETTPFEGQKPGTSGLRKKVTVFQQPHYLANFVQSTFNALPADQVKGATIVVSGDGRYFSKDAVQIITKMAAANGVRRVWVGQDTLLSTPAVSAIIRERIAADGSKATGSFILTASHNPGGPTEDFGIKYNMGNGGPAPESVTDKIFSNTKTITEYLIADDLPDVDVSALGVTTFTGPEGPFDVDVFDSATDYIKLMKTIFDFESIKKLLASPKFSFCFDGLHGVAGAYAKRMFVDELGASESSLLNCVPKEDFGGGHPDPNLTYAKELVERMGLGKSSSNVEPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWLSILAYKNKDNLGGDKLVSVEDIVLQHWATYGRHYYTRYDYENVDAEAAKALMANLVKMQSSLTDVNKLIKEIQPNVSDVVSADEFEYKDPVDGSVSKHQGIRYLFGDGSRLVFRLSGTGSVGATIRIYIEQYENDSSKTGRESSDALSPLVDVALKLSKIQEYTGRSAPTVIT

SEQ ID NO: 13257 - protein, 582 aa, Avena sativa
MVFSVTKKETTPFEGQKPGTSGLRKKVTVFQQPHYLANFVQSTFNALPADQVKGATIVVSGDGRYFSKDAVQIITKMAAANGVRRVWVGQDTLLSTPAVSAIIRERIAADGSKATGSFILTASHNPGGPTEDFGIKYNMGNGGPAPESVTDKIFSNTKTITEYLIADDLPDVDVSALGVTTFTGPEGSFDVDVFDSATDYIKLMKTIFDFESIKKLLASPKFSFCFDGLHGVAGAYAKRMFVDELGASESSLLNCVPKEDFGGGHPDPNLTYAKELVERMGLGKSSSNVEPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWLSILAYKNKDNLGGDKLVSVEDIVLQHWATYGRHYYTRYDYENVDAEAAKALMANLVKMQSSLTDVNKLIKEIQPNVSDVVSADEFEYKDPVDGSVSKHQGIRYLFGDGSRLVFRLSGTGSVGATIRIYIEQYENDSSKTGRESSDALSPLVDVALKLSKIQEYTGRSAPTVIT

SEQ ID NO: 13258 - protein, 583 aa, Pseudotsuga menziesii
MVIFSVTRKETTPYDGQKPGTSGLRKKVTVFQQQNYLHNFVQATFDALSVEKIKGSTIVVSGDGRYFSEEAIQIIIKMAAANGVRSVWVGQNGLLSTPAVSAVIRNRIGADGEKASGSFILTASHNAGGPKEDFGIKYNMENGGPAPEGITDKIYENTKTIKEYFTAEDLPDVDISTIGITTFGGPDGPFDVDVFDSTEDYVKLMKTIFDFEAIQKLLTCPKFTFCYDALHGVAGIYAKRIFVEELSASESSLINCTPKADFGGGHPDPNLTYAKELVTRMGLGKETPGSEVPEFGAAADGDADRNMILGKRFFVTPSDSVAIIAANAVEAIPYFSSGLKGVARSMPTSAALDVVAKNLNLRFFEVPTGWKFFGNLMDAGMCSVCGEESFGTGSDHIREKDGVWAVLAWFSILAYKNKDNLDGGKLVTVEDIVRSHWASYGRHYYTRYDYENVDAGAAKELMAHLIKLQSSLPEVNKLIKEVRPDVSVVVHADEFEYKDPVDGSVSKHQGVRYLFEDGSRLVFRLSGTGSVGATIRLYIEQYEADSAKIGRDSQEALAPLVEVALRLSKMEEFTGRSSPTVIT

SEQ ID NO: 13259 - protein, 583 aa, Pinus pinaster
MVLFSVNKKETSPYDGQKPGTSGLRKKVTVFKQQNYLHNFVQATFDALSVEKIKGSRIVVSGDGRYFSEEAIQIIIKMAAANGVRSVWVGQNGLLSTPAVSAVIRNRIGADGEKASGAFILTASHNPGGPNEDFGIKYNMENGGPAPEGITDKIYENTKTIKEYFTAEDLPDVDISTIGITTFGGPEGPFDVDVFDPTEDYVKLMKTIFDFGAIQKLLTYPKFTFCYDALHGVAGIYAKRIFVEELSASESSLINCTPKDDFGGSHPDPNLTYAKELVTRMGLGKQAPDSEPPEFGAAADGDADRNMVLGKRFFVTPSDSVAIIAANAVEAIPYFSSGLKGVARSMPTSAALDVVAKSLNLRFFEVPTGWKFFGNLMDAGMCSVCGEESFGTGSDHIREKDGVWAVLAWLSILAYKNKDNLDGGKLVTVEDIVRNHWASYGRHYYTRYDYENVDAGAAKELMSHLIKLQSSLPEVNKLIKEVRPDVSGVVDADEFEYKDPVDGSVSKHQGVRYLFEDGSRLVFRLSGTGSVGATIRLYIEQYEADSTKIGRDSQVALGPLVEVALRLSKMEEFTGRSSPTVIT

SEQ ID NO: 13260 - protein, 583 aa, Pinus taeda
MVLFSVNKKETSPYDGQKPGTSGLRKKVTVFKQQNYLHNFVQATFDALSVEKIKGSRIVVSGDGRYFSEEAIQIIIKMAAANGVRSVWVGQNGLLSTPAVSAVIRNRIGADGEKASGAFILTASHNPGGPNEDFGIKYNMENGGPAPEGITDKIYENTKTIKEYFTAENLPDVDISTIGITTFGGPEGPFDVDVFDPTEDYVKLMKTIFDFGAIQKLLTYPKFTFCYDALHGVAGIYAKRIFVEELSASESSLINCTPKDDFGGSHPDPNLTYAKELVTRMGLGKQAPDSEPPEFGAAADGDADRNMVLGKRFFVTPSDSVAIIAANAVEAIPYFSSGLKGVARSMPTSAALDVVAKSLNLRFFEVPTGWKFFGNLMDAGMCSVCGEESFGTGSDHIREKDGIWAVLAWLSILAYKNKDNLDGGKLVTVEDIVRNHWASYGRHYYTRYDYENVDAGAAKELMSHLIKLQSSLPEVNKLIKEVRPDVSGVVDADEFEYKDPVDGSVSKHQGVRYLFEDGSRLVFRLSGTGSVGATIRLYIEQYEADSTKIGRDSQVALAPLVEVALRLSKMEEFTGRSSPTVIT

SEQ ID NO: 13261 - protein, 546 aa, Coffea canephora
MVVFQVARVETTPFDGQKPGTSGLRKKVKVFTQPHYLHNFVQSTFYALGADKVRGATLVVSGDGRYYSKDAIQIIIKMAAANGVRRIWVGQNGLLSTPAVSAVIRDRVGHDGSKANGGFILTASHNPGGPHEDFGIKYNMENGGPAPESVTDKIYENTKTIKEYLIAEGLPDVDISTVGVSSFTGPEGQFDVDVFDSTTDYVKLMKSIFDFESIRKLLSSPNFTFCYDALHGVAGVYAKRIFVEELGAEESSLLNCVPKEDFGGGHPDPNLTYAKELVARMGLGKTNNESEPPEFGAAADGDADRNMILGKRFFVTPSDSVAIIAANAVEAIPYFSSGLKGVARSMPTSAALDVVAKHLNLKFFEVPTGWKFFGNLMDAGMCSVCGEESFGTGSDHIREKDGIWAVLAWLSILAYKNKDNLGGGKLVTVEDIVRQHWSVYGRHYYTRYDYENVDAGGAKDLMAHLVKLQSSLGEVNEIIKGIRSDVSNVDRADEFEYKDPVDGSISKHQGIRYLFEDGSRLVFRLSGTGSEGATIRVYIEQYENDS

SEQ ID NO: 13262 - protein, 531 aa, Euphorbia peplus
KVRGGTLVVSGDGRYYSKDAVQIIIKMSAANGVRRVWVGQNSLLSTPAVSAVIRERVGVDGSKATGAFILTASHNPGGPNEDFGIKYNMENGGPAPEGITDKIYENTKTIKEYLTADLPDVDISAIGVTNFSGPEGQFDVEVFDSANDYVKLMKSIFDFESMKKLISSPKFSFCFDALHGVGGAYAKRMFVEELGAPESALLNCVPKEDFGGGHPDPNLTYAKELVARMGLGKSNSEVEPPEFGAAADGDADRNMVLGKRFFVTPSDSVAIIAANAVESIPYFSSGLKGVARSMPTSAALDVVAKHLNLKFFEVPTGWKFFGNLMDAGMCSVCGEESFGTGSDHIREKDGIWAVLAWLSILAYKNKGNLDGGKLVTVEDIVRNHWAKYGRHYYTRYDYENVDATAAKELMAHLVKLQSSLGEVNEIVKGIRSDVSKVVGGDEFEYKDPVDGSISKHQGIRYFFEDGSRLVFRLSGTGSEGATIRLYIEQYEKDPSKIGRESSEALAPLVDVALKLSKMQEFTGRSAPTVIT

SEQ ID NO: 13263 - protein, 571 aa, Abies balsamea
MVIFSVNKKSTAPYDGQKPGTSGLRKKVTVFKQQNYLHNFVQATFDALSAEKVKGSTIVVSGDGRYFSEEAIQIIIKMAAANGVRRVWVGQNGLLSTPAVSAVIRIRIGADGEKASGAFILTASHNAGGPNEDFGIKYNMENGGPAPEGITDKIYENTKTIKEYFTAENLPDVDISTIGITSFGGPKGPFDVDVFDSTEDYVKLMKTIFDFEAIQKLLTCPKFTFCYDALHGVAGIYAKRIFVDELSASESSLINCIPKDDFGGGHPDPNLTYAKELVTRMGLGKEAPGSEVPEFGAAADGDADRNMILGKRFFVTPSDSVAIIAANAVEAIPYFRSGLKGVARSMPTSAALDVVAKSLDLRFFEVPTGWKFFGNLMDAGMCSICGEESFGTGSDHIREKDGVWAVLAWFSILAYKNKDNLDGGKLVTVEDIVRNHWASYGRHYYTRYDYENVDAGAAKELMAHLIKLQSSLPEVNKLVKEVRPDVSDVVHADEFEYKDPVDGSVSKHQGVRYLFEDGSRLVFRLSGTGSVGATIRLYIEQYEVDSTKIGRDSQEALAPLVEVALRLSKME

SEQ ID NO: 13264 - protein, 476 aa, Brassica napus
MSFNRNLLNIIIILCVCLNWDCSEGAQEKQRRAIDSHTIQLSSLFPSSSSPCVLSTRASSTKSSLHVTHRHGTCSRITSAKAKSPDHAEILRLDQARVNSIHSKLSKKLTDRVRQSKSTDLPAKDGSTYGSGNFVVTLGIGTPKHDLSLIFDTGSDLTWIQCEPCVRTCYSQKEPIFNPSSSSSYHNVSCSSAECSSLSSATGNSGTCSASNCVYGIQYGDQSFSVGFLAKEKFTLTASNVFDGVNFGCGENNQGLFTGVAGLLGLGRDKLSFPSQTAATYNKIFSYCLPSSASYTGHLTFGSAGVSRSVKFTPISTITDGTSFYGLDIVGISVGGQKLAIPPTVFSTPGALIDSGTVISRLPPKAYAALRGAFKAKMSQYKNTSGVSILDTCFDLTGLKTVTIPTVSFYFNGGAVVQLGSKGVLYAFKMSQVCLAFAGNSDDNNAAIFGNVQQQTLEVVYDGAAGRVGFAPNGCS

SEQ ID NO: 13265 - protein, 474 aa, Brassica napus
MSFNRMNIIIILCVCLNWDCSEGAQEKQRRAIDSHTIQLSSLFPSSSSPCVLSTRASSTKSSLHVTHRHGTCSRITNAKAKNPDHAEILRLDQARVNSIHSKLSKKLTDRVRQSKSTDLPAKDGSTYGSGNFVVTLGIGTPKHDLSLIFDTGSDLTWIQCEPCVRTCYSQKEPIFNPSSSSSYHNVSCSSAECSSLSSATGNSGTCSASNCVYGIQYGDQSFSVGFLAKEKFTLTASNVFDGVNFGCGENNQGLFTGVAGLLGLGRDKLSFPSQTAATYNKIFSYCLPSSASYTGHLTFGSAGVSRSVKFTPISTITDGTSFYGLDIVGISVGGQKLAIPPTVFSTPGALIDSGTVISRLPPKAYAALRGAFKAKMSQYKNASGVSILDTCFDLTGFKTVTIPTVSFYFNGGAVVELGSKGVLYAFKMSKVCLAFAGNSDDNNAAIFGNVQQQTLEVVYDGAAGRVGFAPNGCS

SEQ ID NO: 13266 - protein, 477 aa, Brassica napus
MNSTRNVLNIILILCVCLSWGCTDGAQKRENGEILTHTIELSSLFPSSSSPCVLSTRASNTKSSLHVTHRHGTCSSLTSDKATTSPDHAEILRLDQARVNSIQSKLSKKLTDRVRQSKSTALPAKDGSIFGSGNYVVSVGIGTPKRDQSLIFDTGSDLTWIQCEPCVQTCYSQKAPIFNPSSSSSYYNVSCSSAACSSLSSATGNSGSCSASTCVYGIQYGDQSFSVGFLAKEKFTLTASNVFDGVNFGCGENNQGLFTGVAGLLGLGRDKLSFPSQTAATYNKIFSYCLPSSASYTGHLTFGSAGVSRSVKFTPISTITDGTSFYGLDIVGISVGGQKLAIPPTVFSTPGALIDSGTVISRLPPKAYAALRGAFKAKMSQYKNTSAVSILDTCYDLTGLKTVTIPTVSFYFNGGAVVQLGSKGVLYAFKMSQVCLAFAGNSDDNNAAIFGNVQQQTLEVVYDGAAGRVGFAPNGCS

SEQ ID NO: 13267 - protein, 475 aa, Brassica napus
SARNVLNIIIIICVCFNWGSANGAQKRESGEILTHTIELSSLFPSSSSPCVLSTRASNTKSSLHVTHRHGTCSSLTSDKATTSPDHAEILRLDQARVNSIHSKLSKKLTDRVRQSKSTALPAKDGSIFGSGNYVVSVGIGTPKRDQSLIFDTGSDLTWIQCEPCVQTCYSQKEPIFNPSSSSSYYNVSCSSAACTSLSSATGNSGSCSASTCVYGIQYGDQSFSVGFLAKEKFTLTSSNVFDGVYFGCGENNQGLFTGVAGLLGLGRDKLSFPSQTATTYNKIFSYCLPSSASYTGHLTFGTAGISRSVKFTPISTITEGTSFYGLDIVGITVGGQKLAIAPAVFSTPGALIDSGTVITRLPPKAYAALKDAFKAKMSQYPSASGVSILDTCFDLSGLKTVTIPKVAFSFSGGAVVELGSTGVLYAFKMAQVCLAFAGNSDDTNAAIFGNVQQQTLEVVYDGAGGRVGFSPNGCS

SEQ ID NO: 13268 - protein, 477 aa, Brassica napus
MSSARNVLNIIIIICVCLSWGCTDGAQKRESGETDSHTVELSSLFPSSSSPCVLSTRASNTKSSLHVTHRHGTCSSLTSDKATTSPDHAEILRLDQARVNSIHSKLSKKLADRVRQSKSTALPAKDGSIFGSGNYVVSVGIGTPKRDQSLIFDTGSDLTWIQCEPCVQTCYSQKEPIFNPSSSSSYYNVSCSSAACSSLSSATGNSGSCSASTCVYGIQYGDQSFSVGFLAKEKFTLTSSNVFDGVYFGCGENNQGLFTGVAGLLGLGRDKLSFPSQTAKAYNNIFSYCLPSSSSYTGHLTFGTAGISRSVKFTPISTITEGTSFYGLDIVAITVGGQKLAIAPAVFSTPGALIDSGTVITRLPPKAYAALKDAFKAKMSQYPSASGVSILDTCFDLSGLKTFTIPKVAFSFSGGAVVELGSTGVLYAFKMSQVCLAFAGNSDDTNAAIFGNVQQQTLEVVYDGAGGRVGFAPNGCS

SEQ ID NO: 13269 - protein, 719 aa, Brassica napus
MPSHTNFLFRWIGLFSQKLRRETTEISENNGGESSSSSDDTPVLSSGECYACTQVGVPAFHSTSCDQANAPEWRASAGSSLVPIQEGSAPSPVRARIRRLKGPFGEVLDPRSKRVQRWNRALLLARGMALAVDPLFFYALSIGRTTGPACLYMDGAFAAVVTVVRTCLDALHLWHVWLQFRLAYVSRESLVVGCGKLVWDPRAIASHYARSLTGFWFDVIVILPVPQAVFWLVVPKLIREEKVKLIMTILLLIFLFQFLPKIYHCICLMRRMQKVTGYIFGTIWWGFALNLIAYFIASHVAGGCWYVLAIQRVASCIRQQCMRTANCNLSLSCQEEVCYQFVSPSSTIGFPCVSGNLTSVVKKPMCLDSDGPFRYGIYGWALPVISSNSLAVKILYPIFWGLMTLSTFGNDLEPTSNWLEVVFSIVMVLSGLLLFTLLIGNIQVFLHAVMAKKRKMQIRCRDMEWWMKRRQLPSRLRQRVRRFERQRWTALGGEDELELIQDLPPGLRRDIKRYLCVDLINNVPLFRGMDDLILDNICDRAKPRVYSKDEKIIREGDPVQRMIFIMRGRVKRNQSLSKGVVATSTLEPGGYLGDELLSWCLRRPFIDRLPPSSATFVCLDNIEAFSLGSEDLRYITDHFRYKFANERLKRTARYYSSNWRTWAAVNIQMSWRRYRKRTCGGVGGSMSPVSEHSVEGNSERRLLQYAAMFMSIRPHDHLE

SEQ ID NO: 13270 - protein, 721 aa, Brassica napus
MPSHTNFLFRWIGLFSQKLRRETTGISENNGGESSSSSSSDDTPVLSSGECYACTQVGVPAFHSTSCDQANTPEWRASAGSSLVPIQEGSAPDPVRARLRRLKGPFGEVLDPRSKRVQRWNRALLLARGMALAVDPLFFYALSIGRTTGPACLYMDGAFAAVVTVVRTCLDALHLWHVWLQFRLAYVSRESLVVGCGKLVWDPRAIASHYARSLTGFWFDVIVILPVPQAVFWLVVPKLIREEKVKLIMTILLLIFLFQFLPKIYHCICLMRRMQKVTGYIFGTIWWGFALNLIAYFIASHVAGGCWYVLAIQRVASCIRQQCMRTANCNLSLSCQEEVCYQFVSPTSTIGFPCLSGNLTSVVKKPMCLDSNGPFRYGIYGWALPVISSNSLAVKILYPIFWGLMTLSTFGNDLEPTSNWLEVVFSIVMVLSGLLLFTLLIGNIQVFLHAVMAKKRKMQIRCRDMEWWMKRRQLPSRLRQRVRRFERQRWTALGGEDELELIHDLPPGLRRDIKRYLCVDLINKVPLFRGMDDLILDNICDRAKPRVYSKDEKIIREGDPVQRMIFIMRGRVKRNQSLSKGVVATSTLEPGGYLGDELLSWCLRRPFIDRLPPSSATFVCLDNIEAFSLGSEDLRYITDHFRYKFANERLKRTARYYSSNWRTWAAVNIQMSWRRYRKRTCGGVGGSMSPVSEHSVEGNSERRLLQYAAMFMSIRPHDHLE

SEQ ID NO: 13271 - protein, 729 aa, Eutrema parvulum
MPSHPNFLLRWIGLFSEKLRRETSGIEEISIIQNNGGESSSGGDDTPVLSSVECYACTQVGVPAFHSTSCDQAHAPEWRASAGSSLVPIQEGSVPNPVRPRFRRPKGPFGEVLDPRSKRVQRWNRALLLARGMALAVDPLFFYALSIGRTTGPACLYMDGAFAAVVTVVRTCLDALHLWHVWLQFRLAYVSRESLVVGCGKLVWDPRAIASHYARSLTGFWFDVIVILPVPQAVFWLVVPRLIREEKVKLIMTILLLIFLFQFLPKIYHCICLMRRMQKVTGYIFGTIWWGFALNLIAYFIASHVAGGCWYVLAIQRVASCIRHQCMRTGNCNLSLSCQEEVCYQFASPTSTIGYPCLSGNLTSVVKKPMCLDPNGPFRYGIYGWALPVISSNSLAVKILYPIFWGLMTLSTFGNDLQPTSNWLEVIFSIVMVLSGLLLFTLLIGNIQVFLHAVMAKKRKMQIRCRDMEWWMKRRQLPSRLRQRVRRFERQRWTALGGEDELELIHDLPPGLRRDIKRYLCFDLINKVPLFRGMDDLILDNICDRAMPCVFSKDEKIIREGDPVQRMIFIMRGRVKRNQSLSKGVVATSTLEPGGYLGDELLSWCLRRPFIDRLPPSSATFVCLDNIEAFSLGSEDLRYITDHFRYKFANERLKRTARYYSSNWRTWAAVNLQMAWRRYRKRTRGGENIGGVGGSMSPVSDNSVEGNSERRLLQYAAMFMSIRPHDHLE

SEQ ID NO: 13272 - protein, 722 aa, Eutrema halophilum
MPSQPNFIFRWIGLFSDKFRRKTPGIEEISIVQNNSGESSSGDDTPVLSSVECYACTQVGVPAFHSTSCDQAHAPEWRASAGSSLVPIQEGSAPNPTRTRFRRLKGPFGEVLDPRSKRVQRWNRALLIARGMALAVDPLFFYALSIGRTTGPACLYMDGAFAAVVTAVRTCLDAVHLWHVWLQFRLAYVSRESLVVGCGKLVWDPRAIASHYARSLTGFWFDVIVILPVPQAVFWLVVPKLIREEKVKLIMTILLLIFLFQFLPKIYHCICLMRRMQKVTGYIFGTIWWGFALNLIAYFIASHVAGGCWYVLAIQRVASCIRQQCMRAGNCNLSLSCKEEVCYQFVSPIGYPCLSGNLTSVVNKPMCLDSNGPFRYGIYGWALPVISSNSLAVKILYPIFWGLMTLSTFGNDLEPTSNWLEVMFSIVMVLSGLLLFTLLIGNIQVFLHAVMAKKRKMQIRCRDMEWWMKRRQLPSRLRQRVRRFERQRWTALGGEDELELIQDLPPGLRRDIKRYLCFDLINKVPLFRGMDDLILDNICDRAKHRVFSKDEKIIREGDPVQRMIFIMRGRVKRNQSLSKGVVATSTLEQGGYLGDELLSWCLRRPFIDRLPPSSATFVCLDNIEAFSLGSEDLRYITDHFRYKFANERLKRTARYYSSNWRTWAAVNIQMAWRRYRKRTRGGENNGGSMSPVSENSVEGNSERRLLQYAAMFMSIRPHDHLE

SEQ ID NO: 13273 - protein, 726 aa, Arabidopsis thaliana
MPSHPNFIFRWIGLFSDKFRRQTTGIDENSNLQINGGDSSSSGSDETPVLSSVECYACTQVGVPAFHSTSCDQAHAPEWRASAGSSLVPIQEGSVPNPARTRFRRLKGPFGEVLDPRSKRVQRWNRALLLARGMALAVDPLFFYALSIGRTTGPACLYMDGAFAAVVTVLRTCLDAVHLWHVWLQFRLAYVSRESLVVGCGKLVWDPRAIASHYARSLTGFWFDVIVILPVPQAVFWLVVPKLIREEKVKLIMTILLLIFLFQFLPKIYHCICLMRRMQKVTGYIFGTIWWGFALNLIAYFIASHVAGGCWYVLAIQRVASCIRQQCMRTGNCNLSLACKEEVCYQFVSPTSTVGYPCLSGNLTSVVNKPMCLDSNGPFRYGIYRWALPVISSNSLAVKILYPIFWGLMTLSTFANDLEPTSNWLEVIFSIVMVLSGLLLFTLLIGNIQVFLHAVMAKKRKMQIRCRDMEWWMKRRQLPSRLRQRVRRFERQRWNALGGEDELELIHDLPPGLRRDIKRYLCFDLINKVPLFRGMDDLILDNICDRAKPRVFSKDEKIIREGDPVQRMIFIMRGRVKRIQSLSKGVLATSTLEPGGYLGDELLSWCLRRPFLDRLPPSSATFVCLENIEAFSLGSEDLRYITDHFRYKFANERLKRTARYYSSNWRTWAAVNIQMAWRRRRKRTRGENIGGSMSPVSENSIEGNSERRLLQYAAMFMSIRPHDHLE

SEQ ID NO: 13274 - protein, 726 aa, Arabidopsis lyrata
MPSHPNFIFRWIGMFSEKFRRQTTGIDENSILHINGGDSSSSGSDETPVLSSVECYACTQVGVPAFHSTSCDQAHAPEWRASAGSSLVPIQEASVPNPARTRFRRLKGPFGEVLDPRSKRVQRWNRALLLARGMALAVDPLFFYALSIGRTTGPACLYMDGAFAAVVTVLRTCLDAVHLWHVWLQFRLAYISRESLVVGCGKLVWDPRAIASHYARSLTGFWFDVIVILPVPQAVFWLVVPKLIREEKVKLIMTILLLIFLFQFLPKIYHCICLMRRMQKVTGYIFGTIWWGFALNLIAYFIASHVAGGCWYVLAIQRVASCIRQQCMRAGGCNLSLACKEEVCYQFVSPTSTVGYPCLSGNLTSVVNKPMCLDSNGPFRYGIYRWALPVISSNSLAVKILYPIFWGLMTLSTFANDLEPTSNWLEVIFSIVMVLSGLLLFTLLIGNIQVFLHAVMAKKRKMQIRCRDMEWWMKRRQLPSRLRQRVRRFERQRWNALGGEDELELVQDLPPGLRRDIKRYLCFDLINKVPLFRGMDDLILDNICDRAKPRVFSKDEKIIREGDPVQRMIFIMRGRVKRIQSLSKGVIATSTLEPGGYLGDELLSWCLRRPFLDRLPPSSATFVCLDNIEAFSLGCEDLRYITDHFRYKFANERLKRTARYYSSNWRTWAAVNIQMAWRRCRKRTRGENIGGSMSPVSENSIEGNSERRLLQYAAMFMSIRPHDHLE

SEQ ID NO: 13275 - protein, 363 aa, Brassica napus
MTMNSLPRRFGRDQGYLDRDHRRGRRSGSDSDEELKGLSHEEYRRLKRLKMRKSGKHCIWRNTPSPPRDPNEVESDENAADEEVPEKDEEDPKSESGKSESESDRSKRKSKSSRSKRSRRYSDSESDDDSDEEDRRRRRRKKKQKSSRKRRGHRRKRRYSDSDDESEISASSSSGEERSKSKSKKDTDSKGKLEEAGKEPELDEEEMKMIIESKKKALPEDEEEEGEVGPMPLPKAEGHISYGGALRPGEGDAIAQYVQQGKRIPRRGEVGLNADEIQRFEDLGYVMSGSRHQRMNAIRIRKENQVYSAEDKRALAMFNYEEKAKREAKVMSDLSRLVQRHMGEELGPNHDPFGAGKTDGADD

SEQ ID NO: 13276 - protein, 322 aa, Brassica napus
MNSLPRRFGRDQGYLDRDHRRGRRSGSDSDEELKGLSHEEYRRLKRLKMRKSGKHCIWRNTPSPPRDPNEVESDENAADEEVLEKDEEDPKSESGKSESESDRSKRKSKSSRSKRSRRYSDSESDDDSDEEDRRRRRRKKKQKSSRKRRGHRRKRRYSDSDDESEISASSSSGEERSKSKSKKDTDSKGKLEETVKEPELDEEEMKMIIESKKKASAPEEEEEAEVGPMPLPKAEGHISYGGALRPGEGDAIAQYVQQGKRIPRRGEVGLNADEIQRFEDLGYVMSGSRHQRMNAIRIRKENQVYSAEDKRALAMFNYEEKA

SEQ ID NO: 13277 - protein, 450 aa, Eutrema halophilum
MISQFFVLSQRGDNIVFRDYRAEVPKGSTETFFRKVKFWKEDGNAEAPPIFNVDGVNYFHVKVVGLYFVATSRVNVSPSLVLELLQRIARVIKDYLGVLNEDSFRKNFVLVYELLDEVIDFGYVQTTSTEVLKSYVFNEPIVIAPARLQPIDPAAIFTQGAKRMPGTAVTKSVVANEPGGRRREEIFVDIIEKISVTFSSSGYILTSEIDGTIQMKSYLSGNPEIRLALNEDLNIGRGGRSVYDYRSSSGSGVILDDCNFHESVRLDSFDSDRTLSLVPPDGEFPVMNYRMTQEFKPPFHVNTLIEEAGRLKAEVIIKIRAEFPSDIIANTITVQMPLPNYTSRASFELEPGAAGQKTDFKETSKMLAWSLKKIVGGAEHTLRAKLTFSQEFHGNITKEAGPVSMTFTIPMYNVSKLQVKYLQIAKKSSSYNPYRWVRYVTQANSYVARI

SEQ ID NO: 13278 - protein, 450 aa, Eutrema parvulum
MISQFFVLSQRGDNIVFRDYRAEVPKGSTETFFRKVKFWKEDGNAEAPPIFNVDGVNYFHVKVVGLYFVATTRVNVSPSLVLELLQRIARVIKDYLGVLNEDSFRKNFVLVYELLDEVIDFGYVQTTSTEVLKSYVFNEPIVVAPARLQPIDPAAIFTQGAKRMPGTAVTKSVVANDPGGRRREEIFVDIIEKISVTFSSSGYILTSEIDGTIQMKSYLSGNPEIRLALNEDLNIGRGGRSVYDYRSSSGSGVILDDCNFHESVRLDSFDSDRTLSLVPPDGEFPVMNYRMTQEFKPPFHVNTLIEEAGRLKAEVIIKIRAEFPSDIIANTITVQMPLPNYTSRASFELEPGAAGQKTDFKETSKMLEWSLKKIVGGADHTLRAKLTFSQEFHGNITKEAGPVSMTFTIPMYNVSKLQVKYLQIAKKSSSYNPYRWVRYVTQANSYVARL

SEQ ID NO: 13279 - protein, 450 aa, Raphanus sativus
MISQFFVLSQRGDNIVFRDYRAEVPKGSTETFFRKVKFWKEDGNAEAPPIFNVDGVNYFHVKVVGLYFVATTRVNVSPSLVLELLQRIARVIKDYLGVLNEDSFRKNFVLVYELLDEVIDFGYVQTTSTEVLKSYVFNEPILIAPARLQPIDPAAIFNQGAKRMPGTAVTKSVVANDPSGRRREEIFVDIIEKISVTFSSSGYILTSEIDGTIQMKSYLSGNPEIRIALNEDLNIGRGGRSVYDYRSSSGSGVILDDCNFHESVRLDSFDSDRTLSLVPPDGEFPVMNYRMTQEFKPPFHVNTLIEEAGRLKAEVIIKIRAEFPSDIIANTITVQMPLPNYTSRASFELEPGAAGQKTDFKETSKMLEWNLKKIVGGAEHTLRAKLTFSQEFHGNLTKEAGPVSMTFTIPMYNVSKLQVKYLQIAKKSSSYNPYRWVRYVTQANSYVARI

SEQ ID NO: 13280 - protein, 450 aa, Brassica napus
MISQFFVLSQRGDNIVFRDYRAEVPKGSTETFFRKVKFWKEDGNAEAPPIFNVDGVNYFHVKVVGLYFVATTRVNVSPSLVLELLQRIARVIKDYLGVLNEDSFRKNFVLVYELLDEVIDFGYVQTTSTEVLKSYVFNEPIVIAPARLQPIDPAAIFTQGAKRMPGTAVTKSVVANDPSGRRREEIFVDIIEKISVTFSSSGYILTSEIDGTIQMKSYLSGNPEIRIALNEDLNIGRGGRSVYDYRSSSGSGVILDDCNFHESVRLDSFDSDRTLSLVPPDGEFPVMNYRMTQEFKPPFHVNTLIEEAGRLKAEVIIKIRAEFPSDIIANTITVQMPLPNFTSRASFELEPGAAGQKTDFKESNKMLEWSLKKIVGGAEHTLRAKLTFSQEFHGNITKEAGPVSMTFTIPMYNVSKLQVKYLQIAKKSSSYNPYRWVRYVTQANSYVARI

SEQ ID NO: 13281 - protein, 236 aa, Brassica napus
MKSYLSGNPEIRIALNEDLNIGRGGRSVYDYRSSSGSGVILDDCNFHESVRLDSFDSDRTLSLVPPDGEFPVMNYRMTQEFKPPFHVNTLIEEAGRLKAEVIIKIRAEFPSDIIANTITVQMPLPNFTSRASFELEPGAAGQKSDFKETNKMLEWSLKKIVGGAEHTLRAKLTFSQEFHGNITKEAGPVSMTFTIPMYNVSKLQVKYLQIAKKSSSYNPYRWVRYVTQANSYVARI

SEQ ID NO: 13282 - protein, 452 aa, Arabidopsis lyrata
MISQFFVLSQRGDNIVFRDYRAEVPKGSTETFFRKVKFWKEDGNAEAPPIFNVDGVNYFHVKVVGLYFVATTRVNVSPSLVLELLQRIARVIKDYLGVLNEDSFRKNFVLVYELLDEVIDFGYVQTTSTEVLKSYIFNEPIVVAPARLQPIDPAAIFTQGNKRMPGTAVTKSVVANDPGGRRREEIFVDIIEKISVTFSSSGYILTSEIDGTIQMKSYLSGNPEIRLALNEDLNIGRGGRSVYDYRSSSGSGVILDDCNFHESVRLDSFDSDRTLSLVPPDGEFPVMNYRMTQEFKPPFHVNTLIEEAGRLKAEVIIKIRAEFPSDIIANTITVQMPLPNYTSRASFELEPGAAGQKTDFKESSKMLEWNLKKASIVGGGEHTLRAKLTFSQEFHGNITKEAGPVSMTFTIPMYNVSKLQVKYLQIAKKSSSYNPYRWVRYVTQANSYVARI

SEQ ID NO: 13283 - protein, 379 aa, Arabidopsis thaliana
MISQFFVLSQRGDNIVFRDYRAEVPKGSTETFFRKVKFWKEDGNAEAPPIFNVDGVNYFHVKVVGLYFVATTRVNVSPSLVLELLQRIARVIKDYLGVLNEDSFRKNFVLVYELLDEVIDFGYVQTTSTEVLKSYIFNEPIVVSPARLQPIDPAAIFTQGAKRMPGTAVTKSVVANDPGGRRREEIFVDIIEKISVTFSSSGYILTSEIDGTIQMKSYLSGNPEIRLALNEDLNIGRGGRSVYDYRSSSGSGVILDDCNFHESVRLDSFDSDRTLSLVPPDGEFPVMNYRMTQEFKPPFHVNTLIEEAGRLKAEVIIKIRAEFPSDIIANTITVQMPLPNYTSRASFELEPGAAGQRTDFKESNKMLEWNLKKANCWRG

SEQ ID NO: 13284 - protein, 446 aa, Brassica napus
FFVLSQRGDNIVFRDYRAEVPKGSTETFFRKVKFWKEDANAEAPPIFNVDGVNYFHVKVVGLYFVATTRVNVSPSLVLELLQRIARVIKDYLGVLNEDSFRKNFVLVYELLDEVIDFGYVQTTSTEVLKSYVFNEPIVIAPARLQPIDPAAIFTQGAKRMPGTAVTKSVVANDPSGRRREEIFVDIIEKISVTFSSSGYILTSEIDGTIQMKSYLSGNPEIRIALNEDLNIGRGGRSVYDYRSSSGSGVILDDCNFHESVRLDSFDSDRTLSLVPPDGEFPVMNYRMTQEFKPPFHVNTLIEEAGRLKAEVIIKIRAEFPSDIIANTITVQMPLPNFTSRASFELEPGAAGQKSDFKETNKMLEWSLKKIVGGAEHTLRAKLTFSQEFHGNITKEAGPVSMTFTIPMYNVSKLQVKYLQIAKKSSSYNPYRWVRYVTQANSYVARI

SEQ ID NO: 13285 - protein, 452 aa, Brassica napus
MISQFFVLSQRGDNIVFRDYRAEVPKGSTETFFRKVKFWKEDGNAEAPPIFNVDGVNYFHVKVVGLYFVATTKVNVSPSLVLELLQRIARVIKDYLGVLNEDSFRKNFVLVYELLDEVIDFGYVQTTSTEVLKAYVFNEPILIAPARLQPIDPAAIFTQGAKRMPGAAVTKPVLANDPGGRRREEIFVDIIEKISVTFSSSGYILTSEIDGTIQMKSYLSGNPEIRLALNEDLNIGRGGGGVSVYDYRSSSGSGVILDDCNFHESVRLNSFDSDRTLSLVPPDGEFPVMNYRMTQEFRPPFHVNTLIEEAGRLKAEVIIKIRAEFPSDIIANTIAVQMPLPNYTCRASFELEHDAVGQKTDFKETSKMLEWSLKKIVGGAEHTLRAKLTFSQEFHGNITKEAGPVSMTFTIPMYNVSKLQVKYLQIAKKSSSYNPYRWVRYVTQANSYVARI

SEQ ID NO: 13286 - protein, 451 aa, Gossypium hirsutum
MISQFFVLSQRGDNIVFRDYRGEVAKGSAEIFFRKVKFWKEDGQEEAPPVFNVDGVNYFHVKVVGLLFVATTRVNVSPSLVLELLQRIARVIKDYLGVLSEDSLRKNFVLVYELLDEVIDFGYVQTTSTEVLKSYVFNEPIVVDAARLQPLGPAAIFMQGTKRMPGTAVTKSVVANEPGGRKREEIFVDIIEKISVTFSSSGYILTSEIDGTIQMKSYLSGNPEIRLALNEDLSIGRGGGTVYDYRSSSGSGAVILDDCNFHESVRLDSFDMDRTLSLVPPDGEFPVMNYRMTQEFKPPFRINCLIEEAGQLKAEVIIKVRAEFPSNITANTIAVQMPLPKYTTRASFELEPGAVGQRTDFKEANKKLEWGLKKIVGGSEHTLRAKLTFSQESHANLTKEAGPVSMTFTIPMYNVSRLQVKYLQIAKKSSSYNPYRWVRYVTQANSYVARI

SEQ ID NO: 13287 - protein, 452 aa, Ricinus communis
MISQFFVLSQRGDNIVFRDYRGEVPKGSAEIFFRKVKFWKEDGQEEAPPVFNVDGVNYFHVKVVGLLFVATTRVNVSPSLVLELLQRIARVIKDYLGILNEDSLRKNFVLVYELLDEVIDFGYVQTTSTEVLKSYVFNEPIVVDVGRLQPMNPAAIFMQGTKRMPGTAVTKSVVANEPGGRKREEIFVDIIEKISVTFSSSGYILTSEIDGTIQMKSYLSGNPEIRLALNEDLGIGRGSGRSVYDYRSSSGSGAVILDDCNFHESVRLDNFDLDRTLTLVPPDGEFPVMNYRMTQEFKPPFRINTLIEEAGALKAEVILKISAEFPSSITANTINIQMSLPKYTTRATFELEPGVFGQTADFKEANKKLEWGLKKIVGGSEHTLRAKLTFSQELHGNITKEAGPVSMTFTIPMYNASRLQVKYLQIAKKSNTYNPYRWVRYVTQANSYVARI

SEQ ID NO: 13288 - protein, 446 aa, Populus trichocarpa
MISQFFVLSQRGDNIVFRDYRGEVPKGSAEIFFRKVKFWKEDGEEEAPPVFNVDGVNYFHVKVVGLLFVATTRANVSPSLVLELLQRIARVIKDYLGVLNEDSLRKNFVLVYELLDEVIDFGYVQTTSTELLKSYVFNEPLVVDAARLQPLSPAAIFMQGTKRMPGTAVTKSVVANEPGGRKREEIFVDIIEKISVTFSSSGYILTSEIDGTIQMKSYLSGNPEIRLALNEDLSIGRGDYRSSFGSGSVILDDCNFHESVRLDNFDLDRTLTLVPPDGEFPVMNYRMTQEFKPPFRINTLIEEAGALKAEVILKVSAEFPSSITANTIIVQMPLPKYTTRVNFELEPGALGQTTDFKEANRRLEWGLKKIVGGSEHTLRAKLTFSQELHGNITKEAGPVSMTFTIPMYNASRLQVKYLQIAKKSSTYNPYRWVRYVTQANSYVARI

SEQ ID NO: 13289 - protein, 452 aa, Manihot esculenta
MISQFFVLSQRGDNIVFRDYRGEVPKGSAEIFFRKVKFWKEDGQEEAPPVFNVDGVNYFHVKVVGLLFVATTRVNVSPSLVLELLQRIARVIKDYLGILNEDSLRKNFVLVYELLDEVIDFGYVQTTSTELLKSYVFNEPIVVDAGRLQPLNPAAIFMQGTKRMPGTAVTKSVVANEPGGRKREEIFVDIIEKISVTFSSSGYILTSEIDGTIQMKSYLTGNPEIRLALNEDLSIGRGNGRSAYDYRSSFGSGAVILDDCNFHESVRLDNFDLDRTLTLVPPDGEFPVMNYRLTQEFKPPFRINALIEVAGALKAEVILKISAEFPSSITANTISVQMPLPKYTARATYELEPGAIGQTTDFKEANKRLEWGLKKIVGGSEHTLRAKLTFSQELHGNITKEAGPVSMTFTIPMYNASRLQVKYLQIAKKSNTYNPYRWVRYVTQANSYVARI

SEQ ID NO: 13290 - protein, 451 aa, Tragopogon dubius
MISQFFVLSQRGDNIVFRDYRGDVQKGSAEIFFRKVKFWKEDGETEAPPVFNVDGVNYFHVKVVGLLFVATTRANVSPSLVLELLQRIARVTKDYLGILNEDSIRKNFVLVYELLDEVIDFGYVQTTSTEVLKSSVFNEPIMLDASHMPPLGPAALFMQGSKRMPGTAVTKSVVANEPGGRKREEIFVDIIEKISVTFSSSGYILTSEIDGTIQMKSYLSGNPEIRLALNEDLNIGRGGRSVYDYGGSSGSGSVILDDCNFHESVHLDSFDVDRTLTLVPPDGEFPVMNYRMTQEFKPPFRINTLIEEAGSLKAEVILKIRAEFPQNITANTVVIQMPVPTYTSRVSFELEPGAVGQMTDFKESNKKLEWGLKKIVGGTEHTLRAKLTFSHESHGNITKEAGPVSMTFTIPMYNCSRLQVKYLQIAKKSKTYNPYRWVRYVTQANSYVARI

SEQ ID NO: 13291 - protein, 450 aa, Tropaeolum majus
MISQFFVLSQRGDNIVFRDYRGEVPKGSAEIFFRKVKFWKEDGEGDAPPVFNVDGVNYFHVKVAGLLFVATTRVNVSPSLVLELLQRIARVIKDYLGVLNEDSFRKNFILVYELLDEVIDFGYVQTTSTEMLKSYVFNEPIVIEAARLPNLGPASLFMQGTKRMPGTAVTKSVVANEPGGKKREEIFVDIIEKISVTFSASGYILTSEIDGTIQMKSYLSGNPEIRLALNDDLSIGRGGRSIYDYNSSSGGAVILDDCNFHESVHLDNFENDRTLSLVPPDGEFPVMNYRMTQEFKPPFRINALIEVAGPLKAEVILKVRAEFPSSITANTIQIQMPLPTYTTRVSFELEPGTVGNTTDFKESSKKLEWGLKKIVGGSEHTLRAKLTFSQESHGNITKEAGPVSMTFTIPMYNTSKLQVKYLQIAKKSSSYNPYRWVRYVTQANSYVARL

SEQ ID NO: 13292 - protein, 451 aa, Ambrosia trifida
MISQFFVLSQRGDNIVFRDYRGDVQKGSAEIFFRKVKFWSEDGEAEAPPVFNVDGVNYFHVKVVGLLFVATTRTNVSPSLVLELLQRIARVTKDYLGILNEDSIRKNFVLVYELLDEVIDFGYVQTTSTEVLKSCVFNEPIMIDAAHMPPLGPAALFMQGNKRMPGTAVTKSVVANEPGGRRREEIFVDIIEKISLTFSSSGYILTSEIDGTIQMKSYLSGNPEIRLALNEDLNIGRGGRSVYDYGGSSGSGAVILDDCNFHESVHLDSFDVDRTLTLVPPDGEFPVMNYRMTQEFKPPFRINTLIEEAGSLKAEVILKIRAEFPQNITANTVVVQMPVPKYTSRVSFELESGAIGQVTDFKEPNKKIEWGLKKIVGGSEHTLRAKLTFAHESHGNITKEAGPVSMTFTIPMYNCSRLQVKYLQIAKKSKTYNPYRWVRYVTQANSYVARI

SEQ ID NO: 13293 - protein, 72 aa, Centaurea maculosa
MISQFFVLSQRGDNIVFRDYRSDVQKGSAEIFFRKVKFWKEDGETEAPPVFKCGWCQLLSRKGGWIAICCNH

SEQ ID NO: 13294 - protein, 131 aa, Ambrosia trifida
MISQFFVLSQRGDNIVFRDYRGDVQKGSAEIFFRKVKFWSEDGEAEAPPVFNVDGVNYFHVKVVGLLFVATTRANVSPSLVLELLQRIARVTKDYLGILNEDSIEKTLCLCMNYLMKLLILVMCKQHRLKF

SEQ ID NO: 13295 - protein, 287 aa, Gossypium hirsutum
MISQFFVLSQRGDNIVFRDYRGEVAKGSAEIFFRKVKFWKEDGQEEAPPVFNVDGVSYFHVKVVGLLFVATTRVNVSPSLVLELLQRIARVIKDYLGVLSEDSLRKNFVLVYELLDEVIDFGYMQTTSTEVLKSYIFNEPIVVDAARLQPLGPAAIFMQGTKRMPGTAITKSVVANEPGGRKREEIFVDIIEKISVTFSSSGYILTSEIDGTIQMKSYLTGNPEIRLALNEDLSIGRGGESANDYRSSYGSGAVILDDCNFMNQCALIVSIWIGLWLWYHRMVNFLS

SEQ ID NO: 13296 - protein, 451 aa, Carica papaya
MISQFFVLSQRGDNIVFRDYRGEVPKGSTEIFFRKVKFWKEDGQEEAPPVFNVDGVNYFHVKVVGLLFVATTRVNASPSLLLELLQRIARVIKDYLGVLNEDSLRKNFVLVYELLDEVIDFGYVQTTSTEVLKSYVFNEPIVISAARLQTLDPAAIFRQGIKRMPGTAVTKSVVANEPGGRKREEIFVDIIEKISVTFSSSGYILTSEIDGTIQMKSYLSGNPEIRLALNDELSIGRGGTSTYDYRTSYGSGSVILDDCNFHESVHLDSFDIDRTLTLVPPDGEFPVMNYRMTKEFKPPFRINALIEEAGSLKAEVILKVSAEFATNISANTVVIEMPLPKYTTRVSFELESGAIGQRTDFKEANKRLEWCLKKIFGGGEHTLRAKLTFSQEVHGNITKEAGPVSMTFTIPMYNASGLQVKYLQIAKKSANYNPYRWVRYVTQSNSYVARL

SEQ ID NO: 13297 - protein, 451 aa, Cichorium intybus
MISQFFVLSQRGDNIVFRDYRGDIQKGSAEIFFRKVKFWKEDGETEAPPVFNVDGVNYFHVKVVGLLFVATTRANVSPSLVLELLQRIARVTKDYLGILNEDSIRKNFVLVYELLDEVIDFGYVQTTSTEVLKSSVFNEPIMVDSAHMPPLGPAALFMQGNKRMPGTAVTKSVVANEPGGRKREEIFVDIIEKISVTFSSSGYILTSEIDGTIQMKSYLSGNPEIRLALNEDLNIGRGGRSVYDYGGSSGSGAVILDDCNFHESVHLDSFDVDRTLTLVPPDGEFPVMNYRMTQEFKPPFRINTLIEEAGSLKAEVILKIRAEFPQNITANTDVIQMPVPTYTSRVSFELEPGAVGQVTDFKESNKKLEWGLKKIVGGSEHTLRAKLTFSHESHGNITKEAGPVSMTFTIPMYNCSRLQVKYLQIAKKSKTYNPYRWVRYVTQAQFYVARI

SEQ ID NO: 13298 - protein, 450 aa, Actinidia deliciosa
ISQFFVLSQRGDNIVFRDYRGDVPKGSAEIFFRKVKFWKEDGEEEAPPVFNVDGVNYFHVKVVGLLFVATTRTNVSPSLVLELLQRIARVIKDYLGVLNEDSFRKNFVLVYELLDEVVDFGYVQTTSTEVLKSYVFNEPILVDAARLQTLGPANLFMQGSKRMPGTAITKSVVANEPGGRKREEIFVDIIEKISVTFSSSGYILTSEIDGTIQMKSYLTGNPEIRLALNEELSIGRGGRSIYDYSGSSGSGAVILDDCNFHESVHLDSFDMDRTLTLVPSDGEFPVMNYRLTQEFKPPFRINALIEESGPLKAEVILKIRAEFASSITANTILVQMPLPTYTSRVSFELEPGAVGQMTDFKESNKKLEWNLKKIVGGSELTMRAKLTFSQESHGNITKEAGPVSMTFTIPMYNASRLQVKYLQIAKKSKTYNPYRWVRYVTQANSYVARI

SEQ ID NO: 13299 - protein, 310 aa, Ambrosia trifida
MIDAAHMPPLGPAALFMQGNKRMPGTAVTKSVVANEPGGRRREEIFVDIIEKISLTFSSSGYILTSEIDGTIQMKSYLSGNPEIRLALNEDLNIGRGGRSVYDYGGSSGSGAVILDDCNFHESVHLDSFDVDRTLTLVPPDGEFPVMNYRMTQEFKPPFRINTLIEEAGSLKAEVILKIRAEFPQNITANTVVVQMPVPKYTSRVSFELESGAIGQVTDFKEPNKKIEWGLKKIVGGSEHTLRAKLTFAHESHGNITKEAGPVSMTFTIPMYNCSRLQGKYLQIAKKSKTYNPYRWVRYVTQANSYVARI

SEQ ID NO: 13300 - protein, 451 aa, Flaveria ramosissima
MISQFFVLSQRGDNIVFRDYRGDVQKGSAEIFFRKVKFWKEDGETEAPPVFNVDGVNYFHVKVVGLLFVATTRANVSPSLVLELLQRIARVTKDYLGILNEDSIRKNFVLVYELLDEVIDFGYVQTTSTEVLKSCVFNEPIMIDAAHMPPLGPAALFMQGNKRMPGTAVTKSVVANEPGGRRREEIFVDIIEKISLTFSSSGYILTSEIDGTIQMKSYLTGNPEIRLALNEDLNIGRGGRSVYDYGGSSGSGAVILDDCNFHESVHLDSFDVDRTLTLVPPDGEFPVMNYRMTQEFKPPFRINTLIEEAGSLKAEVILKVRAEFPQNITANTVVVQMPVPKYTSRVSFELESGAVGQVTDFKEPNKKIEWGLKKIVGGSEHTLRAKLTFAHESHGNITKEAGPVSMTFTIPMYNCSRLQVKYLQIAKKSKTYNPYRWVRYVTQANSYVARI

SEQ ID NO: 13301 - protein, 451 aa, Flaveria ramosissima
MISQFFVLSQRGDNIVFRDYRGDVQKGSAEIFFRKVKFWKEDGETEAPPVFNVDGVNYFHVKVVGLLFVATTRANVSPSLVLELLQRIARVTKDYLGILNEDSIRKNFVLVYELLDEVIDFGYVQTTSTEVLKSCVFNEPIMIDAAHMPPLGPAALFMQGNKRMPGTAVTKSVVANEPGGRRREEIFVDIIEKISLTFSSSGYILTSEIDGTIQMKSYLTGNPEIRLALNEDLNIGRGGRSVYDYGGSSGSGAVILDDCNFHESVHLDSFDLDRTLTLVPPDGEFPVMNYRMTQEFKPPFRINTLIEEAGSLKAEVILKVRAEFPQNITANTVVVQMPVPKYTSRVSFELESGAVGQVTDFKEPNKKIEWGLKKIVGGSEHTLRAKLTFAHESHGNITKEAGPVSMTFTIPMYNCSRLQVKYLQIAKKSKTYNPYRWVRYVTQANSYVARI

SEQ ID NO: 13302 - protein, 451 aa, Tabernaemontana elegans
MISQFFVLSQRGDNIVFRDYRGDVQKGSAEIFFRKVKFWKEDGEEEAPPVFNVDGVNYFHVKVAGLLFVATTRTNISPSLVLELLQRIARVIKDYLGVLNEDSLRKNFVLVYELLDEVIDFGYVQTTSTEVLKSYVFNEPIVVDAGRLPPLGPASMFMQGSKRMPGTAITKSVVANEPGGRKREEIFVDIIEKISVTFSSSGYILTSEIDGTIQMKSYLTGNPEIRLALNDELNIGRGGRSIYDYGGSSGSGAVILDDCNFHESVHLDSFDVDRTLSLVPPDGEFPVMNYRITQEFKPPFRINTLIEEAGQLKAEVILKIRAEFLSSITANTIVVQMPLPKYTTRVSFELEPGAVGQTTDFKESNRRLEWNLKKIVGGSEHTLRAKLTFSQETHGNITKEAGPVSMTFTIPMYNPSRLQVKYLQIAKKSKTYNPYRWVRYVTQANSYVARL

SEQ ID NO: 13303 - protein, 451 aa, Helianthus annuus
MISQFFVLSQRGDNIVFRDYRGDVQKGSAEIFFRKVKFWKEDGETEAPPVFNVDGVNYFHVKVVGLLFVATTRANISPSLVLELLQRIARVTKDYLGILNEDSIRKNFVLMYELLDEVIDFGYVQTTSTEVLKSCVFNEPIMIEAAHMPPLGPAALFMQGNKRMPGTAVTKSVVANEPGGRRREEIFVDIIEKISLTFSSSGYILTSEIDGTIQMKSYLSGNPEIRLALNEDLNIGRGGRSVYDYGGSSGSGAVILDDCNFHESVHLDSFDVDRTLTLVPPDGEFPVMNYRMTQEFKPPFRINTLIEEAGSLKAEVILKIRAEFPQNITANTVVVQMPVPKYTSRVSFELESGAVGQVTDFKEPTKKIEWGLKKIVGGSEHTLRAKLTFAHESHGNITKEAGPVSMTFTIPMYNCSRLQVKYLQIAKKSKTYNPYRWVRYVTQANSYVARI

SEQ ID NO: 13304 - protein, 451 aa, Artemisia annua
MISQFFVLSQRGDNIVFRDYRGDVQKGSAEIFFRKVKFWKEDGETEAPPVFNVDGVNYFHVKVVGLLFVATTRANVSPSLVFELLQRIARVTKDYLGILNEDSIRKNFVLMYELLDEVIDFGYVQTTSTEVLKSCVFNEPIMIDATHMPPLGPAALFMQGNKRMPGTAVTKSVVANEPGGRKREEIFVDIIEKISITFSSSGYILTSEIDGTIQMKSYLSGNPEIRLALNEDLNIGRGGRSVYDYGGSSGSGSVILDDCNFHESVHLDSFDVDRTLTLVPPDGEFPVMNYRMTQEFKPPFRINTLIEEAGSLKAEVILKIRAEFPQNISANTVSIQMPVPKYTSRVSFELEPGAVGQVTDFKEQNKKVEWGLKKIVGGSEHTLRAKLTFSHESHGNLTKEAGPVSMTFTIPMYNCSRLQVKYLQIAKKSKTYNPYRWVRYVTQANSYVARI

SEQ ID NO: 13305 - protein, 451 aa, Aquilegia formosa
MISQFFVLSQRGDNIVFRDYRSDVPKGSAEIFFRKVKFWKEDEEEEAPPVFNLDGVNYFHVKVAGLLFVATTRVNMSPSLVLELLHRIARVIKDYLGVLNEDSFRKNFVLVYELLDEVIDFGYAQTTSTELLKSYVFNEPIVVDAARLPPLGPAAMFMQGTKRMPGTAVTKSVVANEPGGRKREEIFVDIIEKISVTFSSSGYILTSEIDGTIQMKSYLTGNPEIRLALNEDLNIGRGGRSVYDYGSSAGAGSVILDDCNFHESVHLDSFDVDRTLSLVPPDGEFPVMNYRMTQEFKPPFRINALIEEAGAFKAEVILKVRAEFPSTITANTIVVQMPLPKHTTRVSFELESGAVGHTTDFKEANKKLEWGLKKIVGGSEHTLRAKLTFSQESHGNIMKEAGPVSMTFTIPMYNASKLQVRYLQIAKKSKTYNPYRWVRYVTQANSYVARL

SEQ ID NO: 13306 - protein, 294 aa, Sarracenia psittacina
MQGSKRMPGTAVTKSVVANEPGGRKREEIFVDIIEKISVTFSSSGYILTSEIDGTIQMKSYLTGNPEIRLALNEDLSIGRGGRSIYDSSGSSGSGAVILDDCNFHESVHLDSFEMDRTLTLVPPDGEFPVMNYRMTQEFKPPFHINALIEEAGSLKAEVILKIRAEFASSITANTILVQMPLPTYTTRVSFELEPGAVGQMTDFKEPNKKLEWSLKKIVGGSEHTLRAKLTFLQESHGNITKEAGPVSMTFTIPMYNASRLQVKYLQIAKKSKTYNPYRWVRYVTQSNSYVARI

SEQ ID NO: 13307 - protein, 451 aa, Cucumis melo
MISQFFVLSQRGDNIVFRDYRGEVPKGSAEIFFRKVKFWKEDGEGDAPPVFNLDGVNYFHVKVVGLLFVATTRINASPSLVLELLQRIARVIKDYLGVLNEDSLRRNFVLVYELLDEVIDFGYVQTTSTEVLKSYVFNEPIVVDAARLPPLGPASIFVQGSKRMPGTAVTKSVVANEPGGRKREEIFVDIIEKISVTFSSSGYILTSEIDGTIQMKSYLTGNPEIRLALNEDLSIGRGGRSIYDYSSSSGGGTVILDDCNFHESVHLDNFDTDRTLVLVPPEGEFPVMNYRMTQEFKPPFRINALIEEAGSLKAEVILKVRAEFASSITANTIMIQMPLPTFTTRVSFELEPGAVGNTTDFKEANKRLEWGLKKIVGGSEHTLRARLTFSQESHGNIVKEAGPVSMTFTIPMYNASRLQVKYLQIAKKSKTYNPYRWVRYVTQANSYVARL

SEQ ID NO: 13308 - protein, 451 aa, Citrullus lanatus
MISQFFVLSQRGDNIVFRDYRGEVPKGSAEIFFRKVKFWKDDGEGDAPPVFNLDGVNYFHVKVVGLLFVATTRTNASPSLVLELLQRIARVIKDYLGVLNEDSLRKNFVLVYELLDEVIDFGYVQTTSTEVLKSYVFNEPIVVDAARLPPLGPASIFVQGSKRMPGTAVTKSVVANEPGGRKREEIFVDIIEKISVTFSSSGYILTSEIDGTIQMKSYLTGNPEIRLALNEDLSIGRGGRSIYDYSSSSGGGTVILDDCNFHESVHLDNFDTDRTLVLVPPEGEFPVMNYRMTQEFKPPFRINALIEEAGSLKAEVILKVRAEFASSITANTIMIQMPLPTFTTRVSFELEPGAVGNTTDFKEANKRLEWGLKKIVGGSEHTLRARLTFSQESHGNIVKEAGPVSMTFTIPMYNASRLQVKYLQIAKKSNTYNPYRWVRYVTQANSYVARL

SEQ ID NO: 13309 - protein, 451 aa, Fragaria vesca
MISQFFVLSQRGDNIVFRDYRGEVPKGSAEIFFRKVKFWKEDGQEEAPPVFNVDGVNYFHVKVVGLLFVATTRANVSPSIVLELLQRIARVIKDYVGVLNEDSIRKNFVLVYELLDEVIDFGFVQTTSTELLKSYIFNEPIVVDAARLSSLGSPGLFMQGTKRMPGTAVTKSVVANEPGGRKREEIFVDIIEKISVTFSSSGYILTSEIDGTIQMKSYLTGNPEIRLALNEDLGIGRGGTSAYDYRSSFGSGAVILDDCNFHESVRLDNFDVDKTLTLVPPDGEFPVMNYRMTQEFKPPFRINALIEEAGSLKAEVILKLYAEFPSNITANTISVQMPLPKYTTRASFELEPGAVGQSTDFKEANKRLEWGLKKIVGGSEHTLRARLTFSQEFHGNITKEAGPVSMTFTIPMYNSSKLQVKYLQIAKKSGTYNPYRWVRYVTLANSYVARI

SEQ ID NO: 13310 - protein, 451 aa, Vitis vinifera
MISQFFVLSQRGDNIVFRDYRGEVPKGSAEIFFRKVKFWKEDGEGDAPPVFNVDGVNYFHVKVAGLLFVATTRVNVSPSLVLELLQRIARVIKDYLGILNEDSLRKNFVLVYELLDEVIDFGYVQTTSTEVLKSYVFNEPIVVDAARLPTLGPASIFMQGTKRMPGTAVTKSVVANEPGGRKREEIFVDIIEKISVTFSSSGYILTSEIDGTIQMKSYLTGNPEIRLALNEELSIGRGGRSIYDYNSSTGSGTVILDDCNFHESVHLDSFDIDRTLTLVPPDGEFPVMNYRMTQEFKPPFRINALIEEAGALRAEVILKVRAEFPSSITANTIQVQMPLPPYTTRVSFELEPGAVGNTTDFKEANKRLEWGLKKIVGGSEHTLRAKLTFSQELHGNITREAGPVSMTFTIPMYNASRLQVKYLQISKKSKAYNPYRWVRYVTQSNSYVARL

SEQ ID NO: 13311 - protein, 310 aa, Ambrosia trifida
MIDAAHMPPLGPAALFMQGNKRMPGTAVTKSVVANEPGGRRREEIFVDIIEKISLTFSSSGYILTSEIDGTIQMKSYLSGNPEIRLALNEDLNIGRGGRSVYGYGGSSGSGAVILDDCNFHESVHLDSFDVDRTLTLVPPDGEFPVMNYRMTQEFKPPFRINTLIEEAGSLKAEVILKIRAEFPQNITANTVVVQMPVPKYTSRVSFELESGAVGQVTDFKEPNKKIEWGLKKIVGGSEHTLRAKLTFAHESHGNITKEAGPVSMTFTIPMYNCSRLQVKYLQIAKKSKTYNPYRWVRYVTQANSYVARI

SEQ ID NO: 13312 - protein, 310 aa, Arnica chamissonis
MLDATHMPPLGPAALFMQGNKRMPGTAVTKSVVANEPGGRRREEIFVDIIEKISLTFSSSGYILTSEIDGTIQMKSYLSGNPEIRVALNEDLNIGRGGRSVYDYGGSSGSGAVILDDCNFHESVHLDSFDVDRTLTLVPPDGEFPVMNYRMTQEFKPPFRINTLIEEAGSLKAEVILKIRAEFPQNITANTVVVQMPVPKYTSRVSFELESGAVGQVTDFKEPNKKLEWGLKKIVGGSEHTLRAKLTFAHESHGNITKEAGPVSMTFTIPMYNCSRLQVKYLQIAKKTKNYNPYRWVRYVTQANSYVARI

SEQ ID NO: 13313 - protein, 444 aa, Euphorbia peplus
SQRGDNIVFRDYRGEVPKGSAEIFFRKVKFWNDDGEQDAPPVFNVDGVNYFHVKVVGLLFVATTRVNMSPSLVLELLQRIARVIKDYLGILNEDSLRKNFVLVYELLDEVIDFGYVQTTSTELLKSYVFNEPIVVDAGRLQPLNPAAMFMQGTKRMPGTAVTKSVVANEPGGRKREEIFVDIIEKISVTFSSSGYILTSEIDGTIQMKSYLSGNPEIRLALNEDLSIGRGGGRSVYDYRSSGGSGSVILDDCNFHESVRLDSLEVDRTLSLVPPDGEFPVMNYRMTQEFKPPFRINTLIEEAGALKAEVILKISAEFPSSITANTIIVQMPLPKYTTRATFETEPGAIGQTTDFKEANKKLEWGLKKIVGGSEHTLRAKLTFSQEFHGNLTKEAGPVSMTFTIPMYNASRLQVKYLQIAKKSNTYNPYRWVRYVTQANSYVARI

SEQ ID NO: 13314 - protein, 452 aa, Solanum lycopersicum
MISQFFVLSQRGDSIVFRDYRGDVPKGSAEIFFRKVKFWKEDGGEEAPPVFNVDGVNYFHVKVVGLLFVATSRTNLSPSLVLELLQRIARVIKDYLGVLNEDSLRKNFVLVYELLDEVVDFGYVQTTSTEILKSYIFNEPIMIDAGRLPPLGPAAMFMQGSKRMPGTAITKSVVANEPGGRKREEIFVDIIEKISITFSSSGYILTSEIDGTIQMKSYLTGNPEIRLALNEDLGIGRAGGRSAYDYGGSAGSGAVVLDDCNFHESVQLDSFDVDRTLTLVPPDGEFPVMNYRITQEFKPPFRINTLIEEAGSLKAEVILKIRAEFPSDITANTILVQMPLPTYTSRVSFELEPGTVGQTTDFKESNKRLEWNLKKVVGGSDHTLRAKLTFSQESHGNITKEAGPVSMTFTIPMYNPSRLQVKYLQIAKKSKTYNPYRWVRYVTQANSYVARI

SEQ ID NO: 13315 - protein, 448 aa, Quercus alba
MISQFFVLSQRGDNIVFRDYRGEIQKGSTEIFFRKVKFWKEDGQEEAPPVFNLDGVNYFHVKVVGLFFVATTRVNVSPSLVLELLQRIARVIKDYLGILNEESLRKNFVLVYELLDEVIDFGYVQTTSTEMLKSYVFNEPIVVEDARLQYSALFMQGTKRMPGTAVTKSVVANDPTGRRREEIFVDLIEKISITFSSSGYILTSEIDGTIQMKSYLTGNPEIRLALNDDLTIGRGGRSVFDYRSSSGTGAVILDDCNFHESVHLDSFEMDKTLSLVPPDGEFTVMNYRLTQEFKPPFRVNTLIEETGALKAEVIIKVRAEFSSSITANTIMVQMPLPKYTTRASFELEPGAIGQTTNFKEANRRLEWGLKKIVGGSEHTLRAKLTFSPESHGNITKESGPVSMTFTIPMYNASRLQVKYLQIAKKSGTYNPYRWVRYVTQANSYVARI

SEQ ID NO: 13316 - protein, 452 aa, Solanum phureja
MISQFFVLSQRGDSIVFRDYRGDVLKGSAEIFFRKVKFWKEDGGEEAPPVFNVDGVNYFHVKVVGLLFVATSRTNLSPSLVLELLQRIARVIKDYLGVLNEDSLRKNFVLVYELLDEVVDFGYVQTTSTEILKSYIFNEPIMIDAGRLPPLGPAAMFMQGSKRMPGTAITKSVVANEPGGRKREEIFVDIIEKISITFSSSGYILTSEIDGTIQMKSYLTGNPEIKLALNEDLGIGRAGGRSGYDYGGSAGSGAVVLDDCNFHESVQLDSFDVDRTLTLVPPDGEFPVMNYRITQEFKPPFRINTLIEEAGSLKAEVILKIRAEFPSDITANTILVQMPLPTYTSRVSFELEPGTVGQTTDFKESNKRLEWSLKKVVGGSDHTLRAKLTFSQESHGNITKEAGPVSMTFTIPMYNPSRLQVKYLQIAKKSKTYNPYRWVRYVTQANSYVARI

SEQ ID NO: 13317 - protein, 451 aa, Cannabis sativa
MISQFFVLSQRGDNIVFRDYRGEVQKETAEIFFRKVKFWKEDGQEEAPPVFNVDGVNYFHVKVVGLLFVATTRINLSPSFVFELLQRIARVIKDYLGVLNEDSLRRNFVLVYELLDEVIDFGYVQTTSTEVLKSYVFNEPIVVDSAHLSPLGPASLFMQGTKRMPGTAVTKSVVANDPSGRKREEIFVDIIEKISMTFSSSGYILTSEIDGTIQMKSYLTGNPEIRLALNDDLSIGRGGRSVYDYRSSVGSGVVILDDCNFHESVRLDSFEAEKTLSLVPPDGEFPVMNYRMTQEFKPPFRINALIEEAGALKAEVILKVHAEFPSSITANTISIQMPLPKYTMRASFELETGAVGQTTDFKEANKKLEWNLKKIVGGSEHTLRARLTFSQESHGNITKESGPVSMTFTIPMYNASKLQVKYLQIAKKSGTYNPYRWVRYVTLSNSYVARL

SEQ ID NO: 13318 - protein, 451 aa, Prunus persica
MISQFFVLSQRGDNIVFRDYRGEVPKGSAEIFFRKVKFWKEDGQEEAPPVFNVDGVNYFHVKVVGLLFVATTRANVSPSLVLELLQRIARVIKDYVGVLNEDSIRKNFVLVYELLDEVIDFGFVQTTSTELLKSYIFNEPIILDSARLSSIGPTGLFMQGTKRMPGTAVTKSVVASEPGGRKREEIFVDIIEKISVTFSSSGYILTSEIDGTIQMKSYLTGNPEIRLALNEDLSIGRGGGSAYDYRSSFGSGAVILDDCNFHESVRLDNFEVDKTLTLVPPDGEFPVMNYRMTQEFKPPFRINALIEEAGALKAEVILKIFAEFPSNITSNTIAVQMPLPKYTIRASFELEPGAVGQTTDFKEANKRLEWGLKKIVGGSEHTLRARLTFSPEAHGNITKESGPVSMTFTIPMYNSSRLQVKYLQIAKKSGTYNPYRWVRYVTLANSYVARI

SEQ ID NO: 13319 - protein, 378 aa, Unknown
  Sequence found in Organisms: Citrus clementina, Citrus sinensis
MISQFFVLSQRGDNIVFRDYRGEVQKGSAEIFFRKVKFWKDDGEEEAPPVFNVDGVNYFHVKVVGLLFVATTRVNVSPSLVLELLQRIARVIKDYLGVLNEDSLRKNFVLVYELLDEVIDFGYVQTTSTEVLKSYVFNEPIVVDAVRLQPLSPAAIFMQGTKRMPGTAVTKSVVANEPGGRKREEIFVDIIEKISVTFSSSGYILTSEIDGTIQMKSYLTGNPEIRLALNDDLLIGKGGRSIYDYRSSTGSGAVVLDDCNFHESVRLDSFDVDRTLSLVPPDGEFPVMNYRMTQEFKPPFRINTLVEEAGALKAEVIIKISAEFSASITANTIVVEMPLPKYTTRVSFGLEPGAVGQRTDFKEANRRLEWGLKKAIIS

SEQ ID NO: 13320 - protein, 451 aa, Cirsium arvense
MISQFFVLSQRGDNIVFRDYRGDVQKGSAEIFFRKVKFWTEDGEAEAPPVFNVDGVNYFHAKVVGLLFVATTRANVSPSLVLELLLRIARVTKDYLGILNEDSIRKNFVLMYELLDEVIDFGYVQTTSTEVLKSCVFNEPIMVDAARMPPLGPAALFMQGNKRMPGTAVTKSVVANEPGGRKREEIFVDIIEKISVTFSSSGYILTSEIDGTIQMKSYLSGNPEIRLALNEELNIGSSGRSLYDYTGSTGSGAVILDDCNFHESVHLDSFDVDRTLTLVPHDGEFPVMNYRMTQEFKPPFRINTLIEEAGSLKAEVILKVRAEFPQNITANTVVVQMPVPSYTSRISFEMESGAVGQVTDFKESNKKLEWGLKKIVGGSEHTLRAKLTFSQESHGNITKEAGPVSMTFTIPMYNCSRLQVKYLQIAKKSKTYNPYRWVRYVTQANSYVARI

SEQ ID NO: 13321 - protein, 452 aa, Quercus alba
MISQFFVLSQRGDNIVFRDYRGEVPKGSAEIFFRKVKFWKEDGEGDAPPVFNVDGVNYFHVKVAGLLFVATTRVNVSPSLVLELLQRIARVIKDYLGILNEDSLRKNFVLVYELLDEVIDFGYVKTTSTEVLKSYIFNEPIVIDAARVPSLGAAGIFMQGSKRRMPGTAVTKSVVANEPGGRKREEIFVDIIEKISVTFSSSGYILTSEIDGTIQMKSYLSGNPEIRLALNDDLSIGRGRSSIYDYGNSSGSGSVILDDCNFHESVHLDNFDIDRTLALVPPDGEFPVMNYRMTQEFRTPFRINALIEEAGPLKAEVILKVRAEFASSITANTILVQMPLPTYTTRVTFELEPGAVGNTTDFKEANKRLEWGLKKIVGGSEHTLRAKLTFSQESHGNIVKESGPVSMTFTIPMYNCSRLQVKYLQIAKKSKTDNPYRWVRYVTQANSYVARL

SEQ ID NO: 13322 - protein, 451 aa, Malus domestica
MISQFFLLSQRGDNIVFRDYRGEVPKGSAEIFFRKVKFWKEDGQEEAPPVFNVDGVNYFHVKVVGLLFVATTRANVSPSLVLELLQRIARVIKDYVGVLNEDSIRKNFVLVYELLDEVIDFGFVQTTSTELLKSYIFNEPIVLESARLSSIGPTGLFMQGTKRMPGTAVTKSVVANEPGGRKREEIFVDIIEKISVTFSSSGYILTSEIDGTIQMKSYLSGNPEIRLALNEDLGIGRGGGSGYDHRSSFGSGAVVLDDCNFHESVRLDNFEVDKTLTLVPPDGEFPVMNYRMTQEFKPPFRINALIEEKGAHKAEVILKIYAEFPSNITSNTIAIQMPLPKYTIRASFELEPGAVGQTTDFKDANKRLEWGLKKIVGGSEHTLRARLTFSPDAHGNITKESGPVSMTFTIPMYNSSRLQVKYLQIAKNSGTYNPYRWVRYVTLANSYVARI

SEQ ID NO: 13323 - protein, 253 aa, Fagopyrum esculentum
MISQFFVLSQRGDNIVFRDYRSDVPKGSTEIFFRKVKFWKEEDGEGDAPPVFNIDGVNYFHVKIVGLLFVATTRINTSPSLVLELLQRIARVIKDYLGILSEDSLRKNFVLVYELLDEVIDFGYVQTTSTEVLKSYIFNEPIVVDAARVPALGPASIFMQGNKRMPGTAVTKSVVANEPGGRKREEIFVDIIEKISVTFSSSGYILTSEIDGTIQMKSYLTGNPEIKLALNEDVCVGRGEVHMVMEAQLGLGQ

SEQ ID NO: 13324 - protein, 451 aa, Medicago truncatula
MISQFFVLSQRGDNIVFRDYRGEVPRGSAEIFFRKVKFWEDGELQEAPPVFNVDGVNYFHVKVVGLLFVATTRVNISPSFVFELLQRIARVIKDYLGILNEDSLRKNFVLVYELLDEVIDFGYVQTTSTELLKSYIFNEPLVIDAARLSPLGPAAIFSQGTKRMPGIAVTKSVVATEPGGRRREEIFVDIIEKISITFSSSGYILTSEIDGTIQMKSYLTGNPEIRLALNDDLSIGRSEGPISGYRSSSGSGAVVLDDCNFHESVRLDSFETNRTLSLIPPDGEFPVMNYRMTQPFKPPFRINALIEEAGSLKAEVFLKLSAEFASSITANTIKVQMPLPKYTTRVSFELEPGATGQTTDFREANKKLEWSLKKINGGSEHTLRAKLTFSQESHGNITKESGPVSMTFTIPMHNVSQLQVKYLQIGKKSGSHEPYRWVRYVTQANSYVARI

SEQ ID NO: 13325 - protein, 451 aa, Arachis hypogaea
MISQFFVLSQRGDNIVFRDYRGEVPKGSAEIFFRKVKFWEDGGLEEAPPVFNVDGVNYFHVKVVGLLFVATTRVNTSPSYVLELLQRIARVIKDYLGILNEDSLRKNFVLVYELLDEVIDFGYVQTTSTELLKSYVFNEPLVVDATRMPPLGPATLFAQGTKRMPGIAVTKSVVATEPGGRKREEIFVDIIEKISITFSSSGYILTSEIDGTIQMKSYLSGNPEIRLALNDDLAIGRGQGPVYGYRSSTGSGVVVLDDCNFHESVRLDSFEVDRTLSLVPPDGEFPVMNYRMTQEFKPPFRINALIEEAGAHKAEVILKVRAEFASSITANTIKVQMPLPKYTNRVSFELEPGASGQTTDFKEANKRLEWNLKKVVGGCEHTLRAKLSFSQELHGNITKESGPVSMTFTIPMYNASRLQVKYLQIAKKYGTHEPYRWVRYVTQANSYVARI

SEQ ID NO: 13326 - protein, 452 aa, Phalaenopsis aphrodite
MISQFFVLSQRGDNIVFRDYRGVVPKGSAEIFFRKVKFWKEDEAEEAPPVFNVDGVNYIHAKVAGLMFVATTRANISPSLVLELLQRIARIIKDYLGVLNEDSLRKNFVLVYELLDEIIDFGYPQTTSTEVLKSYVFNEPIVVDSSRMPPLGPAAMFMQSSKRMPGTAVTKSVVSNEPGGRQRDEIFVDVIEKISVTFSSSGYILTSEIDGTIQMKSYLSGNPDIRLALNEDLSIGRNVGNSMYDYRTSSGGGTVILDDCNFHESVHLDNFDLDRTLSLVPPDGEFSVMNYRMTQEFKPPFRINALIEEAGPLKAEVIIKIRADFLSSINANTITVQMPVPKYTTRVSFDLESGAIGQTTDFKEMNRKLEWSLNKIVGGSEHTLRAKLTFSQESHGNLTKEAGPVSMNFTIPMYNASKLQVRYLQIAKKSKTYNPYRWVRYVTQSNSYVARL

SEQ ID NO: 13327 - protein, 451 aa, Amorphophallus konjac
MISQFFVLSQRGDNIVFRDYRGEIQKGSAEIFFRKVKFWKGDEFEEAPPVFNVDGVNYIHVKVAGLLFVATTRVNVSPSLVLELLQRIARVTKDYLGVLNEDSLRKNFVLVYELLDEVIDFGYPQTTSTEVLKSYVFNEPIVVEAARLPPLGPAAMFMQGTKRMPGTAVTKSVVANEPGGRKREEIFVDVIEKISVTFSSSGYILTSEIDGTIQMKSYLTGNPEIRLALNEELSIGRNGSSIYGYSSSAGGGPVILDDCNFHESVHLDSFDVDRTLMLIPPDGEFSVMNYRMTQEFKPPFRVNALIEEAGAFKAEVILKVRADFPSSITANTILVQMPLPAYTTRVSFELEAGAVGNTTDFKEGTKRLEWGLRKIVGGSEHTLRAKLTFTQESHGNIMREAGPVNMTFTIPMYNASRLQVRYLQIAKKSKTYNPYRWVRYVTQANSYVARL

SEQ ID NO: 13328 - protein, 446 aa, Cirsium arvense
MISQFFVLSQRGDNIVFRDYRGDVQKGSAEIFFRKVKFWKEDGETEAPPVFNVDGVNYFHVKVVGLLFVATTRANVSPSLVLELLQRIARVTKDYLGILNEDSIRKNFVLVYELLDEVIDFGYVQTTSTEVLKSSVFNEPIMIDATQMPPLGPAALFMQGSKRMPGTAVTKSVVANEPGGRKREEIFVDIIEKISVTFSSSGYILTSEIDGTIQMKSYLSGNPEIRLALNDDLNIGRGGRSVYDYGGSSGSGAVILDDCNFHESVHLDSFDVDRTLTLVPPDGEFPVMNYRMTQEFKPPFRINTLIEEAGSLKAEVILKIRAEFPQNINANTVVVQMPLPPYTSRVSFELEPGAVGQVTDFKESNKKLEWGLKKIIGGSDHTLRAKLTFSHESHGNITKEAGPVSMTFTIPMYNCSKLQVKYLQIAKKSKTYKSISVGEIRYTSQF

SEQ ID NO: 13329 - protein, 234 aa, Platanus occidentalis
MSLGVGKREEIFVDIIEKISVTFSSSGYILTSEIDGTIQMKSYLTGNPEIRLALNEDLSIGRDGRSIYDYSSSAGAGSVILDDCNFHESVRLDSFDIDRTLTLVPPDGEFPVMNYRMTQEFKPPFRINALIEEAGALRAEVILKIRADFPSSITANTIVVQMPVPTYTTRVSFELEPGAVGNTTDFRESNKRIEWGLKKIVGGSEHTLRAKTHIFTRITCKYHKRSWTSRHDFY

SEQ ID NO: 13330 - protein, 131 aa, Trigonella foenum-graecum
MISQFFVLSQRGDNIVFRDYRGEVPRGSAEIFFRKVKFWEDGELQEAPPVFNVDGVNYFHVKVVGLLFVATTRVNISPSFVFELLQRIARVIKDYLGILNEDSIEKTLSWCTSYSMKLSISVMCKQHLRNC

SEQ ID NO: 13331 - protein, 443 aa, Lotus japonicus
MISQFFVLSQRGDNIVFRDYRGEVQKGSAETFFRKVKFWKEDAEGDAPPVFNVDGVNYFHVKAAGLLFVATTRVNVSPSLVLGLLQRIARVIKDYLGVLNEDSFRKNFVLVYELLDEMIDFGYVQTTSTELLKSYVFNEPIMIDAARLPPMGPASIFMQGTKRMPGTAITKSVFANESGGKKREEIFVDVIEKISATFNSSGFILTSEIDGTIQMKSYLTGNPEIRLALNEDLSIGTSDYRGSGAVILDDCNFHESVHLDSFDVDRTLSLVPPDGEFPVMNYRMTQPFKPPFRINVLIEETGPLKAEVTIKIRAEFNSSINANTVLVQMPLPTSTARVNFELEPGAVGHTTDFKETNKRLEWGIKKVVGGSEHTLRAKLTLSHEFHGNIMKEAGPLSMTFTIPMYNASRLQVKYLQIAKKSKAHNPYRWVRYVTQANSYVARL

SEQ ID NO: 13332 - protein, 451 aa, Pinus taeda
MISQFFVLSQRGDNIVFRDYRGEVPKGSAEIFFRKVKFWKNDDGEEAPPVFNVDGVNYLHVKVAGLLFVATTRVNVSPALVLELLQRIARVIKDYLGILNEDSLRKNFVLVYELLDEVIDFGYPQNTSTEVLKSFIFNEPIVVDAGRGPSLSPAAMFMQGSKRMPGTAVTKSVVANEPGGRKREEVFVDVIEKISVTFSASGYILTSEIDGTIQMKSYLTGNPEIRLALNEDLSIGRSGHSSYDYSSSSGAGMVILDDCNFHESVRLDNFDLDRTLTLVPPDGEFPVMNYRMTQEFKPPFHVNTLIEEAGSLKAEVMLKVRADFSSTITANTVALHMPLPKYTTRVSFDLESGAVGQTTDFKEGNKMLEWGLRKIVGGSEHTLRAKLSFSQETNMNITKESGPVSMTFTIPMYSASRLQVRYLQIVKKSRTYNPYRWVRYVTQANSYVIRI

SEQ ID NO: 13333 - protein, 443 aa, Glycine max
MILQFFVLSQRGDNIVYRDYRGEAQKGSAETFFRKVKFWKEDAEGDAPPVFNIDGVNYFHVKVAGLLFVATTRVNVSPSLVLELLQRIARVIKDYLGVLNEDSFRKNFVLVYELLDEVIDFGYVQTTSTEDLKSYVFNEPIVIDAARMPPLGPASIFMQGTKRMPGTAITKSVVANEPGGRKRDEIFVDVIEKISVTFNSSGFILTSEIDGTIQMKSYLTGNPEIRLALNEDLSIGTSDYRGSGAVILDDCNFHESVHLDSFDVDRTLSLVPPEGEFPVMNYRMTQPFKPPFRINALIEETGSLKAEVTIKVRAEFNSSINANTVLVQMPLPSFTSRVTFELEPGAVGHTTDFKEANKRLEWGLKKVVGGSEHTLRAKLTFSQELHGNIMKEAGPVSMTFTVPMYNASRLQVKYLQIAKKSKAHNPYRWVRYVTQANSYVARL

SEQ ID NO: 13334 - protein, 450 aa, Sorghum bicolor
MISQFFVLSQRGDHIVFRDYRGEVPKGSAEIFFRKVKFWNDDEAEEAPPVFNVDGVNYIHVKVAGLFFVVTTMVNVSPSLLLELLQRIARVTKDYLGVLNEDSLRKNFILVYELLDEVIDFGYPQTTSTEVLKSYIFNEPIMVDAGRLPPLGPAAMFMQGTKRMPGTAVTKSVVATEPGGKKREEIFVDIIERISVTFSSSGYILTSEIDGTIQMKSYLTGNPEIRLALNEDLSIGRTGSSYDYRSSSGGGTVILDDCNFHESVHLDSFDIDRTLTLIPPDGEFPVMNYRMTQEFKPPFRVTALIEEAGPSRAEVLLKIRADFSANATANTITVQMPVPSYTMRASFELEAGAVGQTTDFKEGSRRLEWNLKKIVGGSEHTLRAKLTFSQESHGNITKEAGPVNMNFTIPMYNASKLQVRYLQIAKKSKAYNPYRWVRYVTQANSYVARL

SEQ ID NO: 13335 - protein, 452 aa, Mimulus guttatus
MISQFFVLSQRGDNIVFRDYRSDVQKGSAEIFFRKVKFWKEDGKEEAPPVFNLDGVNYFHVKVVGLLFVATTRINLSPSLALELLQRIARVIKDYLGVLNEESLRKNFVLVYELLDEVIDFGYVQTTSTEVLKSYIFNEPIVVDAARLPPLGPASLFMQGTKRMPGTAVTKSVVANEPGGRKREEIFVDIIEKISVTFSSSGYVLTSEIDGTIQMKSYLTGNPEIKLALNDDLYVGRGGVPNYGGYSGSSGSGAVILDDCNFHESVHMDNFEVDKTLSLVPPDGEFPVMNYRITQEFKPPFTVNTLIEEAGSLKAEVILKIRAEFPSNITANTVLVEMPLPACTTRVNFDLERGVVGQNADFKESQKRLEWSVKKMVGGSEHTLRAKLNFSQELHGNITKEAGPVSMTFTIPMYNPSRLEVKYLQIAKKSKTSNPYRWVRYVTQANSYVARM

SEQ ID NO: 13336 - protein, 451 aa, Cephalotaxus harringtonia
MISQFFVLSQRGDNIVFRDYRGEVPKGSAEIFFRKVKFWKGDDEEEAPPIFNVDGVNYLHVKVAGLLFVATTRVNVSPALVLELLQRIARVIKDYLGILNEDSLRKNFVLVYELLDEVIDFGYPQTTSTEVLKSFIFNEPIVVDAGRLPSLGPASMFMQGSKRMPGTAVTKSVVANEPGGRKREEVFVDIIEKISVTFSSSGYILTSEIDGTIQMKSYLTGNPEIRLALNEDLSIGRSGHSSYDYSSSTGAGMVILDDCNFHESVRLDNFDLDRTLTLVPPDGEFPVMNYRMTQEFKPPFRVNSLIEEAGAFKAEVMLKVRADFSNTITANTAALHMPLPKYTTRVSFELEPGAVGQSTDFKEGSKMLEWGLRKIVGGADHTLRAKLTFSQDTNINITKESGPVSMTFTIPMYSASRLQVRYLQIVKKSRTYNPYRWVRYVTHANSYVIRI

SEQ ID NO: 13337 - protein, 451 aa, Zea mays
MISQFFVLSQRGDHIVFRDYRGEVPKGSAEIFFRKVKFWNDDEAEEAPPVFNVDGVNYIHVKVAGLFFVVTTMVNVSPSLLLELLQRIARVTKDYLGVLNEDSLRKNFILVYELLDEVIDFGYPQTTSTEVLKSYIFNEPIMVDAGRLPPLGPAAMFMQGTKRMPGTAVTKSVVATEPGGKKREEIFVDIIERISVTFSSSGYILTSEIDGTIQMKSYLTGNPEIRLALNEDLSIGRTGSSSYDYRSSSGGGTVILDDCNFHESVHLDSFDIDRTLTLIPPDGEFPVMNYRMTQEFKPPFRVTALIEEAGPARAEVLLKIRADFSASATANTIVVQMPVPAYTMRASFELEAGAVGQTTDFKEGSRRLEWNLKKIVGGSEHTLRAKLTFSQESHGNITKEAGPVNMNFTIPMYNASKLQVRYLQIAKKSKAYNPYRWVRYVTQANSYVARL

SEQ ID NO: 13338 - protein, 451 aa, Pinus pinaster
MISQFFVLSQRGDNIVFRDYRGEVPKGSAEIFFRKVKFWKNDDGEEAPPVFNVDGVNYLHVKVAGLLFVATTRVNVSPALVLELLQRIARVIKDYLGILNEDSLRKNFVLVYELLDEVIDFGYPQNTSTEVLKSFIFNEPIVVDAGRGPSLSPAAMFMQGSKRMPGTAVTKSVVANEPGGRKREEVFVDVIEKISVTFSASGYILTSEIDGTIQMKSYLTGNPEIRLALNEDLSIGRSGHSSYDYSSSSGAGMVILDDCNFHESVRLENFDLDRTLTLVPPDGEFPVMNYRMTQEFKPPFHVNTLIEEAGSLKAEVMLKVRADFSSTITANTVALHMPLPKYTTRVSFDLESGAVGQTTDFKEGNKTLEWGLRKIVGGSEHTLRAKLSFSQETNMNITKESGPVSMTFTIPMYSASRLQVRYLQIVKKSRTYNPYRWVRYVTQANSYVIRI

SEQ ID NO: 13339 - protein, 450 aa, Orobanche aegyptiaca
MISQFFVLSQRGDNIVFRDYRSDVQKGSAEIFFRKVKFWKEDGKEEAPPVFNLDGVNYFHVKVVGLLFVATTRGNLSPSLALELLQRIARVIKDYLGVLSEESLRKNFVLVYELLDEVVDFGYVQTTSTEVLKSYIFNEPIVVDAARIPSLGPAALFMQGNKRMPGTAVTKSVVANEPGGRKREEIFVDIIEKISVTFSSSGYVLTSEIDGTIQMKSYLTGNPEIKLALNDDLYIGKSGASNYGYSSSGTGPVILDDCNFHESVHMDNFDVDRTLSLVPSDGEFPVMNYRITQEFKPPFSINTLIEEAGTLKAEVILKIRAEFPSSITANTVLVEMPLPACTTRVSFDLERGIAGQNADFKESQRKLEWSVKKMVGGSEHTLRAKLNFSQELHGNITKEAGPVSMTFTIPMYNPSRLQVKYLQIAKKAKTSNPYRWVRYVTQANSYVARI

SEQ ID NO: 13340 - protein, 450 aa, Triphysaria pusilla
MISQFFVLSQRGDNIVFRDYRGDVQKGSAEIFFRKVKFWKEDGKEEAPPVFNLDGVNYFHVKMVGLLFVATARVNLAPSLALELLQRIGRVIKDYLGVLSEESLRKNFVLVYELLDEVIDFGYVQTTSTEVLKSYIFNEPIVVDSARMPPLGPAALFMQGNKRMPGTAVTKSVVANEPGGRKREEIFVDIIEKISVTFSSSGYVLTSEIDGTIQMKSYLTGNPEIKLALNDDLYIGKSGISNYGYSSSGVGPVILDDCNFHESVHMDNFDVDRTLSLVPPEGEFPVMNYRITQEFKPPFSINTLIEEAGTLKAEVILKIRAEFPSSITANTIFVEMPLPAYTTRVNFDLERGIVGQSADFKESQKKLEWSMKKIVGGSEHTLRAKLNFSQELHGNITKEAGPVSMTFTIPMYNPSRLQVKYLQIAKMAKTSNPYRWVRYVTQANSYVARM

SEQ ID NO: 13341 - protein, 450 aa, Saccharum officinarum
MISQFFVLSQRGDHIVFRDYRGEVPKGSAEIFFRKVKFWNDDEAEEAPPVFNVDGVNYIHVKVAGLFFVVTTMVNVSPSLLLELLQRIARVTKDYLGVLNEESLRKNFILVYELLDEVIDFGYPQTTSTEVLKSYIFNEPIMVDAGRLPPLGPAAMFMQGTKRMPGTAVTKSVVATEPGGKKREEIFVDIIERISVTFSSSGYILTSEIDGTIQMKSYLTGNPEIRLALNEDLSIGRTGSSYDYRSSSGGGTVILDDCNFHESVHLDSFDIDRTLTLIPPDGEFAVMNYRMTQEFKPPFRVTALIEEAGPSRAEVLLKIRADFSANATANTITVQMPVPSYTMRASFELEAGAVGQTTDFKEGSRRLEWNLKKIVGGCEHTLRAKLTFSQESHGNITKEAGPVNMNFTIPMYNASKLQVRYLQIAKKSKAYNPYRWVRYVTQANSYVARL

SEQ ID NO: 13342 - protein, 716 aa, Brassica napus
MALSAFAFPSYITTKGGLTDSCCKSTSLSSSRSLSADLPSPCLRPNTSHSNRKAKVNASLAEKGEYYSNRPPTPLLDTINYPIHMKNLSIKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAVGRDLKGKNNNVVAVIGDGAMTAGQAYEAMNNAGYLDSDMIVILNDNKQVSLPTATLDGPSPPVGALSSALSRLQSNPALRELREVAKGVTKQIGGPMHQLAAKVDEYARGMISGTGSTLFEELGLYYIGPVDGHNIDDLVAILKEVKSARTTGPVLIHVITEKGRGYPYAERADDKYHGVVKFDPATGKQFKSSNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEAELFNIVATAAAIDDRPSCFRYPRGNGIGVALPPGNKGVPLEVGKGRILKEGERVALLGYGSAVQSCLGAAVMLQERGLNVTVADARFCKPLDRALIRSLAKSHEVLITVEEGSIGGFGSHVVQFLALDGLLDGKLKWRPMVLPDRYIDHGSPADQMAEAGLMPSHIAATALNLIGAPREALY

SEQ ID NO: 13343 - protein, 716 aa, Brassica rapa
MALSAFAFPSYITTKGGLTDSCCKSNSLSSSRSLSADLPSPCLRPNTSHSNRKAKVNASLAEKGEYYSNRPPTPLLDTINYPIHMKNLSTKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLRMAVGRDLKGKNNNVVAVIGDGAMTAGQAYEAMNNAGYLDSDMIVILNDNKQVSLPTATLDGPSPPVGALSSALSRLQSNPALRELREVAKGVTKQIGGPMHQLAAKVDDYARGMISGTGSTLFEELGLYYIGPVDGHNIDDMVAILKEVKSARTTGPVLIHVVTEKGRGYPYAERADDKYHGVVKFDPATGKQFKSSNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEAELFNMVATASAIDDRPSCFRYPRGNGIGVALPPGNKGVPVEVGKGRILKEGERVALLGYGSAVQSCLGAAVMLQERGLNVTVADARFCKPLDRALIRSLAKSHEVLITVEEGSIGGFGSHVVQFLALDGLLDGKLKWRPMVLPDRYIDHGSPADQMAEAGLMPSHIAATALNLIGAPREALY

SEQ ID NO: 13344 - protein, 716 aa, Brassica napus
MALSAFAFPSYITTKGGLTDSCCKSSSLSSSRSFSADLPSPCLRPNTSHSNRKAKVNASLAEKGEYYSNRPPTPLLDTINYPIHMKNLSIKELKQLSDELRSDVIFNVSKTGGHLGSSLGVVELTVALHYIFNTPQDKILWDVGHQSYPHKILTGRRDKMPTMRQTNGLSGFTKRGESEHDCFGTGHSSTTISAGLGMAVGRDLKGKNNNVVAVIGDGAMTAGQAYEAMNNAGYLDSDMIVILNDNKQVSLPTATLDGPSPPVGALSSALSRLQSNPALRELREVAKGVTKQIGGPMHQLAAKVDEYARGMISGTGSTLFEELGLYYIGPVDGHNIDDLVAILKEVKSARTTGPVLIHVITEKGRGYPYAERADDKYHGVVKFDPATGKQFKSTNKTQSYTTYFAEALVAEAEGDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEAELFNIVATAAAIDDRPSCFRYPRGNGIGVALPPGNKGVPFEVGKGRILKEGERVALLGYGSAVQSCLGAAVMLQERGLNATVADARFCKPLDRALIRNLAKSHEVLITVEEGSIGGFGSHVVQFLALDGLLDGKLKWRPMVLPDRYIDHGSSADQIAEAGLMPSHIAATALNLIGAPREALY

SEQ ID NO: 13345 - protein, 715 aa, Eutrema parvulum
MALSAFAFPSYIITKGVLTDSCKSTSLSSSRSLATDLPSPCPRPNNCHSNRKAKVNASLSEKGEYYSNRPPTPLLDTINYPIHMKNLSIKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAVGRDLKGKNNNVVSVIGDGAMTAGQAYEAMNNAGYLDSDMIVILNDNKQVSLPTATLDGPSAPVGALSSALSRLQSNPALRELREVAKGVTKQIGGPMHQLAAKVDEYARGMISGTGSTLFEELGLYYIGPVDGHNIDDLVAILKEVKSARTTGPVLIHVITEKGRGYPYAERADDKYHGVVKFDPATGKQFKSTNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEAELFNIVATAAAIDDRPSCFRYPRGNGIGVALPPGNKGVPIEIGKGKILKEGERVALLGYGSAVQSCLGAAVMLEERGLNVTVADARFCKPLDRALIRSLSKSHEVLITVEEGSIGGFGSHVVQFLALDGLLDGKLKWRPMVLPDRYIDHGSPADQMAEAGLMPSHIAATALNLIGAPREALY

SEQ ID NO: 13346 - protein, 715 aa, Brassica napus
MALSAFAFPSYIIAKGVLTDSCKQTSLSSSRSLATDLPSPCRRPNNSHSNRKVKVNASLVEKGEYYSNRPPTPLLDTINYPIHMKNLSIKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAVGRDLKGKSNNVVAVIGDGAMTAGQAYEAMNNAGYLDSDMIVILNDNKQVSLPTATLDGPSPPVGALSSALSRLQSNPALRELREVAKGVTKQIGGPMHQLAAKVDEYARGMISGTGSTLFEELGLYYIGPVDGHNIDDMVAILKEVKSARTTGPVLIHVVTEKGRGYPYAERADDKYHGVVKFDPATGKQFKSSNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEAELFHMVATASAIDDRPSCFRYPRGNGIGVALPPGNKGIPLEVGKGRILKEGERVALLGYGSAVQSCLGAAVMLQERGLNITVADARFCKPLDRALIRSLAKSHEVLITVEEGSIGGFGSHVVQFLALDGLLDGKLKWRPMVLPDRYIDHGSPADQMAEAGLMPSHIAATALNLIGAPWEALY

SEQ ID NO: 13347 - protein, 715 aa, Brassica napus
MALSAFAFPSYIIAKGVLTDSCKQTSLSSSRSLATDLPSPCRRPNNSHSNRKVKVNASLVEKGEYYSNRPPTPLLDTINYPIHMKNLSIKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAVGRDLKGKSNNVVAVIGDGAMTAGQAYEAMNNAGYLDSDMIVILNDNKQVSLPTATLDGPSPPVGALSSALSRLQSNPALRELREVAKGVTKQIGGPMHQLAAKVDEYARGMISGTGSTLFEELGLYYIGPVDGHNIDDMVAILKEVKSARTTGPVLIHVVTEKGRGYPYAERADDKYHGVVKFDPATGKQFKSSNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEAELFHMVATASAIDDRPSCFRYPRGNGIGVALPPGNKGVPLEVGKGRILKEGERVALLGYGSAVQSCLGAAAMLQERGLNITVADARFCKPLDRALIRSLAKSHEVLITVEEGSIGGFGSHVVQFLALDGLLDGKLKWRPMVLPDRYIDHGSPADQMAEAGLMPSHIAATALNLIGAPWEALY

SEQ ID NO: 13348 - protein, 715 aa, Eutrema halophilum
MALSAFAFPSYIIAKGVLTDSCKSTSLSSSGSLVTDLPSPCPRPKSCHSNRKAKVSASLAEKGEYYSNRPPTPLLDTINYPIHMKNLSIKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAVGRDLKGKSNNVVAVIGDGAMTAGQAYEAMNNAGYLDSDMIVILNDNKQVSLPTATLDGPSPPVGALSSALSRLQSNPALRELREVAKGVTKQIGGPMHQLAAKVDEYARGMISGTGSTLFEELGLYYIGPVDGHNIDDLVAILKEVKSARTTGPVLIHVITEKGRGYPYAERADDKYHGVVKFDPATGKQFKSSNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEAELFNIVATAAAIDDRPSCFRYPRGNGIGVALPPGNKGVPIEIGKGRILKEGERVALLGYGSAVQSCLGAAMMLQERGLNITVADARFCKPLDGALIRSLAKTHEVLITVEEGSIGGFGSHVVQFLALEGLLDGKLKWRPMVLPDRYIDHGSPADQMAEAGLMPSHIAATALNLIGAPREALF

SEQ ID NO: 13349 - protein, 717 aa, Arabidopsis thaliana
MASSAFAFPSYIITKGGLSTDSCKSTSLSSSRSLVTDLPSPCLKPNNNSHSNRRAKVCASLAEKGEYYSNRPPTPLLDTINYPIHMKNLSVKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAVGRDLKGKNNNVVAVIGDGAMTAGQAYEAMNNAGYLDSDMIVILNDNKQVSLPTATLDGPSPPVGALSSALSRLQSNPALRELREVAKGMTKQIGGPMHQLAAKVDEYARGMISGTGSSLFEELGLYYIGPVDGHNIDDLVAILKEVKSTRTTGPVLIHVVTEKGRGYPYAERADDKYHGVVKFDPATGRQFKTTNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEADLFNMVATAVAIDDRPSCFRYPRGNGIGVALPPGNKGVPIEIGKGRILKEGERVALLGYGSAVQSCLGAAVMLEERGLNVTVADARFCKPLDRALIRSLAKSHEVLITVEEGSIGGFGSHVVQFLALDGLLDGKLKWRPMVLPDRYIDHGAPADQLAEAGLMPSHIAATALNLIGAPREALF

SEQ ID NO: 13350 - protein, 483 aa, Arabidopsis lyrata
MASSAFAFPSYIITKGGVSTDSCKSTSLSSSRSLVTDLSSPCLRPNNNSHTNRRAKVNASLAEKGEYYANRPPTPLLDTINYPIHMKNLSVKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAVGRDLKGKNNNVVAVIGDGAMTAGQAYEAMNNAGYLDSDMIVILNDNKQVSLPTATLDGPSPPVGALSSALSRLQSNPALRELREGMTKQIGGPMHQLAAKVDEYARGMISGTGSSLFEELGLYYIGPVDGHNIDDLVAILKEVKSTRTTGPVLIHVVTEKGRGYPYAERADDKYHGVVKFDPATGKQFKSTNKTQSYTTYFAEALVAEAEVDKDVVAIHAAMGGGTGLNLFQRRFPTRCFDVGIAEQHAVTFAAGLACEGLKPFCAIYSSFMQRAYDQASCT

SEQ ID NO: 13351 - protein, 716 aa, Cleome spinosa
MALSAFAFPSYISRGTTPTDSYKSAPLSSSSSLSTDFPSVSSGKTTVHSKRKPGGVYASLAEKGEYYANRPPTPLLDTINYPIHMKNLSVKELKQLSDELRSDVIFNVSKTGGHLGSSLGVVELTVALHYVFNSPQDRILWDVGHQSYPHKILTGRRGKMNTLRQTNGLSGFTKRAESEYDCFGAGHSSTTISAGLGMAVGRDLKGRNNNVVAVIGDGAMTAGQAYEAMNNAGYLDSDMIVILNDNKQVSLPTATLDGPAPPVGALSSALSKLQSNRPLRELREVAKGVTKQIGGPMHELAAKVDEYARGMISGSGATLFEELGLYYIGPVDGHNIDDLVAILNEVKSTRTTGPVLIHVVTEKGRGYPYAERATDKYHGVVKFDPATGKQFKTSAKTQSYTTYFAEALISEAEADKDVVAIHAAMGGGTGLNLFQRRFPTRCFDVGIAEQHAVTFAAGLACEGVKPFCAIYSSFLQRAYDQVVHDVDLQKLPVRFAMDRAGLVGADGPTHCGAFDVTFMACLPNMVVMAPSDEAELFHMVATAAAIDDRPSCFRYPRGNGIGVPLPLGNKGVPLEIGRGRILMEGERVALLGYGSAVQSCVAAAAMLKDRDVNVTVADARFCKPLDRDLIRKLAKSHEVLITVEEGSIGGFGSHVVQFLALDGLLDGKLKWTPMVLPDRYIDHGSPSDQLAEAGLTPSHIAATVMNLLGSPREALF

SEQ ID NO: 13352 - protein, 715 aa, Cleome gynandra
MALSAFALPSYIRRGTSSDSYKTTSLSSSSFLSTNLPSLFPSNTNTHSKRKSVGVYASITEEGEYYSHRPPTPLLDTISYPIHMKNLSVKELKQLADELRSDVIFNVSKTGGHLGSSLGVVELTVALHYIFNTPQDKILWDVGHQSYPHKILTGRRGKMHTLRQTNGLSGFTKRAESEYDCFGTGHSSTTISAGLGMAVGRDLKGRNNNVVAVIGDGAMTAGQAYEAMNNAGYLDSDMIVILNDNKQVSLPTATLDGPVPPVGALSSALSRLQSNRPLRELREVAKGVTKQFGGTMHQLAAKVDEYARGMISGSGATLFEELGLYYIGPVDGHNIDDLVTILNEVKSSRTTGPVLIHVVTEKGRGYPYAERAADKYHGVVKFDPATGKLFKSSAKTQSYTTYFAEALIAEAEVDKDIVAIHAAMGGGTGLNLFQRRFPTRCFDVGIAEQHAVTFAAGLACEGIKPFCTIYSSFMQRAYDQVVHDVDLQKLPVRFAMDRAGLVGADGPTHCGAFDVTFMACLPNMVVMAPSDEAELFHMVATAAAIDDRPSCFRYPRGNGIGVPLPPGNKGVPLEIGRGRIMMEGDRVALLGYGSAVQSCLAAAYMLKERDVKITVADARFCKPLDRELIRSLAKSHEILITVEEGSIGGFGSHVVQFLALDGLLDGKLKWRPMVLPDRYIEHGSPVDQLAEAGLTPSHIAATVMNLLGSPREALL

SEQ ID NO: 13353 - protein, 720 aa, Ricinus communis
MALCAFSFPAHANKVTTASSDLQKSNYVSSNFLLKTDLLGQSMQKFNQGKKRPAGVCASLSETGEYHSQRPPTPLLDTINYPIHMKNLSIKELKQLSDELRSDVIFNVSITGGHLGSSLGVVELTVALHYVFNAPQDKILWDVGHQSYPHKILTGRRDKMQTMRQTNGLSGFTKRSESEYDCFGTGHSSTTISAGLGMAVGRDLKGRKNNVVAVIGDGAMTAGQAYEAMNNAGYLDSDMIVILNDNKQVSLPTANLDGPIPPVGALSSALSRLQSNKPLRELREVAKGVTKRIGGPMHELAAKVDEYARGMISGSGSTLFEELGLYYIGPVDGHNVDDLVAILKEVKSTKTTGPVLIHVVTEKGRGYPYAEKAADKYHGVTKFDPATGKQFKGSASTQSYTTYFAEALIAEAEVDKDVVAIHAAMGGGTGLNLFLRRFPTRCFDVGIAEQHAVTFAAGLACEGLKPFCAIYSSFMQRAYDQVVHDVDLQKLPVRFAMDRAGLVGADGPTHCGAFDVTFMACLPNMVVMAPSDEAELFHMVATAAAIDDRPSCFRYPRGNGIGVQLPPGNKGIPLEVGKGRILIEGERVALLGYGSAVQSCLAAASLMETYDLRITVADARFCKPLDHALIRSLAKSHEVLITVEEGSIGGFGSHVAHFLALDGLLDGKLKWRPVILPDRYIDHGSPADQLVEAGLTPSHIAATIFNILGNKREALQIMSA

SEQ ID NO: 13354 - protein, 722 aa, Ricinus communis
MALCAFSFPAHANKVTTASSDLQKSNYVSSNFLLKTDLLGQSMQKFNQAKGKKRPAGVCASLSETGEYHSQRPPTPLLDTINYPIHMKNLSIKELKQLSDELRSDVIFNVSITGGHLGSSLGVVELTVALHYVFNAPQDKILWDVGHQSYPHKILTGRRDKMQTMRQTNGLSGFTKRSESEYDCFGTGHSSTTISAGLGMAVGRDLKGRKNNVVAVIGDGAMTAGQAYEAMNNAGYLDSDMIVILNDNKQVSLPTANLDGPIPPVGALSSALSRLQSNKPLRELREVAKGVTKRIGGPMHELAAKVDEYARGMISGSGSTLFEELGLYYIGPVDGHNVDDLVAILKEVKSTKTTGPVLIHVVTEKGRGYPYAEKAADKYHGVTKFDPATGKQFKGSASTQSYTTYFAEALIAEAEVDKDVVAIHAAMGGGTGLNLFLRRFPTRCFDVGIAEQHAVTFAAGLACEGLKPFCAIYSSFMQRAYDQVVHDVDLQKLPVRFAMDRAGLVGADGPTHCGAFDVTFMACLPNMVVMAPSDEAELFHMVATAAAIDDRPSCFRYPRGNGIGVQLPPGNKGIPLEVGKGRILIEGERVALLGYGSAVQSCLAAASLMETYDLRITVADARFCKPLDHALIRSLAKSHEVLITVEEGSIGGFGSHVAHFLALDGLLDGKLKWRPVILPDRYIDHGSPADQLVEAGLTPSHIAATIFNILGNKREALQIMSA

SEQ ID NO: 13355 - protein, 719 aa, Capsicum annuum
MALCAYAFPGILNRTVAVASDASKPTPLFSEWIHGTDLQFQFHQKLTQVKKRSRTVQASLSESGEYYTQRPPTPIVDTINYPIHMKNLSLKELKQLADELRSDTIFNVSKTGGHLGSSLGVVELTVALHYVFNAPQDRILWDVGHQSYPHKILTGRREKMSTLRQTNGLAGFTKRSESEYDCFGTGHSSTTISAGLGMAVGRDLKGRNNNVIAVIGDGAMTAGQAYEAMNNAGYLDSDMIVILNDNRQVSLPTATLDGPVPPVGALSSALSRLQSNRPLRELREVAKGVTKQIGGPMHELAAKVDEYARGMISGSGSTLFEELGLYYIGPVDGHNIDDLISILKEVRSTKTTGPVLIHVVTEKGRGYPYAERAADKYHGVAKFDPATGKQFKGSAKTQSYTTYFAEALIAEAEADKDIVAIHAAMGGGTGMNLFLRRFPTRCFDVGIAEQHAVTFAAGLACEGLKPFCAIYSSFMQRAYDQVVHDVDLQKLPVRFAMDRAGLVGADGPTHCGAFDVTFMACLPNMVVMAPSDEAELFHIVATAAAIDDRPSCFRYPRGNGIGVELPAGNKGIPLEVGKGRILVEGERVALLGYGSAVQNCLAAASVLESRGLQVTVADARFCKPLDRALIRSLAKSHEVLVTVEKGSIGGFGSHVVQFMALDGLLDGKLKWRPIVLPDRYIDHGSPADQLAEAGLTPSHIAATVFNILGQTREALEVMT

SEQ ID NO: 13356 - protein, 719 aa, Quercus alba
MALCAFSFPAHVSRAAASDPQKVASFSSHFTLGTDLQCQFQHKLNQIQVRKRPGGVCASLSEKDEYHSQRPPTPLLDTINYPIHMKNLSVKELKQLSDELRSDVIFNVSKTGGHLGSSLGVVELTVALHYVFNAPQDRILWDVGHQSYPHKILTGRRGKMHTIRQTNGLAGFTKRSESEYDCFGTGHSSTTISAGLGMAVGRDLKGRRNNVVAVIGDGAMTAGQAYEAMNNAGYLDSDMIVILNDNKQVSLPTATLDGPIPPVGALSSALSRLQSNRPLRELREVAKGVTKQIGGPMHELAAKVDEYARGMISGSGSTLFEELGLYYIGPVDGHNIDDLISILKEVKSTKTTGPVLIHVVTEKGRGYPYAEKAADKYHGVAKFDPATGKQFKTKAPTQSFTTYFAEALIAEAEIDKDIVAIHAAMGGGTGLNQFLRRFPTRCFDVGIAEQHAVTFAAGLACEGVKPFCAIYSSFMQRAYDQVVHDVDLQKLPVRFAMDRAGLVGADGPTHCGAFDVTFMACLPNMVVMAPSDEAELFHMVATAAAIDDRPSCFRYPRGNGVGVQLPPGNKGIPLEVGKGRILIEGERVALLGYGTAVQSCLAAASLVESRDLRVTVADARFCKPLDRALIRSLAKSHEYLITVEEGSIGGFGSHVAQFLALDGLLDGEVKWRPLVLPDRYIDHGSPADQLTDAGLTPYHIAATVFNIIGQTREALEIMS

SEQ ID NO: 13357 - protein, 717 aa, Tabernaemontana elegans
MALCAFTFPGSLSKTVASDSLKNSLFYSSWLYGSDLPSPIQAKNNQVTKRSNGVRASLSERGEYFSQRPPTPLLDTINYPIHMKNLSTKELKQLADELRSDIIFNVSKTGGHLGSSLGVVELTVALHYVFNCPKDRILWDVGHQSYPHKILTGRRDKMPTLRQTNGLSGFTKRSESEYDCFGAGHSSTTISAGLGMAVGRDLKGRKNNVVAVIGDGAMTAGQAYEAMNNAGYLDSDMIVILNDNKQVSLPTATLDGPAPPVGALSSALSRLQSNRPLRELREVAKGVTMQIGGPVHELAAKVDEYARGLISGSGSTLFEELGFYYIGPVDGHNIDDLVAILKEVKSTKTTGPVLIHVVTEKGRGYPYAEKAADKYHGVVKFDPATGKQFKSSPKTQSYTTYFAEALIAEAEADKDIVAIHAAMGGGTGMNLFLRRFPKRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEAELFHMVATAAAIDDRPSCFRYPRGNGIGVELPPGNKGIPLEVGKGRILIEGERAALLGYGTAVQSCLAAAALVEPHGLRLTVADARFCKPLDRALIRSLAKSHEVLITVEEGSIGGFGSHVAQFMALDGLLDGNLKWRPLVLPDRYIDHGSSDNQLAEAGLTPSHIAASVFNILGQTREALEVMS

SEQ ID NO: 13358 - protein, 717 aa, Nicotiana tabacum
  misc_feature (5)..(5): Xaa can be any naturally occurring amino acid
  misc_feature (8)..(8): Xaa can be any naturally occurring amino acid
  misc_feature (20)..(21): Xaa can be any naturally occurring amino acid
  misc_feature (30)..(30): Xaa can be any naturally occurring amino acid
  misc_feature (38)..(39): Xaa can be any naturally occurring amino acid
  misc_feature (85)..(85): Xaa can be any naturally occurring amino acid
  misc_feature (101)..(101): Xaa can be any naturally occurring amino acid
  misc_feature (103)..(103): Xaa can be any naturally occurring amino acid
MALCXYAXPGILNRTVASDXXKQSPLFSEXFHGTDLQXXFQHKLTQVKKRSRGVQASLSERGEYYAQRPPTPLLDTINYPIHMKXLSVKELKQLAEELRSXTXFNVSKTGGHLGSSLGVVELTVALHYVFNTPQDRILWDVGHQSYPHKILTGRRGKMSTLRQTDGLAGFTKRSESEYDCFGTGHSSTTISAGLGMAVGRDLKGKNNNVIAVIGDGAMTAGQAYEAMNNAGYLDSDMIVILNDNRQVSLPTATLDGPAPPVGALSSALSRLQSNRPLRELREVAKGVTKQIGGPMHELAAKVDEYARGMISGSGSTLFEELGLYYIGPVDGHNIDDLISILKEVRSTKTTGPVLIHVITEKGRGYPYAERAADKYHGVAKFDPATGKQFKVSAKTQSYTTYFAEALIAEAEADKDIVAIHAAMGGGTGMNLFHRRFPTRCFDVGIAEQHAVTFAAGLACEGLKPFCAIYSSFLQRAYDQVVHDVDLQKLPVRFAMDRAGLVGADGPTHCGAFDVTFMACLPNMVVMAPSDETELFHMVATAAAIDDRPSCFRYPRGNGIGVELPVGNKGTPLEVGKGRILVEGERVALLGYGSAVQNCLAAAAVLETRGLQVTVADARFCKPLDGALIRSLAKSHEVLITVEEGSIGGFGSHVAQFMALDGLLDGKLKWRPIVLPDRYIDHGSPADQLAEAGLTPSHIAATVFNILGQTREALEVMT

SEQ ID NO: 13359 - protein, 721 aa, Populus trichocarpa
MALSAFSFPAHVNSVTSLEHPQKFSLLSSHFLWRTDLLSQSLDKINQIHVKKRANGICASLSERGEYHSQRPPTPLLDTINYPIHMKNLSVKELKQLADELRSDVIFNVSKTGGHLGSSLGVVELTVALHYVFNAPQDKILWDVGHQSYPHKILTGRRDKMHTIRQTNGLAGFTKRSESEYDCFGTGHSSTTISAGLGMAVGRDLKGGTNKVVAVIGDGAMTAGQAYEAMNNAGYLDSDMIVILNDNKQVSLPTANLDGPIPPVGALSSALSRLQSNRPLRELREVAKGVTKQIGGPMHELAAKVDEYARGMISGSGSTLFEELGLYYIGPVDGHNIDDLIAILKEVKSTKTTGPVLIHVVTEKGRGYPFAERAADKYHGVAKFDPATGKQFKASPSTQSYTTYFAEALTAEAEADKDIVAIHAAMGGGTGLNLFLRRFPTRCFDVGIAEQHAVTFAAGLACEGLKPFCAIYSSFLQRAYDQVVHDVDLQKLPVRFAMDRAGLVGADGPTHCGAFDVTFMACLPNMVVMAPSDEAELFHMVATATAIDDRPSCFRYPRGNGVGVQLPPGNKGVPLEVGKGRMLIEGERVALLGYGTAVQSCLAAASLVERHGIRLTVADARFCKPLDHALIRSLAKSHEILITVEEGSIGGFGSHVVQFLALDGLLDGKLKWRPVVLPDRYIDHGSPADQLVEAGLTPSHIAATVFSILGQRREALEIMSS

SEQ ID NO: 13360 - protein, 719 aa, Solanum lycopersicum
MALCAYAFPGILNRTGVVSDSSKATPLFSGWIHGTDLQFLFQHKLTHEVKKRSRVVQASLSESGEYYTQRPPTPILDTVNYPIHMKNLSLKELKQLADELRSDTIFNVSKTGGHLGSSLGVVELTVALHYVFNAPQDRILWDVGHQSYPHKILTGRRDKMSTLRQTDGLAGFTKRSESEYDCFGTGHSSTTISAGLGMAVGRDLKGRNNNVIAVIGDGAMTAGQAYEAMNNAGYLDSDMIVILNDNRQVSLPTATLDGPVAPVGALSSALSRLQSNRPLRELREVAKGVTKQIGGPMHELAAKVDEYARGMISGSGSTLFEELGLYYIGPVDGHNIDDLIAILKEVRSTKTTGPVLIHVVTEKGRGYPYAERAADKYHGVAKFDPATGKQFKASAKTQSYTTYFAEALIAEAEADKDIVAIHAAMGGGTGMNLFHRRFPTRCFDVGIAEQHAVTFAAGLACEGIKPFCAIYSSFMQRAYDQVVHDVDLQKLPVRFAMDRAGLVGADGPTHCGAFDVTYMACLPNMVVMAPSDEAELFHMVATAAAIDDRPSCFRYPRGNGIGVELPAGNKGIPLEVGKGRILIEGERVALLGYGSAVQNCLDAAIVLESRGLQVTVADARFCKPLDHALIRSLAKSHEVLITVEEGSIGGFGSHVVQFMALDGLLDGKLKWRPIVLPDRYIDHGSPVDQLAEAGLTPSHIAATVFNILGQTREALEVMT

SEQ ID NO: 13361 - protein, 720 aa, Gossypium hirsutum
MALCASSFPAIINWGAASDPQKSTPFASHFLGGSDLVLQPLKKLNQVKKRPGGVYASLSEGAEYHSQRPATPLLDTINYPIHMKNLSVKELKQLSEELRSDVIFNVSKTGGHLGSSLGVVELTVALHYVFNAPRDKILWDVGHQSYPHKILTGRRHKMHTMRQTNGLAGFTKRSESEYDCFGTGHSSTTISAGLGMAVGRDLKGERNHVVAVIGDGAMTAGQAYEAMNNAGYLDSDMIVILNDNKQVSLPTANLDGPIPPVGALSSALSRLQSNRPLRELREVAKGVTKQIGGPMHELAAKVDEYARGMISGSGSTLFEELGLYYIGPVDGHNIDDLVSILKEVKTTKTTGPVLIHVVTEKGRGYPYAERAADKYHGVVKFDPATGKQFKGNSATQSYTTYFAEALIAEAEADKNIVAIHAAMGGGTGLNLFLRRFPQRCFDVGIAEQHAVTFAAGLACEGLKPFCAIYSSFMQRAYDQVVHDVDLQKLPVRFAMDRAGLVGADGPTHCGAFDVTFMACLPNMVVMAPSDEAELFHMVATAAAIDDRPSCFRYPRGNGIGVQLPPGKKGVPLEVGKGRVLIEGERVALLGYGSAVQSCLAAASLLESHGLRLTVADARFCKPLDHALIRKLAKSHEVLITVEEGSIGGFGSHVAQFLALDGLLDGKVKWRPLVLPDRYIDHGSPVDQLAEAGLTPSHIAATVFNVLEQKREALEVMSSRN

SEQ ID NO: 13362 - protein, 720 aa, Hevea brasiliensis
MALSACSFPAHVNKNTISDLQKYSYVPSHSLWRKNPLAQSLDRLNQAKSKKRPEGICASLSEREEYHSQRPPTPLLDTTNYPIHMKNLSIKELKQLADELRSDVIFNVSRTGGHLGSSLGVVELTVALHYVFNAPQDKILWDVGHQSYPHKILTGRREKMHTIRQTNGLSGFTKRSESEYDCFGTGHSSTTISAGLGMAVGRDLKGKKNNVVAVIGDGAMTAGQAYEAMNNAGYLDSDMIVILNDNKQVSLPTATLDGPIPPVGALSSALSRLQSNRPLRELREVAKGVTKQIGGPMHERAAKVDEYARGMISGSGSTLFEELGLYYIGPVDGHNIDDLIAILKEVKSTKTTGPVLIHVVTEKGRGYPYAEKAADKYHGVTKFDPATGKQFKGSAITQSYTTYFAEALIAEAEVDKDIVAIHAAMGGGTGLNLFLRRFPTRCFDVGIAEQHAVTFAAGLACEGLKPFCAIYSSFMQRAYDQVVHDVDLQKLPVRFAMDRAGLVGADGPTHCGAFDVTFMACLPNMVVMAPSDEAELFHMVATAAAIDDRPSCFRYPRGNGVGVQLPPGNKGIPLEVGKGRILIEGERVALLGYGTAVQSCLAAASLVEPHGLLITVADARFCKPLDHTLIRSLAKPHEVLITVEEGSIGGFGSHVAHFLALDGLLDGKLKWRPLVLPDRYIDHGSPSVQLIEAGLTPSHVAATVLNILGNKREALQIMSS

SEQ ID NO: 13363 - protein, 723 aa, Citrus sinensis
MALSAFSFPTYVSKATNSDPHKSSPVTSHFFGAALFSHFSQKLDNHQIQLKKRPNGVCASLSERGEYHSQRPPTPLLDTINYPIHMKNLSIRELKQLADELRADVIFNVSKTGGHLGSSLGVIELTVALHYVFNAPKDRILWDVGHQTYPHKILTGRRDKMHTMRQTDGLSGFTKRSESEYDCFGTGHSSTSISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKQIGGPMHELAAKVDEYARGMISGSGSTLFEELGLYYIGPVDGHNVDDLVAILEEVKNTKTTGPVLIHVVTEKGRGYPYAEKAADKYHGVAKFDPATGKQFKSSARTQSYTTYFAEALIAEAEVDKDVVAIHAAMGGGTGLNLFLRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEAELFHMVATAAAIDDRPSCFRYPRGNGIGVELPPGNKGIPLEVGKGRILIEGERVALLGYGTAVQSCLAASALLESHGLRLTVADARFCKPLDHALIRSLAKSHEVLITVEEGSIGGFGSHVVQFLALDGLLDGTVKWRPLVLPDRYIDHGSPADQLAQAGLTPSHIAATVFNILGQTREALEIMSFKS

SEQ ID NO: 13364 - protein, 718 aa, Cucumis melo
MALCMLTFPAHVSRVGLKEHDGSSVAVSSRFLWGTDLVFRFQKRVNQVKKRPGGICASLSETGEYPSQRPPTPLLDTINYPIHMKNLSVKELYQLADEVRSDVIFNVSKTGGHLGSSLGVVELTVALHYVFNAPQDRILWDVGHQSYPHKILTGRRDKMSTIRQTNGLSGFTKRSESEFDCFGAGHSSTTISAGLGMAVGRDLKGRKNNVIAVIGDGAMTAGQAYEAMNNAGYLDSDMIVILNDNKQVSLPTATLDGPVPPVGALSSALSRLQSNRPLRELREVAKGVTKQIGGPMHELAAKVDEYARGMISGSGSTLFEELGLYYIGPVDGHNVDDLVSILKEVKSTKTTGPVLIHVVTEKGRGYPYAEKAADKYHGVTKFDPATGKQQKSKAPTQSYTTYFAEALIAEAERDKDIIAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEAELFNMVATAAAIDDRPSCFRYPRGNGIGVELPPGNKGIPIEVGKGRILLEGERVALLGYGTAVQNCLAAASMVERHGLRITVADGRFCKPLDRALIRSLAKSHEILITVEEGSIGGFGSHVIQFLALDGLLDGTLKWRPLVLPDRYIDHGSPADQLAEAGLTPSHIAATVFNMLGQTREALEIMT

SEQ ID NO: 13365 - protein, 723 aa, Citrus clementina
MALSAFSFPTYVSKATNSDPHKSSPVTSHFFGAALFSHFSQKLDNHQIQLKKRPNGVCASLSERGEYHSQRPPTPLLDTINYPIHMKNLSIRELKQLADELRADVIFNVSKTGGHLGSSLGVIELTVALHYVFNAPKDRILWDVGHQTYPHKILTGRRDKMHTMRQTDGLSGFTKRSESEYDCFGTGHSSTSISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKQIGGPMHELAAKVDEYARGMISGSGSTLFEELGLYYIGPVDGHNVDDLVAILEEVKNTKTTGPVLIHVVTEKGRGYPYAEKAADKYHGVAKFDLATGKQFKSSARTQSYTTYFAEALIAEAEVDKDVVAIHAAMGGGTGLNLFLRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEAELFHMVATAAAIDDRPSCFRYPRGNGIGVELPPGNKGIPLEVGKGRILIEGERVALLGYGTAVQSCLAASALLESNGLRLTVADARFCKPLDHALIRSLAKSHEVLITVEEGSIGGFGSHVVQFLALDGLLDGTVKWRPLVLPDRYIDHGSPADQLAQAGLTPSHIAATVFNILGQTREALEIMSFKS

SEQ ID NO: 13366 - protein, 723 aa, Citrus sinensis
MALSAFSFPTYVSKATNSGPHKSSPVTSHFFGAALFSHFSHKLDNHQIQLKKRPNGVCASLSERGEYHSQRPPTPLLDTINYPIHMKNLSIRELKQLADELRADVIFNVSKTGGHLGSSLGVIELTVALHYVFNAPKDRILWDVGHQTYPHKILTGRRDKMHTMRQTDGLSGFTKRSESEYDCFGTGHSSTSISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKQIGGPMHELAAKVDEYARGMISGSGSTLFEELGLYYIGPVDGHNVDDLVAILEEVKNTKTTGPVLIHVVTEKGRGYPYAEKAADKYHGVAKFDPATGKQFKSSARTQSYTTYFAEALIAEAEVDKDVVAIHAAMGGGTGLNLFLRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEAELFHMVATAAAIDDRPSCFRYPRGNGIGVELPPGNKGIPLEVGKGRILIEGERVALLGYGTAVQSCLAASALLESNGLRLTVADARFCKPLDHALIRSLAKSHEVLITVEEGSIGGFGSHVVQFLAQDGLLDGTVKWRPLVLPDRYIDHGSPADQLAQAGLTPSHIAATVFNILGQTREALEIMSFKS

SEQ ID NO: 13367 - protein, 718 aa, Vinca minor
MALCAFAFPGGLNKALAASDSLKNTLFGSNGLYESDLLSPLQSKNPQVIKRCNGVRASLSERGEYFSQRPPTPLLDTINYPIHMKNLSKKELKQLADELRSDVIFNVSKTGGHLGSSLGVVELTVALHYVFNCPQDRILWDVGHQSYPHKILTGRRDKMSTLRQTNGLCGFTKRSESEYDCFGAGHSSTTISAGLGMAVGRDLKGRKNDVVAVIGDGAMTAGQAYEAMNNAGYLDSDMIVILNDNKQVSLPTATLDGPAAPVGALSSALSRLQSNRPLRELREVAKGVTKQIGGSVHELAAKVDEYARGMISGSGSTYFEELGMYYIGPVDGHNIDDLVAILNEVKSTKTTGPVLIHVITEKGRGYPYAEKAADKYHGVVKFDPATGKQFKSSSNTKSYTTYFAEALIAEAEADKDIVAIHAAMGGGTGLNIFQRRFPGRCFDVGIAEQHAVTFAAGLACEGLKPFCAIYSSFLQRAYDQVVHDVDLQKLPVRFAMDRAGLVGADGPTHCGAFDVTYMACLPNMVVMAPSDEAELFHMVATTAAIDDRPSCLRYPRGNGIGVGLPPANKGIPLEIGKGRILREGERVALLGYGSAVQNCLAAADLLEYHGLRLTVADARFCKPLDRALIRSLVKSHEVLITVEEGSIGGFGSHVVQFMALDGLLDGNVKWRPLVLPDRYIDHGSPADQLAEAGLTPSHIAASVFNILGKTREALEVMS

SEQ ID NO: 13368 - protein, 716 aa, Arnica chamissonis
MALCAFAFPAQMNHRSITNSPVFQHCLFGRDLQHHQSSHKPFFNQSSKRVGVVEATLSERGEYHSQRPPTPLLDTINYPIHMKNLSIKELKQLADELRSDVIFNVSKTGGHLGSSLGVVELTVALHYVFNTPQDKILWDVGHQSYPHKILTGRRDRMHTIRQTNGLAGFTKRAESEHDCFGTGHSSTTISAGLGMAVGRDLKGGTNDVVAVIGDGAMTAGQAYEAMNNAGYLDSDMIVILNDNKQVSLPTATLDGPIAPVGALSSALSRLQSNRPLRELREVAKEVTKQIGGPMHEIAAKVDEYARGMISGSGSTLFEELGLYYIGPVDGHSIDDLVAILKEVKSTKTTGPVLIHVITEKGRGYPYAENAADKYHGVAKFDPATGKQFKSSAPTQSYTTYFAEALIAEAEVDKRVVGIHAAMGGGTGMNLFHRRFPSRCFDVGIAEQHAVTFAAGLACEGLKPFCAIYSSFLQRGYDQVVHDVDLQKLPVRFAMDRAGLVGADGPTHSGSFDVTYMACLPNMVVMAPSDEAELFHMVATAAAIDDRPSCFRYPRGNGIGVPLPPGNKGIPLEIGKGRIMIEGERVALLGYGTAVQSCLAAASLVQGRGLNITVADARFCKPLDQNLIRALAKSHEVLITVEEGSIGGFGSHVAHFMALDGLLDGKLKWRPLVLPDRYIDHGAPDDQLAEAGLTPSHIAATVFNVLGQTREALEVMS

SEQ ID NO: 13369 - protein, 717 aa, Humulus lupulus
MAFCTLSFPAHISRATTPVSDLHKTSSFSSRFYWGADLLRPSQYKQVRKIQSGVYASLSESGEYHSRRPPTPLLDTINFPIHMKNLSVKELKQLSDELRSDVIFNVSNTGGHLGSSLGVVELTVALHYVFNTPQDRILWDVGHQSYPHKILTGRRDKMHTMRQTNGLAGFTKRSESEYDCFGTGHSSTTISAGLGMAVGRDLKGRKNNVVAVIGDGAMTAGQAYEAMNNAGYLDSDMIIILNDNKQVSLPTASLDGPIPPVGALSSALSRLQSNRPLRELREVAKGVTKQIGGSVHELAAKVDEYARGMISGSGSTLFEELGLYYIGPVDGHNIDDLISILGEVKSTKTTGPVLIHCITEKGRGYPYAEKAADKYHGVAKFDPATGKQFKGTSSTQSYTTYFAEALVAEAEADKDVVAIHAAMGGGTGLNLFLRRFPTRCFDVGIAEQHAVTFAAGLACEGLKPFCAIYSSFMQRAYDQVVHDVDLQKLPVRFAMDRAGLVGADGPTHCGAFDVTFMACLPNMVVMAPSDEAELFHMVATAAAIDDRPSCFRYPRGNGTGVALPQGNKGIPLEIGKGRVLVEGERVALLGYGTAVQSCLAAAALVEPHGLRLTVADARFCKPLDHALIRELAKNHEFLITVEEGSIGGFGSHVAQFMALDGLLDGKTKWRPIVLPDRYIDHGAPADQLAEAGLTPPHIAATVFNVLGQTREALKVMT

SEQ ID NO: 13370 - protein, 718 aa, Lippia dulcis
MALCTFAFPGNLSKGVVAAEVQKQTTLSSQWLHGLDLQPNGFCKSNQVKKRPTGVCASLSERGEYFSQKPPTPLLDTINYPIHMKNLSTKELKQLADELRSDVIFNVSKTGGHLGSSLGVIELTVALHYVFNAPQDKILWDVGHQAYPHKILTGRREKMPTLRQTGGLSGFTKRAESDYDCFGAGHSSTTISAGLGMAVGRDLKGRKNSVVAVIGDGAMTAGQAYEAMNNAGYLDSDMIVILNDNKQVSLPTANLDGPIPPVGALSSALSRLQSSRELRQLREVAKGVTKQIGGPMHELAAKVDEYARGMISGSGSSLFEELGLYYIGPVDGHNIDDLTAILKEVKSTKITGPVLIHVVTEKGRGYPYAEMAADKYHGVTKFDPATGKQFKSSAPTQSYTTYFAEALIAEAEADKDVVAIHAAMGGGTGLNLFQRRFPTRCFDVGIAEQHAVTFAAGLACEGIKPFCAIYSSFLQRGYDQVVHDVDLQKLPVRFAMDRAGLVGADGPTHCGAFDVAFMACLPNMVVMAPSDEVELFHMVATAAAIDDRPSCFRYPRGNGIGLELPPGNKGTPLEVGKGRILIEGERVALLGYGSAVQSCLAAAALVEPRGLQITVADARFCKPLDHALIRSLAKSHEILITVEEGSIGGFGSHVVQFMALDGLLDGNLKWRPLVLPDRYIDHGAPADQLMEAGLTPSHIAATVFNMLGRSREALEVMS

SEQ ID NO: 13371 - protein, 717 aa, Citrullus lanatus
MALCTLTFPAHVSRVAVKEHDGSSAVSSRFLWGTDLVFRFQKRVNQVKKRPGGICASLSEMGEYPSQRPPTPLLDTINYPIHMKNLSIKELYQLADEVRSDVIFNVSKTGGHLGSSLGVVELTVALHYVFNAPQDRILWDVGHQSYPHKILTGRRDKMSTIRQTNGLSGFTKRSESEFDSFGAGHSSTTISAGLGMAVGRDLKGRKNNVVAVIGDGAMTAGQAYEAMNNAGYLDSDMIVILNDNKQVSLPTATLDGPVPPVGALSSALSRLQSNRPLRELREVAKGVTKQLGGPMHELAAKVDEYARGMISGSGSTLFEELGLYYIGPVDGHNVDDLVSILKEVKSTKTTGPVLIHVVTEKGRGYPYAEKAADKYHGVTKFDPATGKQQKPKAPTQSYTTYFAEALIAEAEKDKDIIAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMVVMAPSDEAELFNMVATAAAIDDRPSCFRYPRGNGIGVELPPGNKGIPIEVGKGRILLEGERVALLGYGTAVQNCLAAASMVERHGLRITVADGRFCKPLDRALIRSLAKSHEILITVEEGSIGGFGSHVIQFLALDGLLDGTLKWRPLVLPDRYIDHGLPADQLAEAGLTPSHIAATVFNMLGQTREALEIMS

SEQ ID NO: 13372 - protein, 719 aa, Catharanthus roseus
MALCAFAFPGSLNKAVASESLNNSLFCSNWLYGSDLLSPFQSKNHQVITRRPNNGVRASLSEMGEYFSQRPPTPLLDSINYPVHMKNLSNKELKQLADEVRSDIIFNVSKTGGHLGSSLGVVELTVALHYVFNCPQDRILWDVGHQSYPHKILTGRRDKMPTLRQTNGLSGFTKRSESEYDCFGAGHSSTTISAGLGMAVGRDLKGRKNNVVAVIGDGAMTAGQAYEAMNNAGYLDSDMIVILNDNKQVSLPTATLDGPAPPVGALSSALSRLQSNRPLRELREVAKGVTKQIGGPVHELAAKVDEYARGMISGSGSTLFEELGFYYIGPVDGHNIDDLVAILKEVKSTKTTGPVLIHVVTEKGRGYPYAERAADKYHGVVKFDPSTGKQFKSSSNTQSYTTYFAEALISEAEADKDIVAIHAAMGGGTGMNLFLRRFPRRCFDVGIAEQHAVTFAAGLACEGLKPFCAIYSSFMQRAYDQVVHDVDLQKLPVRFAMDRAGLVGADGPTHSGSFDVTFMACLPNMVVMAPSDESELFHMVATAAAIDDRPSCLRYPRGNGVGVQLPPGNKGLPLEVGKGRILIEGERVALLGYGAAVQNCLAAAALVESHGLRVTVADARFCKPLDHELIRSLAKSHDVLITVEEGSIGGFSSHVAQFMSLDGLLDGNLKWRPLVLPDRYIDHGSPADQMAEAGLTPSHIAATVFNILGQTREALEVMS

SEQ ID NO: 13373 - protein, 719 aa, Eucalyptus grandis
MALCAFSFPAHINRATASDAQRNASLSSHFVGGSDLLVQSQHSLAQVQVRKRPGGVYASLSESGEYYSKRPPTPLLDTVNYPLHMKNLAIKELKQLADELRSDVIFNVSKTGGHLGSSLGVVELTVALHYVFNAPQDRILWDVGHQSYPHKILTGRRDKMQTIRQTNGLAGFTKRSESEYDCFGTGHSSTTISAGLGMAVGRDLKGRKNNVVAVIGDGAMTAGQAYEAMNNAGYLDSDMIVILNDNKQVSLPTANLDGPIPPVGALSSALSRLQSNRPLRELREVAKGVTKQIGGPMHELAAKVDEYARGMISGSGSTLFEELGLYYIGPVDGHNIDDLVSILKEVKSTKTTGPVLIHVVTEKGRGYPYAEKAADKYHGVVKFDPATGKQFKSSPATQSYTTYFAEALIAEAEADKDIVAIHAAMGGGTGLNLFLRRFPTRCFDVGIAEQHAVTFAAGLACEGIKPFCAIYSSFLQRAYDQVVHDVDLQKLPVRFAMDRAGLVGADGPTHCGAFDVTFMACLPNMVVMAPADEAELFHMVATAAAIDDRPSCFRYPRGNGVGVPLPPGNKGTPLEIGKGRILLEGERVALLGYGTAVQGCLAAAALIETHGFKITVADARFCKPLDHALIRSLAKSHEVLITVEEGSIGGFGSHVAQFLALDGLLDGTVKWRPLVLPDRYIDHGSPADQIAQAGLTPAHIAATVFNVVGKTREALEIMT

SEQ ID NO: 13374 - protein, 714 aa, Lotus japonicus
MDLCAFACPAFVNRVTPSEPRRLLHSQWGVDLLSLSQLRHYQVKKKCGGGVYASLSERGEYYSQRPPTPLLDTINYPIHMKNLSAKELKQLAEELRSDVIFSVSRTGGHLGSSLGVVELTVALHYVFNAPQDKILWDVGHQSYPHKILTGRRGKMHTLRQTDGLSGFTKRSESEFDCFGTGHSSTTISAGLGMAVGRDLKGKKNNVIAVIGDGAMTAGQAYEAMNNAGYLDSDMIVILNDNKQVSLPTANLDGPIPPVGALSSALSRLQSNRPLRELREVAKGLTKQIGGPMHELAAKVDEYARGMISGSGSSLFEELGLYYIGPVNGHNIDDLVAILNEVKSTQTTGPVLIHVITEKGRGYPYAEKAADKYHGVTKFDPTTGKQFKAKATTQSYTTYFAEALIAEAEADKDIVAIHAAMGGGTGMNLFLRRFPTRCFDVGIAEQHAVTFAAGLACEGVKPFCAIYSSFMQRAYDQVVHDVDLQKLPVRFAMDRAGLVGADGPTHCGAFDVTFMACLPNMVVMAPSDEAELFHMVATAAAIDDRPSCFRYPRGNGIGVELPKGNKGIPLEVGKGRILIEGERVALLGYGSAVQNCLAAASLVERHGLRITVADARFCKPLDRSLIRSLAKSHEVLITVEEGSIGGFGSHVAQFMALDGLLDGKLKWRPVVLPDRYIEHGSPNDQLSSAGLAPSHIAATVFNILGQTREALEVMS

SEQ ID NO: 13375 - protein, 712 aa, Glycine max
MDLSSLSSYRTVGVTPSDPRKSLPQWGLHFLSYTHRLNQIKKRSSGVYASLSERERGEYYSQRPPTPLLDTVNYPIHMKNLSTNELKQLADELRSDVIFSVSRTGGHLGSSLGVVELTVALHYVFNAPQDKILWDVGHQSYPHKILTGRRDKMHTMRQTNGLSGFTKRSESEFDCFGTGHSSTTISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKRIGGPMHELAAKVDEYARGMISGSGSSLFEELGLYYIGPVDGHNINDLVAILNEVKSTNTTGPVLIHVITEKGRGYPYAEKAADKYHGVTKFDPPTGKQFKSKATTRSYTTYFAEALIAEAEADKDVVAIHAAMGGGTGMNLFHRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEAELFHMVATAAAINDRPSCFRYPRGNGIGVQLPTGNKGTPLEIGKGRILIEGERVALLGYGSAVQNCLAAASLVEHHGLRVTVADARFCKPLDRSLIRSLAKSHEVLITVEEGSIGGFGSHVAQFMALDGLIDGKLKWRPIVLPDRYIDHGSPADQLSLAGLTPSHIAATVFNILGQTREALEVMS

SEQ ID NO: 13376 - protein, 710 aa, Triphysaria pusilla
MALCTFSFTGKYVSNGLLGSDTQRQTSLCYQSPFHKNNQERKRAIRVYASLSENGEYFSRKPPTPLLDTINYPIHMKNLSTKELKQLVDELRSDVIFNVSNTGGHLGSSLGVVELTVALHFVFNAPQDRILWDVGHQSYPHKILTGRRDKMPTLRQTDGLSGFTKRSESEYDCFGTGHSSTTISAGLGMSVGRDLKGRKNHVVAVIGDGAMTAGQAYEAMNNAGYLDSDMIVILNDNKQVSLPTANLDGPTAPVGALSSALSRLQSNRPLRELREVAKGVTKQLGGPMHELAAKVDEYARGLISGSGSTLFEELGLYYIGPVDGHSIDDLTAILKEVKSTKTTGPVLIHVITEKGRGYPYAEKAADKYHGVTKFDPATGKQFKTSAPTQSYTTYFAEALIAEAEKDNDIVAIHAAMGGGTGLNLFQRRFPTRCFDVGIAEQHAVTFAAGLACEGVKPFCAIYSSFLQRAYDQVVHDVDLQKLPVRFAMDRAGLVGADGPTHCGAFDVTFMACLPNMVVMAPSDEAELFHMVATAAAIDDRPSCFRYPRGNGIGAELPNGNKGNPLEVGKGRILIEGERVALLGYGTAVQSCMAAAALVESRGLRLTVADARFCKPLDYGLIRSLAKSHEVLITVEEGSIGGFGSHVVQFMALDGLLDGKLKWRPMVLPDRYIDHGSPNYQQMEAGLMPSHIAATVFNILGKAREALEVML

SEQ ID NO: 13377 - protein, 484 aa, Theobroma cacao
MALCAFSFPAHINRAAASDPQKSTSFASHLLGGTDLLFQPLHKLNQVQVRKRPGGVCASLSERAEYHSQRPPTPLLDTINYPIHMKNLSVKELKQLADELRSDVIFNVSKTGGHLGSSLGVVELTVALHYVFNAPKDKILWDVGHQSYPHKILTGRRDKMYTMRQTNGLAGFTKRSESEYDCFGTGHSSTTISAGLGMAVGRDLKGERNNVVAVIGDGAMTAGQAYEAMNNAGYLDSDMIVILNDNKQVSLPTATLDGPIPPVGALSSALSRLQSNRPLRELREVAKGVTKQIGGPMHELAAKVDEYARGMISGSGSTLFEELGLYYIGPVDGHNIDDLVSILKEVKSTKTTGPVLIHVVTEKGRGYPYAERAADKYHGVVKFDLATGKQFKGSSATQSYTTYFAEALIAEAEADKNIVAIHAAMGGGTGLNLFLRRFPERCFDVGIAEQHAVTFAAGLACEGLKPFCAIYSSFMQRAYDQASY

SEQ ID NO: 13378 - protein, 714 aa, Malus domestica
MALCAFSFPAHISKPAASADAQKSHFSVGTPLPCPSQQKLNQVMRKRPSGICASLSERGEYHSQRPPTPLLDTINYPIHMKNLSVKELQQLADELRSDVIFNVSKTGGHLGSSLGVVELTVALHYVFNAPQDRILWDVGHQSYPHKILTGRRDKMHTMRQTNGLAGFTKRSESEYDCFGTGHSSTTISAGLGMAVGRDLKGGNNHVVAVIGDGAMTAGQAYEAMNNAGYLDSDMIIILNDNKQVSLPTASLDGPIPPVGALSSALSRLQSNRPLRELREVAKGVTKQIGGPVHNLAAKVDEYARGMISGTGSSLFEELGLYYIGPVDGHNIDDLISILKEVKITKTTGPVLIHLITEKGRGYPYAEKAADKYHGVAKFDPATGKQFKASASTQSYTTYFAEALIAEAEADKDIVAIHAAMGGGTGMNLFLRRFPTRCFDVGIAEQHAVTFAAGLACEGLKPFCAIYSSFLQRAYDQVVHDVDLQKLPVRFAMDRAGLVGADGPTHSGSFDVTFMACLPNMVVMAPSDEAELFDMVATAAAIDDRPSCFRYPRGNGVGVELPLGNKGTPLEVGKGRILIEGERVALLGYGAAVQSCLAASSLVESHGLHLTVADARFCKPLDRALIRSLARSHEFLITVEEGSIGGFGSHVAHFLALDGLLDGKLKWRPIVLPDRYIDHGSPADQLAEAGLTPSHIAATVFNMLGQAREALEIMS

SEQ ID NO: 13379 - protein, 714 aa, Euphorbia peplus
MALCAFSFPAHVSSDLCKDGYGSWHSLWRRTEKSQHKLNQAKQKRRQSGVWATLSERGEYQSQKPATPLLDTINYPIHMKNLSTKELKQLADELRSDVIFNVSKTGGHLGSSLGVVELTVALHYVFNTPQDRILWDVGHQSYPHKILTGRRDKMHTMRQTNGLSGFTKRSESEYDCFGTGHSSTTISAGLGMAVGRDLKGKSNNVVAVIGDGAMTAGQAYEAMNNAGYLDSDMIVILNDNKQVSLPTANLDGPIPPVGALSSALSRLQSNKPLRELREVAKGVTKTIGGPMHELAAKVDEYARGMISGSGSTLFEELGLYYIGPVDGHNIDDLIAILKEVKSTKTTGPVLIHVVTEKGRGYPYAEKAADKYHGVTKFDPATGKQFKASASTQSYTTYFAEALIAEAEADKDIVAIHAAMGGGTGLNMFLRRFPSRCFDVGIAEQHAVTFAAGLACEGLKPFCAIYSSFMQRAYDQVVHDVDLQKLPVRFAMDRAGLVGADGPTHCGAFDVTFMACLPNMVVMAPSDEAELFHMVATAAAIDDRPSCFRYPRGNGIGVQLPPGNKGIPLEVGKGRILMEGERVALLGYGTAVQSCLAAASIMESHEISITVADARFCKPLDHDLIRRLAKSHEILITVEEGSIGGFGSHVAHFLALDGLLDGKLKWRPIVLPDQYIEHGSPADQLVWAGLTPSHIAATVFNILGNKREALQIMSS

SEQ ID NO: 13380 - protein, 721 aa, Glycine max
MSLSAFSFPLHLRQTTPPSDPKTSSTPLPLSSHSHWGADLLTQSQRKLNQVKRRPHGVCASLSEMGEYYSQKPPTPLLDTINYPIHMKNLATKKLKQLADELRSDVIFHVSRTGGHLGSSLGVVELTIALHYVFNAPKDKILWDVGHQSYPHKILTGRRDKMHTMRQTDGLAGFTKRSESDYDCFGTGHSSTTISAGLGMAVGRDLKGDKNNVVAVIGDGAMTAGQAYEAMNNAGYLDSDMIVILNDNKQVSLPTANLDGPIPPVGALSSALSKLQSNRPLRELREVAKGVTKQIGGPMHELAAKVDEYARGMISGSGSTLFEELGLYYIGPVDGHNIDDLVSILNEVKSTKTTGPVLLHVVTEKGHGYPYAERAADKYHGVTKFDPATGKQFKSNAATQSYTTYFAEALIAEAEADKDIVGIHAAMGGGTGMNLFLRRFPTRCFDVGIAEQHAVTFAAGLACEGLKPFCAIYSSFMQRAYDQVVHDVDLQKLPVRFAMDRAGLVGADGPTHCGAFDVTFMACLPNMVVMAPSDEAELFHMVATAAAIDDRPSCFRYPRGNGIGVELPLGNKGIPLEIGKGRILIEGERVALLGYGSAVQSCLAAASLLEHHGLRATVADARFCKPLDRSLIRSLAQSHEVLITVEEGSIGGFGSHVVQFMALDGLLDGKLKWRPIVLPDCYIDHGSPVDQLSAAGLTPSHIAATVFNLLGQTREALEVMT

SEQ ID NO: 13381 - protein, 727 aa, Manihot esculenta
MALSACSFPAHANRATISDLQKYSYVSSHFLWRADLLAQSLHRLNKVKSKKGPGGVCASLSERGDYHSQRPPTPLLDTINYPIHMKNLSIKELKQLADELRSDVIFNVSRTGGHLGSSLGVVELTVALHYVFGAPQDKILWDVGHQAYPHKILTGRRDKMHTMRQTNGLSGFTKRSESEYDCFGTGHSSTTISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKRIGGPMHELAAKVDEYARGMISGSGSTLFEELGLYYIGPVDGHNIDDLISILKEVKSTKTTGPVLIHVVTEKGRGYPYAEQAADKYHGVTKFDPATGKQFKASASTQSYTTYFAEALIAEAEADKDIVAIHAAMGGGTGLNLFLRRFPTRCFDVGIAEQHAVTFAAGLACEGLKPFCAIYSSFMQRAYDQASQYIFLVVHDVDLQKLPVRFAMDRAGLVGADGPTHCGAFDVTFMACLPNMVVMAPSDEAELFHMVATAAAIDDRPSCFRYPRGNGVGVQLPSGNKGIPLEVGKGRILIEGERVALLGYGTAVQSCLAAASLVEPHGLRITVADARFCKPLDHALIRSLAKSHEILITVEEGSIGGFGSHVAHFLALDGLLDGKLKWRPLVLPDRYIDHGSPADQLVQAGLTPSHIAATVFNILGNRREALQIMSS

SEQ ID NO: 13382 - protein, 713 aa, Helianthus annuus
MALCGFAFPINHRSISSHTIQHCFFGKDLHQGQSCSHKPFNQLSKRSGVVQATLSERGEYHSQRPPTPLLDTINYPIHMKNLSIKELKQLADELRSDVIFNVSKTGGHLGSSLGVVELTVALHYVFNTPQDKILWDVGHQSYPHKILTGRRDRMHTIRQTNGLAGFTKRAESEHDCFGTGHSSTTISAGLGMAVGRDLKGGTNDVVAIIGDGAMTAGQAYEAMNNAGYLDSDMIVILNDNKQVSLPTATLDGPIPPVGALSSALSRLQSNRPLRELREVAKEVTKQIGGPMHELAAKVDEYARGMISGSGSTLFEELGLYYIGPVDGHSIDDLVAILKEVKSTKTTGPVLIHVITEKGRGYPYAEKAADKYHGVAKFDPATGKQFKSSAPTQSYTTYFAEALIAEAEADKQIVAIHAAMGGGTGMNLFHRRFPSRCFDVGIAEQHAVTFAAGLACEGLKPFCAIYSSFLQRGYDQVVHDVDLQKLPVRFAMDRAGLVGADGPTHSGSFDVTYMACLPNMVVMAPSDEAELFHMVATAAAIDDRPSCFRYPRGNGIGVPLPPGNKGVPLEIGKGRIMIEGERVALLGYGTAVQSCLTAAGLVKERGLNITVADARFCKPLDHNLIRALAKSHEVLITVEEGSIGGFGSHVAHFMALDGLLDGKLKWRPLVLPDRYIDHGAPDDQLAEAGLTPSHIAATVFNVLGQTREALEVMS

SEQ ID NO: 13383 - protein, 714 aa, Malus domestica
MALCAFSFPAHISKPAASADAQKSHFSVGTPLPCPSQQKLNQVMRKRPSGICASLSERGEYHSQRPPTPLLDTINYPIHMKNLSVKELQQLADELRSDVIFNVSKTGGHLGSSLGVVELTVALHYVFNAPQDRILWDVGHQSYPHKILTGRRDKMHTMRQTNGLAGFTKRSESEYDCFGTGHSSTTISAGLGMAVGRDLKGGNNHVVAVIGDGAMTAGQAYEAMNNAGYLDSDMIIILNDNKQVSLPTASLDGPIPPVGALSSALSRLQSNRPLRELREVAKGVTKQIGGPVHNLAAKVDEYARGMISGTGSSLFEELGLYYIGPVDGHNLDDLISILKEVKITKTTGPVLIHLITEKGRGYPYAEKAADKYHGVAKFDPATGKQFKSSASTQSYTTYFAEALIAEAEADKDIVAIHAAMGGGTGMNLFLRRFPTRCFDVGIAEQHAVTFAAGLACEGLKPFCAIYSSFLQRAYDQVVHDVDLQKLPVRFAMDRAGLVGADGPTHSGSFDVTFMACLPNMVVMAPSDEAELFDMVATAAAIDDRPSCFRYPRGNGVGVELPLGNKGTPLEVGKGRILIEGERVALLGYGAAVQSCLAASSLVESHGLHLTVADARFCKPLDRALIRSLARSHEFLITVEEGSIGGFGSHVAHFLALDGLLDGKLKWRPIVLPDRYIDHGSPADQLAEAGLTPSHIAATVFNMLGQAREALEIMS

SEQ ID NO: 13384 - protein, 709 aa, Fragaria vesca
MALSTFSISTQKPTSKFSSHFSFGPALPCPQQQKLFNQVKKRTTGICASLSESGEYHSQRPPTPLLDTINYPIHMKNLSVKELKQLADELRSDVIFNVSKTGGHLGSSLGVVELTVALHYVFNAPQDKILWDVGHQSYPHKILTGRRDKMQTMRQTNGLAGFTKRSESEYDCFGTGHSSTTISAGLGMAVGRDLKGKNNHVVAVIGDGAMTAGQAYEAMNNAGYLDSDMIIILNDNKQVSLPTANLDGPIPPVGALSSALSKLQSNRPLRELREVAKGVTKQIGGSVHELAAKVDEYARGMISGSGSTLFEELGLYYIGPVDGHNVDDLIAILQEVKTTQTTGPVLIHLITEKGRGYPYAEKAADKYHGVAKFDPATGKQFKAAASTQSYTTYFAEALIAEAEADKDIVAIHAAMGGGTGMNLFLRRFPTRCFDVGIAEQHAVTFAAGLACEGLKPFCAIYSSFLQRAYDQVVHDVDLQKLPVRFAMDRAGLVGADGPTHCGAFDVTFMACLPNMVVMAPSDEAELFHMVATAAAIDDRPSCFRYPRGNGIGVELPAGNKGTPLEIGKGRILIEGERVALLGYGSAVQTCLAAATLVEPLGLSLTVADARFCKPLDHALIRKLAKSHEFLITVEEGSIGGFGSHVVQFLALDGLLDGNLKWRPLVLPDRYIDHGAPADQLADAGLTPSHIAATVLNMLGQTREALQVMS

SEQ ID NO: 13385 - protein, 483 aa, Prunus persica
MALCTFSFPAHIYRPTTHSDAQKSTSLFSHFSWETVLPCQSQHKLNQVMRKRPAGICASLSESGEYHSQRPPTPLLDTINYPIHMKNLSVKELKQLADELRSDVIFNVSKTGGHLGSSLGVVELTVALHYVFNAPRDRILWDVGHQSYPHKILTGRRDKMHTMRQTNGLAGFTKRSESEYDCFGTGHSSTTISAGLGMAVGRDLKGGNNHVVAVIGDGAMTAGQAYEAMNNAGYLDSDMIIILNDNKQVSLPTASLDGPIPPVGALSSALSRLQSNRPLRELREVAKGVTKQIGGPVHNLAAKVDEYARGMISGTGSSLFEELGLYYIGPVDGHNLDDLISILKEVKSTKTTGPVLIHLITEKGRGYPYAEKAADKYHGVAKFDPATGKQFKASASTQSYTTYFAEALIAEAEADKDIVAIHAAMGGGTGMNLFLRRFPTRCFDVGIAEQHAVTFAAGLACEGLKPFCAIYSSFLQRAYDQAS

SEQ ID NO: 13386 - protein, 716 aa, Vitis vinifera
MALCTLSFPAHFSQAAASNPQRLTPQCSHLFLGVDLQCQSQQRSKARKRPNGVCASLSDREEYHSQRPPTPLLDTINYPIHMKNLSVKELKQLADELRSDVVFNVSKTGGHLGSSLGVVELTVALHYVFNAPQDRILWDVGHQSYPHKILTGRRDQMHTMRQTDGLAGFTKRSESEYDCFGTGHSSTTISAGLGMAVGRDLKGKNNNVIAVIGDGAMTAGQAYEAMNNAGYLDSDMIVILNDNKQVSLPTATLDGPIPPVGALSSALSRLQSNRPLRELREVAKGVTKQIGGPMHELAAKVDEYARGMISGSGSTLFEELGLYYIGPVDGHNIDDLVAILKEVKSTKTTGPVLIHVVTEKGRGYPYAEKAADKYHGVTKFDPATGKQFKSSAPTQSYTTYFAEALIAEAEVDKDIVAIHAAMGGGTGLNLFHRRFPTRCFDVGIAEQHAVTFAAGLACEGIKPFCAIYSSFMQRAYDQVVHDVDLQKLPVKFAMDRAGLVGADGPTHCGAFDVTFMACLPNMVVMAPADEAELFHMVATAAAIDDRPSCFRYPRGNGVGVELPPGNKGIPIEVGRGRILIEGERVALLGYGTAVQSCLVASSLLEQHGLRITVADARFCKPLDHALIRSLAKSHEVLITVEEGSIGGFGSHVAQFLALNGLLDGTTKWSPMVLPDRYIDHGAPADQLAMAGLTPSHIAATVFNILGQTREALEIMS

SEQ ID NO: 13387 - protein, 722 aa, Tripterygium wilfordii
MALCAFSFPAQINKAGLLDSQKTSSLSSHLLCGPDLFCLPLYRLNQLQPGKRPKGVCASLSEMGEYHSQKPPTPLLDTVNYPIHMKNLSMKELNQLADELRSDVIFNVSKTGGHLGSSLGVVELTVALHYVFNCPQDKILWDVGHQTYPHKILTGRRDKMSTIRQTNGLSGFTKRSESEYDSFGAGHSSTSISAGLGMAVGRDLKGRKNNVIAVIGDGAMTAGQAYEAMNNAGYLDTDMIVILNDNKQVSLPTATLDGPIPPVGALSSALSRLQSNRPLRELREVAKGVTKQIGGPMHELAAKVDEYARGMIGGSGSTLFEELGLYYIGPVDGHNIDDLVSILKEVKSTKTTGPVLIHVVTEKGRGYPYAERAADKYHGVAKFDPATGNQLKARAPTKSYTTYFAEALIAEAEADKEIVAIHAAMGGGTGLNLFHRRFPTRCFDVGIAEQHAVTFAAGLACEGIKPFCAIYSSFLQRAYDQVIHDVDLQKLPVRFAMDRAGLVGADGPTHCGSFDVTFMACLPNMVVMAPADEAELFNMVATAAAINDRPSCFRYPRGNGIGIQLPPGNKGIPLEVGKGRILIEGERVALLAYGTAVQSCLAAASLVESHGLQLTVADARFCKPLDRALICSLAKSHEVLITVEEGSIGGFGSHVAQFMALEGLLDGKLKWRPLVLPDRYIDHGSPADQLAEAGLTSSHIAATVFNILGLTREALETMSLRN

SEQ ID NO: 13388 - protein, 635 aa, Ambrosia trifida
MKNLSIKELKQLADEVRSDVIFNVSKTGGHLGSSLGVVELTVALHYVFNTPQDKILWDVGHQSYPHKILTGRRDRMHTIRQTNGLAGFTKRSESEHDCFGTGHSSTTISAGLGMAVGRDLKGGTNDVVAIIGDGAMTAGQAYEAMNNAGYLDSDMIVILNDNKQVSLPTATLDGPIPPVGALSSALSRLQSNRPLRELREVAKEVTKQIGGPMHELAAKVDEYARGMISGSGSSLFEELGLYYIGPVDGHSIDDLVAILKEVKSTKTTGPVLIHVITEKGRGYPYAEKAADKYHGVAKFDPATGKQFKSSAPTQSYTTYFAEALIAEAEEDKKIVAIHAAMGGGTGMNLFHRRFPSRCFDVGIAEQHAVTFAAGLACEGLKPFCAIYSSFLQRGYDQVVHDVDLQKLPVRFAMDRAGLVGADGPTHSGSFDVTYMACLPNMVVMAPSDEAELFHMVATAAAIDDRPSCFRYPRGNGIGVPLPPGNKGVPLEVGKGRIMLEGERVALLGYGTAVQSCLAAAGLVKQRGLNITVADARFCKPLDHHLIRALAKSHEVLITVEEGSIGGFGSHVAHFMALDGLLDGKLKWRPLVLPDRYIDHGAPDDQLAEAGLTPSHIAATVFNVLGQTREALEVMS

SEQ ID NO: 13389 - protein, 710 aa, Mimulus guttatus
MALCAFPFTGSLSKGLTGTHWLNGSGLQPHPCCKKNHQKVRKSSNGVHASLSERGEYFSQKPPTPLLDTINYPIHMKNLSTKELKQLADELRSDVIFNVSKTGGHLGSSLGVIELTVALHFVFNTPQDRILWDVGHQSYPHKILTGRRDKMPTLRQTNGLSGFTKRSESDYDCFGTGHSSTTISAGLGMAVGRDLKGKSNNVVAVIGDGAMTAGQAYEAMNNAGYLDSDMIVILNDNKQVSLPTANLDGPTAPVGALSSALSRLQSNRPLRELREVAKGVTKQIGGPMHELAAKVDEYARGLISGSGSTFFEELGLYYIGPVDGHNLDDLTAILNEVKSTKTTGPVLIHVITEKGRGYPYAEKAADKYHGVTKFDPATGKQFKSSAPTQSYTTYFAEALIAEAEADKDIVAIHAAMGGGTGLNLFQRRFPTRCFDVGIAEQHAVTFAAGLACEGIKPFCAIYSSFLQRAYDQVVHDVDLQKLPVRFAMDRAGLVGADGPTHCGAFDVTYMACLPNMVVMAPSDEAELFHMVATAAAIDDRPSCFRFPRGNGVGIELPKGNKGIPIEIGKGRVLIEGERVALLGYGTAVQSCMAAAALLEPHGIRLTVADARFCKPLDHDLIRSLAKSHQVLITVEEGSIGGFGSHVAQFMALDGLLDGNLKWRPLVLPDRYIDHGSPIDQQMEAGLTPSHIAATVCNILGKAREALEIMS

SEQ ID NO: 13390 - protein, 588 aa, Amorphophallus konjac
MALSTASFPCHLHRVVASDPHKSALLASHSRLLGGGDDELQQQQQHKLFKVKRRPRVCASLSEKGEYFSQRPPTPLLDTINYPIHMKNLSIKELKQLADELRSDVIFNVSKTGGHLGSSLGVVELTVALHYVFNTPQDKILWDVGHQSYPHKILTGRRDKMPTMRQTNGLSGFTKRSESEHDCFGTGHSSTSISAALGMAVGRDLKGRKNNVIAVIGDGAMTAGQAYEAMNNAGYLDSDMIVILNDNKQVSLPTATLDGPIPPVGALSSALSRLQSSRPLRELREVAKGVTKQIGGSMHELAAKVDEYARGMISGSGSTLFEELGLYYIGPVDGHNMDDLVTILKEVKSTKTTGPVLIHVVTEKGRGYPYAEKAADKYHGVAKFDPATGKQLKSSSKTQSYTNYFAEALVAEAEADKDIIAIHAAMGGGTGLNLFQRRFPTRCFDVGIAEQHAVTFAAGLACEGLKPFCAIYSSFLQRAYDQVIHDVDLQKLPVRFALDRAGLVGADGPTHSGSFDVTYMACLPNMVVMAPSDEAELFHMVATAAAINDRPSCFRYPRGTASVSPCQLETKVFLSRSGKGEFLLGVSE

SEQ ID NO: 13391 - protein, 718 aa, Vinca minor
MALCAFAFPGTLNKAVASSNSLKNSLFCSNWLYGSDFLSPFQSKNSKAIKRTNGVRATLSESGEYFSQRPATPLLDTINYPIHMKNLSKKELKQLADELRSDVIFNVSRTGGHLGSSLGVVELTVALHYVFNCPQDRILWDVGHQSYPHKILTGRRDKMSTLRQTNGLCGFTKRSESEYDCFGAGHSSTTISAGLGMAVGRDLKGRKNKVVAVIGDGAMTAGQAYEAMNNAGYLDSDMIVILNDNKQVSLPTATLDGPAPPVGALSSALSRLQSNRPLRELREVAKGVTKQIGGSVHGLAAKVDEYARGLISGSGSTFFEELGMYYIGPVDGHNLDDLVSILNEVKSTNTTGPVLIHIVTEKGRGYPYAEKAADKYHGVVKFDPATGKQFKSSSKTQSYTTYFAEALIAEAEADKDVIAIHAAMGGGTGLNIFQRRFPGRCFDVGIAEQHAVTFAAGLACEGLKPFCTIYSSFLQRAYDQVVHDVDLQKLPVRFAMDRAGLVGADGPTHCGAFDVTYMACLPNMVVMAPSDEAELFHMVATAAAINDRPSCLRYPRGNGIGVELPPRKKGIPLEVGKGRILREGERVALLGYGTAVQNCLAAADLLEYHGLRLTVADARFCKPLDRALIRSLVKSHEVLITVEEGSIGGFGSHVVQFMALDGLLDGNVKWRPLVLPDRYIDHGSPADQLAEAGLTPSHIAASVFNILGKTREALEVMS

SEQ ID NO: 13392 - protein, 483 aa, Aquilegia formosa
MALSTFPFASYLPRALSSDSHNTSSLSSHLLWGTDLQYPSQQNLVQVRKRSGGVWASLSEKGEYHSQRPPTPLLDTINYPIHMKNLSIKELKQLADEVRSDVIFNVSKTGGHLGSSLGVVELTVALHYVFNLPQDKILWDVGHQTYPHKILTGRRDKMHTLRQTDGLAGFTKRSESEYDCFGAGHSSTSISAGLGMAVGRDLKGRDNHVVAVIGDGAMTAGQAYEAMNNAGYLDSDMIVILNDNKQVSLPTASLDGPIPPVGALSSALSRLQSSRPLRELREVAKGVTKQIGGPVHELAAKVDEYTRGMISGSNSSLFEELGLYYIGPVDGHNVDDLVTILKEVKSTHTTGPVLIHVVTDKGRGYPYAERAADKYHGVTKFDPATGKQFKGSSNTQSYTTYFAEALIAEAEVDKDIVAIHAAMGGGTGMNLFLRRFPTRCFDVGIAEQHAVTFAAGLACEGLKPFCAIYSSFLQRAYDQASGT

SEQ ID NO: 13393 - protein, 714 aa, Malus domestica
MALCTFSFPADISRSAASADAQKSLFSVGTSLPCPSQQKLNQVVRKRPSGICASLSEREEYYSQRPPTPLLDTINYPIHMKNLSVKELKQLADELRSDVIFNVSKTGGHLGSSLGVVELTVAVHYVFNAPQDRILWDVGHQSYPHKILTGRRDKMHTMRQTNGLAGFTKRSESEYDCFGTGHSSTTISAGLGMAVGRDLRGGNNHVVAVIGDGAMTAGQAYEAMNNAGYLDSDMIIILNDNKQVSLPTASLDGPIPPVGALSSALSRLQSNRPLRELREVAKGVTKQIGGSVHNLAAKVDEYARGMISGSGSSLFEELGLYYIGPVDGHNIDDLISILKEVKITKTTGPVLIHLVTEKGRGYPYAEKAADKYHGVAKFDPATGKQFKASASTQSYTTYFAEALIAEAEADKDIVAIHAAMGGGTGLNLFLRRFPTRCFDVGIAEQHAVTFAAGLACEGLKPFCAIYSSFLQRAYDQVVHDVDLQKLPVRFAMDRAGLVGADGPTHSGSFDVTFMACLPNMVVMAPSDEAELFHMVATAAAIDDRPSCFRYPRGNGVGVELPLGNKGTPLEVGRGRILIEGERVALLGYGAAVQSCLAASSLVESRGLRLTVADARFCKPLDRALIRSLVKSHEILITVEEGSIGGFGSHVAHFLALDGLLDGKLKWRPIVLPDRYIDHGSPVDQLAEAGLTPSHIAATVFNMLGQSREALEIVS

SEQ ID NO: 13394 - protein, 716 aa, Flaveria ramosissima
MALCGFAFPANMNHRAIGSHAPVVQHYFFGKDLQHPQSSHKPFNQLSKRVGVVQATMADRGEYHSQRPPTPLLDTINYPIHMKNLSIKELKQLADELRSDVIFNVSKTGGHLGSSLGVVELTVALHYVFNTPQDKILWDVGHQSYPHKILTGRRDRMHTIRQTNGLAGFTKRSESEHDCFGTGHSSTTISAGLGMAVGRDLKGGTNDVVAIIGDGAMTAGQAYEAMNNAGYLDSDMIVILNDNKQVSLPTATLDGPTPPVGALSSALSRLQSNRPLRELREVAKEVTKQIGGPMHELAAKVDEYARGMISGSGSTLFEELGLYYIGPVDGHSIDDLVAILKEVKSTKTTGPVLIHVITEKGRGYPYAEKAADKYHGVAKFDPATGKQFKSSAATQSYTTYFAEALIAEAEVDKKIVGIHAAMGGGTGMNLFDRRFPNRCFDVGIAEQHAVTFAAGLACEGLKPFCAIYSSFLQRGYDQVVHDVDLQKLPVRFAMDRAGLVGADGPTHSGSFDVTYMACLPNMVVMAPSDEGELFHMVATAAAIDDRPSCFRYPRGNGVGATLPPGNKGFPLEVGKGRILIEGERVALLGYGTAVQSCLVAARLVQERGLNITVADARFCKPLDHNLIRALAKSHEVLITVEEGSVGGFGSHVAHFMALDGLLDGKLKWRPLVLPDRYIDHGAPDDQLAEAGLTPSHIAATVFNVLGQTREALEVMS

SEQ ID NO: 13395 - protein, 560 aa, Plantago ovata
MPTLRQTDGLSGFTKRSESEYDCFGTGHSSTTISAGLGMAVGRDLKGKKNSVIAVIGDGAMTAGQAYEAMNNAGYLDSDMIVILNDNKQVSLPTANLDGPIPPVGALSSALSRLQSNRPLRELREVAKGVTKQIGGPMHELAAKVDEYARGMISGSGSSLFEELGLYYIGPVDGHNIDDLTTILKEVKSTKTTGPVLIHVVTEKGRGYPYAEKAADKYHGVSKFDPATGKQTKTSAPTQSYTTYFAEALIAEAEADKNIVAIHAAMGGGTGLNLFLRRFPNRCYDVGIAEQHAVTFAAGLACEGIKPFCAIYSSFLQRAYDQVVHDVDLQKLPVRFAMDRAGLVGADGPTHCGAFDVTFMACLPNMVVMAPSDEAELFHMVATAAAIDDRPSCFRYPRGNGIGVELPQGNKGIPLEVGRGRILMEGERVALLGYGSAVQSCLAAAAMVEEHGLRLTVADARFCKPLDHALIRSLAKSHEIVITVEEGSIGGFGSHVAHFMAIDGLLDGKLKWRPLVLPDKYIEHGAPIDQMREAGLTASHIAATVFSLLGKSREALQILS

SEQ ID NO: 13396 - protein, 729 aa, Amsonia hubrichtii
MALCAFTFPGSLNKAVASDSLKNSLSYSNWLYVSDLPSPFQSKSNQVTKKSNGVRASLSEGGEYFSQSPPTPLLDTINYPIHMKNLSTKELKQLADELRSDIVFNVSKTGGHLGSSLGVVELTVALHYVFNCPQDRILWDVGHQSYPHKILTGRRDKMPTLRQTDGLSGFTKRSESEYDCFGAGHSSTTISAGLGMAVGRDLKGRKNNVVAVIGDGAMTAGQAYEAMNNAGYLDSDMIVILNDNKQVSLPTATLDGPAPPVGALSSALSRLQSNRPLRELREVAKGVTKQIGGPVHELAAKVDEYARGLISGSGSTLFEELGFYYIGPVDGHSIDDMVAILKEVKNTKTTGPVLIHVVTEKGRGYSYAEKAADKYHGVVKFDPATGKQFKSNTKTQSYTTYFAEALIAEAEADKDIVAIHAAMGGGTGLNLFLRRFPRRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEAELFHMVATAAAIDDRPSCFRYPRGNGKGVELPPGNKGIPLEVGKGRILIEGERVALLGYGTAVQSCLAAAALVEPRGLRLTVADARFCKPLDHALIRSLAKSHEVLITIEEGSIGGFGSHVAQFMALDGLLDGKLKWRPLVLPDRYIDHGSPVDQLAEAGLTPSHIAATVLTYLDKQERLLRSCHKSEVLFLRNLYK

SEQ ID NO: 13397 - protein, 717 aa, Medicago truncatula
MDLCSLACPSFVTPCDPRRTLPLPSSSSSHSQWGLHFFSHSQQHNKLKKKFGVVHASLSEMGEYYSQRPPTPLLDTINYPIHMKNLSTKELKQLADELRSDVIFSVSRTGGHLGSSLGVVELTIALHYVFNTPQDKILWDVGHQSYPHKILTGRRDKMHTMRQTNGLSGFTKRSESEYDSFGTGHSSTTISAGLGMAVGRDLKGRKNDVVAVIGDGAMTAGQAYEAMNNAGYLDSDMIVILNDNKQVSLPTATLDGPIPPVGALSSALSRLQSNKPLRELREVAKGVTKRIGGPMHELAAKVDEYARGMISGTGSTLFEELGLYYIGPVDGHNIDDLVAILKEVKTTNSTGPVLIHVITEKGRGYPYAEKAADKYHGVAKFDPPTGKQFKVAAKTQSYTTYFAEALIAEAKADKDIIAIHAAMGGGTGMNIFHRRFPTRCFDVGIAEQHAVTFAAGLACEGLKPFCAIYSSFLQRAYDQVVHDVDLQKLPVRFAMDRAGLVGSDGPTHSGSFDVTFMACLPNMVVMAPSDEAELCHMVATAAAIDDRPSCFRYPRGNGIGVELPTEYKGIPLEIGKGRILIEGERVALLGYGSAVQNCLAAASLVEQHGLRLTVADARFCKPLDRSLIRSLAKSHEVLITVEEGSIGGFGSHVAQFMALDGLLDGNLKWRPVVLPDRYIDHGSPADQLCMAGLTPSHIAATVFNILGQTREALEVMS

SEQ ID NO: 13398 - protein, 735 aa, Solanum lycopersicum
MALCAYAFPGILNRTGVVSDSSKATPLFSGWIHGTDLQFLFQHKLTHEVKKRSRVVQASLSESGEYYTQRPPTPILDTVNYPIHMKNLSLKELKQLADELRSDTIFNVSKTGGHLGSSLGVVELTVALHYVFNAPQDRILWDVGHQSYPHKILTGRRDKMSTLRQTDGLAGFTKRSESEYDCFGTGHSSTTISAGLGMAVGRDLKGRNNNVIAVIGDGAMTAGQAYEAMNNAGYLDSDMIVILNDNRQVSLPTATLDGPVAPVGALSSALSRLQSNRPLRELREVAKGVTKQIGGPMHELAAKVDEYARGMISGSGSTLFEELGLYYIGPVDGHNIDDLIAILKEVRSTKTTGPVLIHVVTEKGRGYPYAERAADKYHGVAKFDPATGKQFKASAKTQSYTTYFAEALIAEAEADKDIVAIHAAMGGGTGMNLFHRRFPTRCFDVGIAEQHAVTFAAGLACEGIKPFCAIYSSFMQRAYDQASKNASNYSHFVEYSAVVHDVDLQKLPVRFAMDRAGLVGADGPTHCGAFDVTYMACLPNMVVMAPSDEAELFHMVATAAAIDDRPSCFRYPRGNGIGVELPAGNKGIPLEVGKGRILIEGERVALLGYGSAVQNCLDAAIVLESRGLQVTVADARFCKPLDHALIRSLAKSHEVLITVEEGSIGGFGSHVVQFMALDGLLDGKLKWRPIVLPDRYIDHGSPVDQLAEAGLTPSHIAATVFNILGQTREALEVMT

SEQ ID NO: 13399 - protein, 707 aa, Elaeis guineensis
MALSTFSFPSQMPSLLCPHWLGGADLHSHQHQYRLLKTRKRPCVCASLSEHGEYHSQRPPTPLLDTINYPIHMKNLSIKELKQLGDELRSDIIFHVSKTGGHLGSSLGVVELTVALHHVFNAPQDKILWDVGHQSYPHKILTGRRDKMPTLRQTNGLSGFTKRSESEYDSFGAGHSSTSISAALGMAVGRDLKGRKNNVIAVIGDGAMTAGQAYEAMNNAGYLDSDMIVILNDNKQVSLPTANLDGPIPPVGALSSALSRLQSSRPLRELREVAKGVTKQIGGSMHKLAAKVDEYARGMISGSGSTLFEELGLYYIGPVDGHNMDDLVTILKEVKSTKTTGPVFIHVVTEKGRGYPYAERAADKYHGVAKFDPSTGKQFKSRSKTQSYTNYFAEALISEAEVDKDIVAIHAAMGGGTGLNYFLRRFPTRCFDVGIAEQHAVTFAAGLACEGLKPFCAIYSSFLQRAYDQVVHDVDLQKLPVRFAMDRAGLVGADGPTHCGSFDVTYMACLPNMVVMTPSDEAELFHMVATAAAIDDRPSCFRYPRGNGVGVPLPAGNKGVPLEVGKGRILIEGERVALLGYGAAVQGCLAAASLLEEHSLKVTVADARFCKPLDHALIRSLARSHELLITVEEGSIGGFGSHVAQFMALDGLLDGKLKWRPLVLPDRYIDHGSPADQLAEAGLTPSHVAATVFNMLGQAREALEIMS

SEQ ID NO: 13400 - protein, 173 aa, Flaveria ramosissima
HAPVVQHCFFGKDLQHPQSSHKPFNQLSKRVGVVQSTMADRGEYHSQRPPTPLLDTINYPIHMKNLSIKELKQLADELRSDVIFNVSKTGGHLGSSLGVVELTVALHYVFNTPQDKILWDVGHQSYPHKILTGRRDRMHTIRQTNGLAGFTKRSESEHDCFGTGHSSTTISAG

SEQ ID NO: 13401 - protein, 683 aa, Eutrema parvulum
NFCFVQSKVRTRVCGSLVEKGEYHSIRPPTPLLDTINHPIHMKNLSIKELKVLSDELRSDVIFNVSKTGGHLGSNLGVVELTVAFHYIFNTPQDKNLWDVGHQSYPHKILTGRRGKMKTMRQTNGLSGFTKRGESEHDSFGTGHSSTTISAGLGMAVGRDLKGRNNNVVAVIGDGAMTAGQAYEAMNNAGYLDSDMIVILNDNKQVSLPTANLDGPTPPVGALSSALSRLQSNRPLRELREAAKASNYSLTCGVTKQIGGSMHRLASTVDDYARGLISGAGSKLFEELGMYYIGPVDGHNIDDLVSILKEVKSTRTIGPVLIHVVTEKGRGYPYAERADDKYHGVLKFDPATGKQFKNIAETQSYTTYFAEALISEAEADRDIVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEAELFNMVATAAAIDDRPSCFRYPRGNGIGVSLPPGNKGVPLQIGKGRILREGERVALLGYGSAVQNCLEASSILDKRGMKVTVADARFCKPLDVALIRNLAKSHEVLVTVEEGSIGGFGSHVVQFLALDGLLDGKLKWRPMVLPDRYIEHGSPLDQLAEAGLTASHIAATALNLIGTPRETLFWK

SEQ ID NO: 13402 - protein, 289 aa, Ambrosia trifida
MNLFHRRFPSRCFDVGIAEQHAVTFAAGLACEGLKPFCAIYSSFLQRGYDQVVHDVDLQKLPVRFAMDRAGLVGADGPTHSGSFDVTYMACLPNMVVMAPSDEAELFHMVATAAAIDDRPSCFRYPRGNGIGVPLPPGNKGIPLEVGKGRIMLEGERVALLGYGTAVQSCLAAAGLVKGRGLNITVADARFCKPLDHHLIRALAKSHEVLITVEEGSIGGFGSHVAHFMALDGLLDGKLKWRPLVLPDRYIDHGAPDDQLAEAGLTPSHIAATVFNVLGQTREALEVMS

SEQ ID NO: 13403 - protein, 714 aa, Salvia sclarea
MALCPFAFSGSLVAADAQKHTNFCSQWLHGADLPFHPFCKNSQIRKSSTGICATLSERGEYFSQKPPTPLLDTINYPIHMKNLSTKELQQLADELRSDVIFNVSKTGGHLGSSLGVIELTVALHYVFNAPQDRILWDVGHQAYPHKILTGRRDRMPSLRQTGGLSGFTKRSESDYDCFGAGHSSTTISAGLGMAVGRDLKGRKDNVVAVIGDGAMTAGQAYEAMNNAGYLDSDMIVILNDNKQVSLPTANLDGPTAPVGALSSALSRLQSNRPLRELREVAKGVTKQIGGPMHELAAKVDEYARGLISGSGSTLFEELGLYYIGPVDGHNLDDLTAIHREVKSTKTTGPVLIHVVTEKGRGYPYAEKAADKYHGVTKFDPATGKQFKSSAPTQPYTTYFAEALIAEAEVDKDIVAIHAAMGGGTGLNLFQRRFPTRCFDVGIAEQHAVTFAAGLACEGIKPFCAIYSSFLQRGYDQVVHDVDLQKLPVRFAMDRAGLVGADGPTHCGAFDVTFMACLPNMVVMAPSDEAELFNMVATAAAIDDRPSCFRYPRGNGIGVELPPGNKGKPLEIGKGRILIEGERVALLGYGSAVQSCLAAAALVETRGLQLTVADARFCMPLDHALIRSLAKSHEVLITVEEGSIGGFGSHVAHFMALDGLLDGNLKWRPLVLPDRYIDHGAPVDQLMEAGLTPSHIAATVFNILGKAREALEIMS

SEQ ID NO: 13404 - protein, 735 aa, Solanum phureja
MALCAYAFPGILNRTAVVSDSSKTAPLFSEWIHGTDLQFLFQHKLTHEVKKRSRVVQASLSESGEYYTQRPPTPILDTVNYPIHMKNLSLKELKQLADELRSDTIFNVSKTGGHLGSSLGVVELTVALHYVFNAPQDRILWDVGHQSYPHKILTGRRDKMSTLRQTDGLAGFTKRSESEYDCFGTGHSSTTISAGLGMAVGRDLKGRNNNVIAVIGDGAMTAGQAYEAMNNAGYLDSDMIVILNDNRQVSLPTATLDGPVAPVGALSSALSRLQSNRPLRELREVAKGVTKQIGGPMHELAAKVDEYARGMISGSGSTLFEELGLYYIGPVDGHNIDDLIAILKEVRSTKTTGPVLIHVVTEKGRGYPYAERAADKYHGVAKFDPATGKQFKASAKTQSYTTYFAEALIAEAEADKDIVAIHAAMGGGTGMNLFHRRFPTRCFDVGIAEQHAVTFAAGLACEGIKPFCAIYSSFMQRAYDQASKNASNYSHFIEYSAVVHDVDLQKLPVRFAMDRAGLVGADGPTHCGAFDVTYMACLPNMVVMAPSDEAELFHMVATAAAIDDRPSCFRYPRGNGIGVELPAGNKGIPLEVGKGRILIEGERVALLGYGSAVQNCLDAAIVLESRGLQVTVADARFCKPLDHALIRSLAKSHGVLITVEEGSIGGFGSHVVQFMALDGLLDGKLKWRPIVLPDRYIDHGSPVDQLSEAGLTPSHIAATVFNILGQTREALEVMT

SEQ ID NO: 13405 - protein, 708 aa, Glycine max
MDLSALSSYRTLGKLLPLPSHSQWGLHFLAHAHRLHQMKKRPCGVYASLSESGEYYSHRPPTPLLDTVNYPIHMKNLSAKELKQLADELRSDVIFSVSRTGGHLGSSLGVVELTVALHYVFNAPQDKILWDVGHQSYPHKILTGRRDQMHTMRQTNGLSGFTKRSESEFDCFGTGHSSTTISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKRIGGPMHELAAKVDEYARGMISGSGSSLFEELGLYYIGPVDGHNIDDLVAILNEVKSTKTTGPVLIHVITEKGRGYPYAEKAADKYHGVTKFDPPTGKQFKSKATTQSYTTYFAEALIAEAEADKDVVAIHAAMGGGTGMNLFHRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEADLFHMVATAAAINDRPSCFRYPRGNGIGVQLPTGNKGTPLEIGKGRILIEGERVALLGYGSAVQNCLAAASLVECHGLRLTVADARFCKPLDRSLIRSLAKSHEVLITVEEGSIGGFGSHVAQFMALDGLLDGKLKWRPIVLPDRYIDHGSPADQLSLAGLTPSHIAATVFNVLGQTREALEVMS

SEQ ID NO: 13406 - protein, 729 aa, Phalaenopsis aphrodite
MNLSALFYPCQLPAGSIVSGCTSQSPLSSSRLLRGFHSETYQHQHAKKMKKAYVHAALSDSGEYYSQKPPTPLLDTINYPIHMKNLSMKELKQLSDELRSDVIFNVSKTGGHLGSSLGVVELTVALHYVFNAPMDKIVWDVGHQSYPHKILTGRRDKMPTLRQTNGLSGFTKRSESEYDSFGTGHSSTSISAALGMAVGRDLMGRKNNVIAVIGDGAMTAGQAYEAMNNAGYLDSDMIVILNDNKQVSLPTANLDGPIPPVGALSSALSKLQSSRPLRELREVAKGVTKQIGGSMHEFAAKVDEYARGMISGSNSSLFEELGLYYIGPVDGHNLDDLITILKEVKSTKTTGPVLIHVVTEKGRGYPYAERAADKYHGVAKFDPATGKQFKGSAKTQSYTNYFAEALIAEAEADKNIVAIHAAMGGGTGLNYFLRRFPNRCFDVGIAEQHAVTFAAGLACEGLKPFCAIYSSFLQRAYDQVIHDVDLQKLPVRFALDRAGLVGADGPTHCGSFDVTYMACLPNMIVMAPSDEAELFHMVATAAAINDRPSCFRYPRGDGIGIPLPPGNKGVPIEVGKGRILREGEAVALLGYGTAVQSCLAAARLVEHHGLKLTVADARFCKPLDQALIRSLAKSHQVLITVEEGSIGGFGSHVAQFMALDGLLDGTTKWRPLVLPDRYIEHGSPGDQMCEAGLTPSHIAATALNVAGKKMEALEIMSYQLNKSSSKNTA

SEQ ID NO: 13407 - protein, 712 aa, Triticum aestivum
MALSSTFSLPRGFLGVLPQEHHFAPAVELQAKPLKTPRRRSSGISASLSEREAEYHSQRPPTPLLDTVNYPIHMKNLSLKELQQLSDELRSDVIFHVSKTGGHLGSSLGVVELTVALHYVFNTPQDKLLWDVGHQSYPHKILTGRRDKMPTMRQTNGLSGFVKRSESEYDSFGTGHSSTTISAALGMAVGRDLKGAKNNVVAVIGDGAMTAGQAYEAMNNAGYLDSDMIVILNDNKQVSLPTATLDGPAPPVGALSGALSKLQSSRPLRELREVAKGVTKQIGGSVHEIAAKVDEYARGMISGSGSSLFEELGLYYIGPVDGHNIDDLITILREVKGTKTTGPVLIHVITEKGRGYPYAERASDKYHGVAKFDPATGRQFKVPAKTLSYTNYFAEALIAEAEQDSKIVAIHAAMGGGTGLNYFLRRFPNRCFDVGIAEQHAVTFAAGLACEGLKPFCAIYSSFLQRGYDQVVHDVDLQKLPVRFAMDRAGLVGADGPTHCGAFDVAFMACLPNMVVMAPSDEAELLNMVATAAAIDDRPSCFRYPRGNGIGVPLPENYKGTAIEVGKGRIMIEGERVALLGYGSAVQYCMAASSIVAQHGLRVTVADARFCKPLDHALIRSLAKSHEVIITVEEGSIGGFGSHVAQFMALDGLLDGKLKWRPVVLPDKYIDHGSPADQLVEAGLTPSHIAATVFNILGQAREALAIMTVQNA

SEQ ID NO: 13408 - protein, 715 aa, Triphysaria pusilla
MALCTFPCSGNLLNGLNPYAQKQSTLYSHGVGLQRLFGCQNNQVRKRSAAGICASLSERGEYLSQKPETPLLDTINYPIHMKNLNVKELKQLADELRSDVIFNVSKTGGHLGSNLGVIELTVALHYIFNAPQDRILWDVGHQSYPHKILTGRREKMPTLRQTEGLCGFTKRSESDYDCFGTGHSSTTISAGLGMAVGRDLKGRNNNVVAVIGDGAMTAGQAYEAMNNAGYLDSDMIVILNDNKQVSLPTANLDGPTPPVGALSSTLSRLQSNRPLRELREVAKGMTKKIGGSTHELAAKVDEYARGLISASGSTLFEELGLYYIGPVDGHSIDDLTAILREVKNTKITGPVLIHVVTEKGRGYPYAEKADDKYHGVAKFDPATGKQFKTSTPTQSYTTYFAEALIAEAEVDKDIVGIHAAMGGGTGMNLFQRRFPTRCFDVGIAEQHAVTFAAGLACEGIKPFCAIYSSFIQRGYDQIVHDVDLQKLPVRFAMDRAGLVGSDGPTHCGAFDVSFMACLPNMVVMAPSDEAELFHMVAMASAIDDRPSCFRYPRGNGIGVELPRGNKGIPLEVGKGRILIEGERVALLGYGSAVQSCLAAAALVEPHGLNLTVADARFCKPLDHALIRSLAKSHDVLITVEEGSIGGFGSHVAQFMALDGLLDGKIKWRPLVLPDRYIDHGSPADQLMQAGLTPSHIAATVFNILGNAREALKIMS

SEQ ID NO: 13409 - protein, 717 aa, Setaria italica
MALSTTFSVPRGFLGVPAQDSHFAPAAELHAHKQLQARPIKPRRRPACVSASLSEREAEYYSQRPPTPLLDTINYPVHMKNLSVKELRQLADELRSDVIFHVSKTGGHLGSSLGVVELTVALHYVFNAPQDRILWDVGHQSYPHKILTGRRDKMPTMRQTNGLAGFTKRAESEYDSFGTGHSSTTISAALGMAVGRDLKGSKNHVVAVIGDGAMTAGQAYEAMNNAGYLDSDMIVILNDNKQVSLPTATLDGPVPPVGALSSALSKLQSSRPLRELREVAKGVTKQIGGSVHELAAKVDEYARGMISGPGSSLFEELGLYYIGPVDGHNIDDLITILNDVKSTKTTGPVLIHVITEKGRGYPYAERAADKYHGVAKFDPATGKQFKSPAKTLSYTNYFAEALIAEAEQDSKIVAIHAAMGGGTGLNYFLRRFPNRCFDVGIAEQHAVTFAAGLACEGLKPFCAIYSSFLQRGYDQVVHDVDLQKLPVRFAMDRAGLVGADGPTHCGAFDVTYMACLPNMVVMAPSDEAELCHMVATAAAIDDRPSCFRYPRGNGIGVPLPPNYKGTPLEVGKGRILLEGDQVALLGYGSAVQYCLAAATLVERHGLKVTVADARFCKPLDQALIRSLAKSHEVLITVEEGSIGGFGSHVAQFMALDGLLDGKLKWRPLVLPDRYIDHGSPADQLAEAGLTPSHIAATVFNVLGQNREALAIMAMPNA

SEQ ID NO: 13410 - protein, 668 aa, Arabidopsis lyrata
MALSVFAFPSYIYRNPSIKYCKPTSMSSTKTSKVRATIAEKGEYYSSRPPTPLLDTINHPMHMKNLSIKELKVLSDELRSDVIFNVSKTGGHLGSNLGVVELTVALHYIFNTPQDKILWDVGHQSYPHKILTGRRGKMKTIRQTNGLSGYTNRRESEHDSFGTGHSSTTISAGLGMAVGRDLKGMNNSVVAVIGDGAMTAGQAYEAMNNAGYLDSDMIVILNDNKQVSLPTANLDGPTPPVGALSCALSRLQSNHDYARRMTSGTGSTLFEELGFHYVGPVDGHNIDDLVSILEKVKSTKPIGPVLIHVVTEKGRGYPYAERADDKYHGVLKFDPATGKQFKNISKTQSYTSCFVEALTAEAEADKNIVAIHAAMGGGTMLNLFESRFPTRCFDVGIAEQHAVTFAAGLACEGLKPFCTIYSSFMQRAYDQVVHDVDLQKLPVRFAIDRAGLMGADGPTHCGAFDVTFMACLPNMIVMAPSDEAELFNMVATAAAIDDRPSCFRYHRGNGIGVSLPPGNKGVPLQIGKGRILREGERVALLGYGSAVQRCLEAASMLSERGLKITVADARFCKPLDVALIRSLVKSHEVLITVEEGSIGGFGSHVVQFLALDGLLDGKLKWRPMVLPDRYIEHGSPMDQLAEAGLTASHIAATALNLMGTPREALFWE

SEQ ID NO: 13411 - protein, 720 aa, Oryza sativa
MALTTFSISRGGFVGALPQEGHFAPAAAELSLHKLQSRPHKARRRSSSSISASLSTEREAAEYHSQRPPTPLLDTVNYPIHMKNLSLKELQQLADELRSDVIFHVSKTGGHLGSSLGVVELTVALHYVFNTPQDKILWDVGHQSYPHKILTGRRDKMPTMRQTNGLSGFTKRSESEYDSFGTGHSSTTISAALGMAVGRDLKGGKNNVVAVIGDGAMTAGQAYEAMNNAGYLDSDMIVILNDNKQVSLPTATLDGPAPPVGALSSALSKLQSSRPLRELREVAKGVTKQIGGSVHELAAKVDEYARGMISGSGSTLFEELGLYYIGPVDGHNIDDLITILREVKSTKTTGPVLIHVVTEKGRGYPYAERAADKYHGVAKFDPATGKQFKSPAKTLSYTNYFAEALIAEAEQDNRVVAIHAAMGGGTGLNYFLRRFPNRCFDVGIAEQHAVTFAAGLACEGLKPFCAIYSSFLQRGYDQVVHDVDLQKLPVRFAMDRAGLVGADGPTHCGAFDVTYMACLPNMVVMAPSDEAELCHMVATAAAIDDRPSCFRYPRGNGIGVPLPPNYKGVPLEVGKGRVLLEGERVALLGYGSAVQYCLAAASLVERHGLKVTVADARFCKPLDQTLIRRLASSHEVLLTVEEGSIGGFGSHVAQFMALDGLLDGKLKWRPLVLPDRYIDHGSPADQLAEAGLTPSHIAATVFNVLGQAREALAIMTVPNA

SEQ ID NO: 13412 - protein, 722 aa, Sorghum bicolor
MALWTTFSVPRGFLAVPAHHDSHFASAVEQLHGHKLLQARPLRPRRHHRPACVSASLSPEREAEYYSQRPPTPLLDTINYPVHMKNLSVKELRQLADELRSDVIFHVSKTGGHLGSSLGVVELTVALHYVFNAPQDRILWDVGHQSYPHKILTGRRDKMPTMRQTNGLAGFTKRAESEYDSFGTGHSSTTISAALGMAVGRDLKGGKNNVVAVIGDGAMTAGQAYEAMNNAGYLDSDMIVILNDNKQVSLPTATLDGPVPPVGALSSALSKLQSSRPLRELREVAKGVTKQIGGSVHELAAKVDEYARGMISGPGSSLFEELGLYYIGPVDGHNIDDLITILNDVKSTKTTGPVLIHVVTEKGRGYPYAERAADKYHGVAKFDPATGKQFKSPAKTLSYTNYFAESLIAEAEQDSKIVAIHAAMGGGTGLNYFLRRFPSRCFDVGIAEQHAVTFAAGLACEGLKPFCAIYSSFLQRGYDQVVHDVDLQKLPVRFAMDRAGLVGADGPTHCGAFDVAYMACLPNMVVMAPSDEAELCHMVATAAAIDDRPSCFRYPRGNGIGVPLPPNYKGTPLEVGKGRILMEGDRVALLGYGSAVQYCLAAASLVERHGLRVTVADARFCKPLDHALIRSLARSHEVIITVEEGSIGGFGSHVAQFMALDGLLDGKLKWRPLVLPDRYIDHGSPADQLAEAGLTPSHIAATVFNILGQNREALAIMAVPNA

SEQ ID NO: 13413 - protein, 719 aa, Zea mays
MALSTFSVPRGFLGVPAQDSHFASAVELHVNKLLQARPINLKPRRRPACVSASLSSEREAEYYSQRPPTPLLDTINYPVHMKNLSVKELRQLADELRSDVIFHVSKTGGHLGSSLGVVELTVALHYVFNAPQDRILWDVGHQSYPHKILTGRRDKMPTMRQTNGLAGFTKRAESEYDSFGTGHSSTTISAALGMAVGRDLKGGKNNVVAVIGDGAMTAGQAYEAMNNAGYLDSDMIVILNDNKQVSLPTATLDGPVPPVGALSSALSKLQSSRPLRELREVAKGVTKQIGGSVHELAAKVDEYARGMISGPGSSLFEELGLYYIGPVDGHNIDDLITILNDVKSTKTTGPVLIHVVTEKGRGYPYAERAADKYHGVAKFDPATGKQFKSPAKTLSYTNYFAEALIAEAEQDSKIVAIHAAMGGGTGLNYFLRRFPSRCFDVGIAEQHAVTFAAGLACEGLKPFCAIYSSFLQRGYDQVVHDVDLQKLPVRFAMDRAGLVGADGPTHCGAFDVAYMACLPNMVVMAPSDEAELCHMVATAAAIDDRPSCFRYPRGNGVGVPLPPNYKGTPLEVGKGRILLEGDRVALLGYGSAVQYCLTAASLVQRHGLKVTVADARFCKPLDHALIRSLAKSHEVLITVEEGSIGGFGSHVAQFMALDGLLDGKLKWRPLVLPDRYIDHGSPADQLAEAGLTPSHIAASVFNILGQNREALAIMAVPNA

SEQ ID NO: 13414 - protein, 719 aa, Phaseolus coccineus
MALSALSFPLHLRQTTSDPKASTPLPLPSSHSHFSVDLLTQSSRRHTQVRKRRHGVCASLSETGEYHSQKPPTPLLDTINYPIHMKNLSAKELNQLAEELRSDVIFHVSRTGGHLGSSLGVVELTIALHYVFNSPKDKILWDVGHQSYPHKILTGRRDMMHTMRQADGLAGFTKRSESEHDCFGTGHSSTTISAALGMAIGRDLKGEKNNVVTVIGDGAMTAGQAYEAMNNAGYLDSDMIVILNDNKQVSLPTADLDGPIPPVGALSSTLSKLQSNRPLRELREVAKGVTKQIGGQMHEIAAKVDEYARGMISGSGSTLFEELGLYYIGPVDGHRIDDLVAILNEVKSTKTTGPVLIHVVTEKGHGYPYAERAVDKYHGVAKFDPATGKQFKAKETTQSITSCFAEALIAEAEADKDIVGIHAAMGGGTGMNMFLRRFPTRCFDVGIAEQHAVTFAAGLACEGLKPFVAIYSSFIQRGYDQVVHDVDLQKLPVRFAIDRAGLVGADGPTHCGAFDVTFMACLPNMVVMAPSDEAELVHMVATAAAINDRPSCFRYPRGNGIGVELPPGNRGIPLEIGKGRILIEGERVALLGYGSAVQSCVTAASLLEHHGLRVTVADARFCKPLDHSLISSLAKSHEVLITVEEGSVGGFGSHVAQFMALAGLLDGKLKWRPMVLPDCYIDHGSRDDQLKEAGLTPSHIAATVFNLLGQTREALEIMT

SEQ ID NO: 13415 - protein, 701 aa, Brachypodium distachyon
TGFLGVLPQEHHFAPALELQTRSLKPRKRSCISASLSAEREAEYHSQRPPTPLLDTVNYPIHMKNLSLKELQQLSDELRSDVIFHVSKTGGHLGSSLGVVELTVALHYVFNTPQDKILWDVGHQSYPHKILTGRRDKMPTMRQTNGLSGFVKRSESEYDSFGTGHSSTTISAALGMAVGRDLKGAKNNVVAVIGDGAMTAGQAYEAMNNAGYLDSDMIVILNDNKQVSLPTATLDGPAPPVGALSGALSKLQSSRPLRELREVAKGVTKQIGGSVHELAAKVDEYARGMISGSGSSLFEELGLYYIGPVDGHNIDDLITILREVKGTKTTGPVLIHVVTEKGRGYPYAERASDKYHGVAKFDPATGKQFKSPAKTLSYTNYFAEALIAEAEQDSKIVAIHAAMGGGTGLNYFLRRFPNRCFDVGIAEQHAVTFAAGLACEGLKPFCAIYSSFLQRGYDQVVHDVDLQKLPVRFAMDRAGLVGADGPTHCGAFDVTFMACLPNMVVMAPSDEAELLNMVATAAAIDDRPSCFRYPRGNGIGVPLPPNYKGIPLEVGKGRILMEGERVALLGYGSAVQYCVAASSIVEEHGLRVTVADARFCKPLDHALIRSLAKSHEVIITVEEGSIGGFGSHVAQFMALDGLLDGKLKWRPVVLPDKYIDHGSPADQLVEAGLTPSHIAATVFNILGQAREALAIMTVPNA

SEQ ID NO: 13416 - protein, 667 aa, Flaveria ramosissima
GRCGQATWLIEVSITRRRPPTPLLDTINYPIHMKNLSIKELKQLADELRSDVIFNVSKTGGHLGSSLGVVELTVALHYVFNTPQDKILWDVGHQSYPHKILTGRRDRMHTIRQTNGLAGFTKRSESEHDCFGTGHSSTTISAGLGMAVGRDLKGGTNDVVAIIGDGAMTAGQAYEAMNNAGYLDSDMIVILNDNKQVSLPTATLDGPIPPVGALSSALSRLQSNRPLRELREVAKEVTKQIGGPMHELAAKVDEYARGMISGSGSTLFEELGLYYIGPVDGHSIDDLVAILKEVKSTKTTGPVLIHVITEKGRGYPYAEKAADKYHGVAKFDPATGKQFKSSAATQSYTTYFAEALIAEAEVDKKIVGIHAAMGGGTGMNLFHRRFPNRCFDVGIAEQHAVTFAAGLACEGLKPFCAIYSSFLQRGYDQVVHDVDLQKLPVRFAMDRAGLVGADGPTHSGSFDVTYMACLPNMVVMAPSDEAELFHMVATAAAIDDRPSCFRYPRGNGIGAPLPPGNKGVPLEVGKGRILIEGERVALLGYGTAVQSCLVAARLVQERGLNITVADARFCKPLDHNLIRALAKSHEVLITVEEGSIGGFGSHVAHFMALDGLLDGKLKWRPIVLPDRYIDHGAPDDQLAEAGLTPSHIAATVFNVLGQTREALEVMS

SEQ ID NO: 13417 - protein, 810 aa, Brassica rapa
  misc_feature (315)..(315): Xaa can be any naturally occurring amino acid
MSNPAESSDSKSKKDFSTAILERKKSPNRLVVDEAINDDNSVVSLHPATMEKLQLFRGDTILIKGKKRKDTICIALADESCEEPKIRMNKVVRSNLRVRLGDVISVHQCPDVKYGQRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPXREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGGGGDAGGAADRVLNQLLTEMDGMNAKKTVFIIGATNRPDIIDSALLRPGRLDQLIYIPLPDEDSRLNIFKACLRKSPVAKDVDINALAKYTQGFSGADITEICQRACKYAIRENIEKDIEKEKRRSENPEAMEEDGVDEVSEIKAAHFEESMKYARRSVSDADIRKYQAFAQTLQQSRGFGSEFRFETNAAGSGATTGVADPFATSAAAAADDDDLYN

SEQ ID NO: 13418 - protein, 810 aa, Brassica napus
MSNPAESSDSKSKKDFSTAILERKKSPNRLVVDEAINDDNSVVSLHPDTMEKLQLFRGDTILIKGKKRKDTICIALADESCEEPKIRMNKVVRSNLRVRLGDVISVHQCPDVKYGQRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGGGGDAGGAADRVLNQLLTEMDGMNAKKTVFIIGATNRPDIIDSALLRPGRLDQLIYIPLPDEDSRLNIFKACLRKSPVAKDVDINALAKYTQGFSGADITEICQRACKYAIRENIEKDIEKEKRRSENPEAMEEDGVDEVSEIKAAHFEESMKYARRSVSDADIRKYQAFAQTLQQSRGFGSEFRFETNAAGSGATTGVADPFATSAAAAADDDDLYN

SEQ ID NO: 13419 - protein, 810 aa, Raphanus sativus
  misc_feature (403)..(403): Xaa can be any naturally occurring amino acid
MSNPAESSDSKSKKDFSTAILERKKSPNRLVVDEAINDDNSVVSLHPATMEKLQLFRGDTILIKGKKRKDTVCIALADESCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERIXKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGGGGDAGGAADRVLNQLLTEMDGMNAKKTVFIIGATNRPDIIDSALLRPGRLDQLIYIPLPDEDSRLNIFKAALRKSPIAKDVDINALAKYTQGFSGADITEICQRACKYAIRENIEKDIEKEKRRSENPEAMEEDGVDEVSEIKAAHFEESMKYARRSVSDADIRKYQAFAQTLQQSRGFGSEFRFETNAAGSGATTGVADPFATSAAAAADDDDLYN

SEQ ID NO: 13420 - protein, 809 aa, Brassica napus
MSNPAESSDSKSKKDFSTAILERKKSPNRLVVDEAINDDNSVVSLHPDTMEKLQLFRGDTILIKGKKRKDTVCIALADESCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGGGGDAGGAADRVLNQLLTEMDGMNAKKTVFIIGATNRPDIIDSALLRPGRLDQLIYIPLPDEDSRLNIFKACLRKSPVAKDVDINALAKYTQGFSGADITEICQRACKYAIRENIEKDIEREKRRSLNPEAMEEDGVDEVSEIKAAHFEESMKYARRSVSDADIRKYQAFAQTLQQSRGFGSEFRFETNAGSGATTGVADPFATSAAAAADDDDLYN

SEQ ID NO: 13421 - protein, 809 aa, Eutrema parvulum
MSNPAESSDSKSKKDFSTAILERKKSPNRLVVDEAINDDNSVVSLHPATMEKLQLFRGDTILIKGKKRKDTVCIALADESCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSGSGGDGGGAADRVLNQLLTEMDGMNAKKTVFIIGATNRPDIIDAALLRPGRLDQLIYIPLPDEDSRLNIFKACLRKSPIAKDVDINALAKYTQGFSGADITEICQRACKYAIRENIEKDIEKEKRRSENPEAMEEDGVDEVSEIKAAHFEESMKYARRSVSDADIRKYQAFAQTLQQSRGFGSEFRFETSAGSGATTGVADPFATSAAAAADDDDLYN

SEQ ID NO: 13422 - protein, 808 aa, Brassica napus
MSNPAESSDSKPKKDFSTAILERKKSPNRLVVDEAINDDNSVVSLHPATMEKLQLFRGDTILIKGKKRKDTICIALADESCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGSGGDGGGAADRVLNQLLTEMDGMNAKKTVFIIGATNRPDIIDSALLRPGRLDQLIYIPLPDEDSRLNIFKACLRKSPIAKDVDINALAKYTQGFSGADITEICQRACKYAIRENIEKDIEKEKRRSENPEAMEEDMDEVSEIKAAHFEESMKYARRSVSDADIRKYQAFAQTLQQSRGFGSEFRFETNAGSGATTGVADPFATSAAAAADDDDLYN

SEQ ID NO: 13423 - protein, 808 aa, Brassica napus
MSNPAESSDSKSKKDFSTAILERKKSPNRLVVDEAINDDNSVVSLHPATMEKLQLFRGDTILIKGKKRKDTICIALADESCEEPKIRMNKVVRSNLRVRLGDVISVHQCPDVKYGQRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGSGGDGGGAADRVLNQLLTEMDGMNAKKTVFIIGATNRPDIIDSALLRPGRLDQLIYIPLPDEDSRLNIFKACLRKSPIAKDVDINALAKYTQGFSGADITEICQRACKYAIRENIEKDIEKEKRRSENPEAMEEDMDEVSEIKAAHFEESMKYARRSVSDADIRKYQAFAQTLQQSRGFGSEFRFETNAGSGATTGVADPFATSAAAAADDDDLYN

SEQ ID NO: 13424 - protein, 809 aa, Eutrema halophilum
MSTPAESSDSKPKKDFSTAILERKKSPNRLVVDEAINDDNSVVSLHPATMEKLQLFRGDTILIKGKKRKDTVCIALADESCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSGSGGDGGGAADRVLNQLLTEMDGMNAKKTVFIIGATNRPDIIDAALLRPGRLDQLIYIPLPDEDSRLNIFKACLRKSPVAKDVDINALAKYTQGFSGADITEICQRACKYAIRENIEKDIEKEKRRSENPEAMEEDGEDEVSEIKAAHFEESMKYARRSVSDADIRKYQAFAQTLQQSRGFGSEFRFENTAGSGATTGVADPFATSAAAAADDDDLYN

SEQ ID NO: 13425 - protein, 809 aa, Arabidopsis thaliana
MSTPAESSDSKSKKDFSTAILERKKSPNRLVVDEAINDDNSVVSLHPATMEKLQLFRGDTILIKGKKRKDTVCIALADETCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDDVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWNDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGSGGDGGGAADRVLNQLLTEMDGMNAKKTVFIIGATNRPDIIDSALLRPGRLDQLIYIPLPDEDSRLNIFKAALRKSPIAKDVDIGALAKYTQGFSGADITEICQRACKYAIRENIEKDIEKEKRRSENPEAMEEDGVDEVSEIKAAHFEESMKYARRSVSDADIRKYQAFAQTLQQSRGFGSEFRFENSAGSGATTGVADPFATSAAAAGDDDDLYN

SEQ ID NO: 13426 - protein, 809 aa, Arabidopsis lyrata
MSTPAESSDSKSKKDFSTAILERKKSPNRLVVDEAINDDNSVVSLHPATMEKLQLFRGDTILIKGKKRKDTVCIALADESCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDDVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWNDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGSGGDGGGAADRVLNQLLTEMDGMNAKKTVFIIGATNRPDIIDSALLRPGRLDQLIYIPLPDEDSRLNIFKAALRKSPIAKDVDIAALAKYTQGFSGADITEICQRACKYAIRENIEKDIEKEKRRNENPEAMEEDGVDEVSEIKAAHFEESMKYARRSVSDADIRKYQAFAQTLQQSRGFGSEFRFENSTGSGATTGVADPFATSAAAAGDDDDLYN

SEQ ID NO: 13427 - protein, 810 aa, Arabidopsis thaliana
MSNEPESSDSKTKKDFSTAILERKKSPNRLVVDEAINDDNSVVSLHPTTMEKLQLFRGDTILIKGKKRKDTVCIALADETCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVSNEHFHTALGNSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGNSAGDAGGAADRVLNQLLTEMDGMNAKKTVFIIGATNRPDIIDSALLRPGRLDQLIYIPLPDEDSRLNIFKACLRKSPVAKDVDVTALAKYTQGFSGADITEICQRACKYAIRENIEKDIENERRRSQNPEAMEEDMVDDEVSEIRAAHFEESMKYARRSVSDADIRKYQAFAQTLQQSRGFGSEFRFDSTAGVGRTTGVAAADPFATSAAAADDDDLYS

SEQ ID NO: 13428 - protein, 810 aa, Arabidopsis lyrata
MSNQPESSDSKPKKDFSTAILERKKSPNRLVVDEAINDDNSVVSLHPATMEKLQLFRGDTILIKGKKRKDTVCIALADETCEEPRIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDDVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVSNEHFHTALGNSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGNSVGDAGGAADRVLNQLLTEMDGMNAKKTVFIIGATNRPDIIDPALLRPGRLDQLIYIPLPDEDSRLNIFKACLRKSPVAKDVDVTALAKYTQGFSGADITEICQRACKYAIRENIEKDIEKERRRSENPEAMEEDMVDDEVSEIRAAHFEESMKYARRSVSDADIRKYQAFAQTLQQSRGFGSEFRFDSTASAGRTIGGAAADPFATSAAAADDDDLYS

SEQ ID NO: 13429 - protein, 810 aa, Eutrema halophilum
MSNQPESSDSKSKKDFSTAILERKKSPNRLVVDEAINDDNSVVSIHPATMEKLQLFRGDTILIKGKKRKDTVCIALADESCEEPKIRMNKVVRSNLRVRLGDVVSVHQCPDVKYGKRVHILPVDDTVEGVTGNLFDAYLKPYFLEAYRPVRKGDLFLVRGGMRSVEFKVIETEPAEYCVVAPDTEIFCEGEPIKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLSEDVDLERISKDTHGYVGADLAALCTEAALQCIREKMDVIDLEDDSIDAEILNSMAVSNEHFQTALGNSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEDSRLNIFKACLRKSPVAKDVDVTALAKYTQGFSGADITEICQRACKYAIRENIEKDIERERRRSENPEAMEEDLVDDEVAEIRAAHFEESMKYARRSVSDADIRKYQAFAQTLQQSRGFGTEFRFDPTAAAGRTTGGAAADPFATSAAAADDDDLYS

SEQ ID NO: 13430 - protein, 810 aa, Eutrema parvulum
MSNQPESSDSKSKKDFSTAILERKKSPNRLVVDEAINDDNSVVSLHPATMEKLQLFRGDTILIKGKKRKDTVCIALADESCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDDVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERICKDTHGYVGADLAALCTEAALQCIREKMDVIDLEDDSIDAEILNSMAVSNEHFHTALGNSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEDSRLNIFKACLRKSPVAKDVDVTALAKYTQGFSGADITEICQRSCKYAIRENIEKDIERERRRSENPEAMEEDLVDDEVAEIRAAHFEESMKYARRSVSDADIRKYQAFAQTLQQSRGFGTEFRFDPTTAAGPTTGGAAADPFATSTAAADDDDLYS

SEQ ID NO: 13431 - protein, 653 aa, Brassica napus
RHEDKSSQLSSTTLCSISAIITLSNQPESSDSKSKKDFSTAILERKKSPNRLVVDEAINDDNSVVSLHPNAMEKLQLFRGDTILIKGKKRKDTVCIALADDSCEEPKIRMNKVVRSNLRVRLGDVVSVHQCPDVKYGTRVHILPVDDTVEGVTGNLFDAYLKPYFLEAYRPVRKGDLFLVRGGMRSVEFKVIETDPAEYCVVAPDTEIFCEGEPIKREDEERLDEVGYDDVGGVRKQMAQIRELVELPLRHPQLFKSIGVKPPKGILLYGPPGSGKTLIARAVANETGAFFFCINGPEIMSKMAGESESNLRKAFEEAEKNAPSIIFIDEIDSIAPKRDKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDESIDAEILNSMAVSNEHFHTALGNSNPSALRETVVEVPNVSWKDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNARRLSSSSERLTDPTL

SEQ ID NO: 13432 - protein, 806 aa, Vinca minor
MSNQAESSDSKGTKRDFSTAILERKKSPNRLVVDEAINDDNSVVALHPDTMEKLQLFRGDTILIKGKKRKDTICIALADETCDEPKIRMNKVVRSNLRVRLGDVVSVHQCPDVKYGKRVHILPVDDTVEGVTGNLFDAYLKPYFLEAYRPVRKGDLFLVRGGMRSVEFKVIETDPSEYCVVAPDTEIFCEGEPVRREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVDLEKISKDTHGYVGADLAALCTEAALQCIREKMDVIDLEDDSIDAEILNSMAVTNEHFSTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEDSRHQIFKACLRKSPISKDVDLRALAKYTQGFSGADITEICQRACKYAIRENIEKDIEREKRRRDNPEAMEEDVDDEVAEITAAHFEESMKYARRSVSDADIRKYQAFAQTLQQSRGFGTEFRFSETSASGATGTDPFAAPAGGADEDDLYS

SEQ ID NO: 13433 - protein, 805 aa, Tabernaemontana elegans
MSNQAESSDSKGTKRDFSTAILERKKAPNRLVVDEAINDDNSVVALHPETMEKLQLFRGDTILIKGKKRRDTICIALADDSCEEPKIRMNKVVRSNLRVRLGDVVSVHQCPDVKYGKRVHILPIDDTVEGVTGNLFDAYLKPYFLEAYRPVRKGDLFLVRGGMRSVEFKVIETEPAEYCVVAPDTEIFCEGEPVRREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSEDVDLERIAKDTHGYVGADLAALCTEAALQCIREKMDVIDLEDDSIDAEILNSMAVTNEHFQTALGTSNPSALRETVVEVPNVTWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEDSRHQIFKACLRKSPVSKDVDLRALAKYTQGFSGADITEICQRACKYAIRENIEKDIERERRRRDNPEAMEEDVEDEVAEIKAAHFEESMKYARRSVSDADIRKYQAFAQTLQQSRGFGSEFRFPETGAGATGADPFATSAGGADEDDLYS

SEQ ID NO: 13434 - protein, 805 aa, Euphorbia peplus
MSSQAESSDSKGTKRDFSTAILERKKSPNRLVVDEAINDDNSVVSLHPETMEKLQLFRGDTILIKGKKRKDTICIALADDTCDEPKIRMNKVVRSNLRVRLGDVVSVHQCPDVKYGKRVHILPIDDTIEGVTGNLFDAYLKPYFLEAYRPVRKGDLFLVRGGMRSVEFKVIETDPTEYCVVAPDTEIFCEGEPVRREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLSEEVDLERIAKDTHGYVGADLAALCTEAALQCIREKMDVIDLEDESIDAEILNSMAVTNEHFHTALGNSNPSALRETVVEVPNCSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPISKDVDIRALAKYTQGFSGADITEICQRACKYAIRENIEKDIERERRRRDNPEAMEEDVEDEVAEIKAAHFEESMKFARRSVSDADIRKYQAFAQTLQQSRGFGSEFRFSEASGATTGADPFTSTAAAADDDDLYS

SEQ ID NO: 13435 - protein, 806 aa, Vinca minor
MSNQAESSDSKGTKRDFSTAILERKKSPNRLVVDEAINDDNSVVALHPDTMEKLQLFRGDTILIKGKKRKDTICIALADETCDEPKIRMNKVIRSNLRVRLGDVVSVHQCPDVKYGKRVHILPVDDTVEGVTGNLFDAYLKPYFLEAYRPVRKGDLFLVRGGMRSVEFKVIETDPAEYCVVAPDTEIFCEGEPVRREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLERISKDTHGYVGADLAALCTEAALQCIREKMDVIDLEDDSIDAEILNSMAVTNEHFSTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSGGDAGGAADRVLNQLLTEMDGMNAKKTVFIIGATNRPDIIDPALLRPGRLDQLIYIPLPDEDSRHQIFKACLRKSPISKNVDLRALAKYTQGFSGADITEICQRACKYAIRENIEKDIERERRRRDNPEAMEEDVEDEVAEITAGHFEESMKYARRSVSDADIRKYQAFAQTLQQSRGFGTEFRFSETSAGGTTGSDPFAAPAGGADEDDLYS

SEQ ID NO: 13436 - protein, 805 aa, Aquilegia formosa
MSNQAESSDSKGTKRDFSTAILERKKAANRLVVDEAINDDNSVVSMHPDTMEKLQLFRGDTILIKGKKRKDTICIALADDTCDEPKIRMNKVVRSNLRVRLGDVVSVHQCPDVKYGKRVHILPVDDTIEGVTGNLFDAYLKPYFLEAYRPVRKGDLFLVRGGMRSVEFKVIETDPLEYCVVAPDTEIFCEGEPVKREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLSDDVDLERISKDTHGYVGADLAALCTEAALQCIREKMDVIDLEDESIDAEILNSMAVTNEHFKTALGTSNPSALRETVVEVPNVNWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEASRYSIFKAALRKSPVSKDVDLNALAKYTQGFSGADITEICQRACKYAIRENIEKDIEREKRRSENPEAMEEDVEDEVAEIKAAHFEESMKYARRSVSDADIRKYQAFAQTLQQSRGFGSEFRFADTAGAGTTTSDPFAAAAGADDDDLYS

SEQ ID NO: 13437 - protein, 805 aa, Catharanthus roseus
MSNQAESSDSKGTKRDFSTAILERKKSPNRLVVDEAINDDNSVVALHPDTMEKLQLFRGDTILIKGKKRKDTICIALADDTCDEPKIRMNKVVRSNLRVRLGDVVSVHQCPDVKYGKRVHILPIDDTIEGVTGNLFDAYLKPYFLEAYRPVRKGDLFLVRGGMRSVEFKVIETDPPEYCVVAPDTEIFCEGEPVRREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERISKDTHGYVGADLAALCTEAALQCIREKMDVIDLEDDSIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEDSRHQIFKACLRKSPVSKDVDLRALAKYTQGFSGADITEICQRACKYAIRENIEKDIERERRRRDNPEAMEEDVEDEVAEIKAAHFEESMKFARRSVSDADIRKYQAFAQTLQQSRGFGADFRFSETRAATTGSDPFTTSAGGADEDDLYS

SEQ ID NO: 13438 - protein, 805 aa, Silene vulgaris
MADHAESSDSKGTKKDFSTAILERKKAANRLVVDEAVNDDNSVVSMHPDTMEKLQIFRGDTILLKGKKRKDTICIALADETCEEPKIRMNKVVRSNLRVRLGDVVSVHQCPDVKYGKRVHILPIDDTIEGVTGNLFDAYLKPYFLEAYRPVRKGDFFLVRGGMRSVEFKVIETDPAEYCVVAPDTEIFCEGEPVKREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVDLEKISKETHGYVGADLAALCTEAALQCIREKMDVIDLEDDTIDAEILNSMAVTNEHYQTALGQSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQAAPCVLFFDELDSIATQRGGGGGDAGGAADRVLNQLLTEMDGMSAKKTVFIIGATNRPDIIDSALLRPGRLDQLIYIPLPDDESRLQIFKAALRKSPIAKDVDINALAKYTQGFSGADITEICQRACKYAIRENIEKDIEKERRRNENPEAMEEDLDDEVSEIKAAHFEESMKYARRSVSDADIRKYQAFAQTLQQSRGFGSEFRFNTSTTTPSATDAFAASAGAADEDDLYN

SEQ ID NO: 13439 - protein, 807 aa, Vinca minor
MSNQAESSDSKGTKRDFSTAILERKKSPNRLVVDEAINDDNSVVALHPDTMEKLQLFRGDTILIKGKKRKDTICIALADETCDEPKIRMNKVIRSNLRVRLGDVVSVHQCPDVKYGKRVHILPVDDTVEGVTGNLFDAYLKPYFLEAYRPVRKGDLFLVRGGMRSVEFKVIETEPAEYCVVAPDTEIFCEGEPVRREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDELDSIAPKREKTHGEVERRIVSQLLTLMDGLKSRAHVIVMGATNRPNSIDPALRRFGRFDREIDIGVPDEVGRLEVLRIHTKNMKLSEDVDLERISKDTHGYVGADLAALCTEAALQCIREKMDVIDLEDDSIDAEILNSMAVTNEHFSTALGTSNPSALRETVVEVPNVSWEDIGGLGNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEDSRHQIFKACLRKSPISKDVDLRALAKYTQGFSGADITEICQRACKYAIRENIEKDIERERRRKDNPEAMEEDVEDEVAEIKAAHFEESMKYARRSVSDADIRKYQAFAQTLQQSRGFGTEFRFSETSAGGGATGSDPFAAPAGGADEDDLYS

SEQ ID NO: 13440 - protein, 807 aa, Castanea mollissima
MAHQGESSDPKLGKKDFSTAILERKKSPNRLVVDEAVNDDNSVVALHPDTMEKLQLFRGDTILIKGKKRKDTVCIALADETCEEPKIRMNKVVRSNLRVRLGDVVSVHQCPDVKYGKRVHILPVDDTIEGVTGNLFDAYLKPYFLEAYRPVRKGDLFLVRGGMRSVEFKVIETDPGEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDELDSIAPKREKTHGEVERRIVSQLLTLMDGLKSRAHVIVMGATNRPNSIDPALRRFGRFDREIDIGVPDEIGRLEVLRIHTKNMKLSEEVDLERISKDTHGYVGADLAALCTEAALQCIREKMDVIDLEDDSIDAEILSSMAVTNEHFQTALGTSNPSALRETVVEVPNVGWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEESRFQIFKSCLRKSPVSKDVDLRALAKYTQGFSGADITEICQRACKYAIRENIEKDIEKERRRSENPEAMDEDENDEVAEIRAAHFEESMKFARRSVSDADIRKYQAFAQTLQQSRGFGSEFRFSETRAGATTGSDPFATSAGGAADEDDLYS

SEQ ID NO: 13441 - protein, 806 aa, Ricinus communis
MSNQAESSDSKGTKRDFSTAILERKKSPNRLVVDEAINDDNSVVSLHPETMEKLQLFRGDTILIKGKKRKDTICIALADDSCDEPKIRMNKVVRSNLRVRLGDVVSVHQCPDVKYGKRVHILPIDDTIEGVTGNLFDAYLKPYFLEAYRPVRKGDLFLVRGGMRSVEFKVIETDPAEYCVVAPDTEIFCEGEPVRREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERISKDTHGYVGADLAALCTEAALQCIREKMDVIDLEDETIDAEILNSMAVSNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRRRDNPEAMEEDVEDDVAEIKAAHFEESMKYARRSVSDADIRKYQAFAQTLQQSRGFGSEFRFSEATGAAAGADPFAASAGGEADDDDLYS

SEQ ID NO: 13442 - protein, 805 aa, Ricinus communis
MSNQPESSDSKGTKRDFSTAILERKKSPNRLVVDEAINDDNSVVSLHPETMEKLQLFRGDTILIKGKKRKDTICIALADGSCDEPKIRMNKVVRSNLRVRLGDVVSVHQCPDVKYGKRVHILPIDDTIEGVTGNLFDAYLKPYFLEAYRPVRKGDLFLVRGGMRSVEFKVIETDPAEYCVVAPDTEIFCEGEPVRREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERISKDTHGYVGADLAALCTEAALQCIREKMDVIDLEDESIDAEILNSMAVSNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRQRDNPEAMEEDVEDDVAEIKAAHFEESMKYARRSVSDADIRKYQAFAQTLQQSRGFGSEFRFSESTGGAAGADPFAASAGGADDDDLYN

SEQ ID NO: 13443 - protein, 808 aa, Solanum lycopersicum
MTNKAESSDSKGTKRDFSTAILERKKSPNRLVVDEATNDDNSVVAIHPDTMEKLQLFRGDTILIKGKKRKDTICIALADDTCDVPKIRMNKVVRNNLRVRLGDVVSVHQCPDVKYGKRVHILPIDDTIEGVTGNLFDAYLKPYFLEAYRPVRKGDLFLVRGGMRSVEFKVIETDPAEYCVVAPDTEIFCEGEPVIREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEEVDLERICKDTHGYVGADLAALCTEAALQCIREKMDVIDLEDETIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSSSGDAGGAADRVLNQLLTEMDGMNAKKTVFIIGATNRPDIIDPALLRPGRLDQLIYIPLPDEDSRHQIFKACLRKSPLSKDIDLRALAKYTQGFSGADITEICQRACKYAIRENIEKDIEREKRRSENPEAMEEDVEDEVPEIKAAHFEESMKYARRSVSDADIRKYQAFAQTLQQSRGFGSEFRFSETSTAGTTGTAADPFATSAGGADEDDLYS

SEQ ID NO: 13444 - protein, 808 aa, Solanum phureja
MTNKAESSDSKGTKRDFSTAILERKKSPNRLVVDEATNDDNSVVAIHPDTMEKLQLFRGDTILIKGKKRKDTICIALADDTCDVPKIRMNKVVRNNLRVRLGDVVSVHQCPDVKYGKRVHILPIDDTIEGVTGNLFDAYLKPYFLEAYRPVRKGDLFLVRGGMRSVEFKVIETDPAEYCVVAPDTEIFCEGEPVIREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEEVDLERICKDTHGYVGADLAALCTEAALQCIREKMDVIDLEDETIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSSSGDAGGAADRVLNQLLTEMDGMNAKKTVFIIGATNRPDIIDPALLRPGRLDQLIYIPLPDEDSRHQIFKACLRKSPLSKDIDLRALAKYTQGFSGADITEICQRACKYAIRENIEKDIEREKRRSENPEAMEEDVEDEVPEIKAAHFEESMKYARRSVSDADIRKYQAFAQTLQQSRGFGSEFRFSETSTAGTTGTAADPFATSAGGADEDDLYS

SEQ ID NO: 13445 - protein, 805 aa, Manihot esculenta
MSNQAESSDSKGTKRDFSTAILERKKAPNRLVVDEATNDDNSVVSLHPDTMEKLQLFRGDTILIKGKKRKDTICIALADDTCDEPKIRMNKVVRSNLRVRLGDVVSVHQCPDVKYGKRVHILPIDDTIEGVTGNLFDAYLKPYFLEAYRPVRKGDLFLVRGGMRSVEFKVIETDPAEYCVVAPDTEIFCEGEPVRREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERIAKDTHGYVGADLAALCTEAALQCIREKMDVIDLEDESIDAEILNSMAVSNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERKRRENPEAMEEDVEDDVAEIKAAHFEESMKYARRSVSDADIRKYQAFAQTLQQSRGFGTEFRFSEASGAATGSDPFAASAGGADDDDLYN

SEQ ID NO: 13446 - protein, 804 aa, Citrullus lanatus
MANQPESSDSKGTKRDFSTAILERKKAPNRLVVDEAINDDNSVVALHPDTMEKLQLFRGDTILIKGKKRKDTICIALADDTCDEPKIRMNKVVRSNLRVRLGDVVSVHQCADVKYGKRVHILPVDDTIEGVTGNLFDAYLKPYFLEAYRPLRKGDLFLVRGGMRSVEFKVIETDPAEYCVVAPDTEIFCDGEPVKREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVIGATNRPNSIDPALRRFGRFDREIDIGVPDEVGRLEVLRIHTKNMKLAEEVDLERIAKDTHGYVGADLAALCTEAALQCIREKMDVIDLEDDSIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEESRLQIFKACLRKSPISKDVELRALAKYTQGFSGADITEICQRACKYAIRENIEKDIEKERRKSENPEAMEEDADDEVAEIKAAHFEESMKYARRSVSDADIRKYQAFAQTLQQSRGFGAEFRFEQSSAPTASDPFATSAGGADEDDLYN

SEQ ID NO: 13447 - protein, 807 aa, Citrullus lanatus
MANQAESSDSKGPKRDFSTAILERKKAANRLIVDEAINDDNSVVALHPDTMEKLQLFRGDTILIKGKKRKDTICIALADDTCDEPKIRMNKVVRSNLRVRLGDVVSVHQCADVKYGKRVHILPVDDTIEGVTGNLFDAYLKPYFLEAYRPVRKGDLFLVRGGMRSVEFKVIETDPPEYCVVAPDTEIFCDGEPVKREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERIAKDTHGYVGADLAALCTEAALQCIREKMDVIDLEDETIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRRRDNPEAMEEDVEDEVAEIKAAHFEESMKFARRSVSDADIRKYQAFAQTLQQSRGFGSEFRFSDNTASGTAAADPFATSAGGGADDDDLYN

SEQ ID NO: 13448 - protein, 808 aa, Nicotiana tabacum
MTNKAESSDSKGTKRDYSTAILERKKSPNRLVVDEAINDDNSVVALHPDTMEKLQLFRGDTILIKGKKRKDTICIALADDTCDEPKIRMNKVVRNNLRVRLGDVVSVHQCPDVKYGKRVHILPIDDTIEGVTGNLFDAYLKPYFLEAYRPVRKGDLFLVRGGMRSVEFKVIETDPPEYCVVAPDTEIFCEGEPVSREDENRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEEVDLERIGKDTHGYVGADLAALCTEAALQCIREKMDVIDLEDETIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEDSRHQIFKACLRKSPLSKDIDLRALAKYTQGFSGADITEICQRACKYAIRENIEKDIEREKRRSENPEAMEEDVDDEVAEIKPAHFEESMKYARRSVSDADIRKYQAFAQTLQQSRGFGTEFRFSETSTAGGTTGTADPFATSAGGADEDDLYS

SEQ ID NO: 13449 - protein, 807 aa, Quercus alba
MAHQGESSEPKPAKKDFSTAILERKKSPNRLVVDEAVNDDNSVVALHPDTMEKLQLFRGDTILIKGKKRKDTVCIALADETCEEPKIRMNKVVRSNLRVRLGDVVSVHQCPDVKYGKRVHILPVDDTIEGVTGNLFDAYLKPYFLEAYRPVRKGDLFLVRGGMRSVEFKVIETDPGEYCVVAPDTEIFCEGEPVRREDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDELDSIAPKREKTHGEVERRIVSQLLTLMDGLKSRAHVIVMGATNRPNSIDPALRRFGRFDREIDIGVPDEIGRLEVLRIHTKNMKLSEEVDLERISKDTHGYVGADLAALCTEAALQCIREKMDVIDLEDDSIDAEILNSMAVTNEHFQTALGTSNPSALRETVVEVPNVGWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEESRFQIFKSCLRKSPVSKDVDLRALAKYTQGFSGADITEICQRACKYAIRENIEKDIEKERRRSENPEAMDEDENDEVAEIRAAHFEESMKFARRSVSDADIRKYQAFAQTLQQSRGFGSEFRFSETRTGATSGSDPFATSAGGAADEDDLYS

SEQ ID NO: 13450 - protein, 802 aa, Populus trichocarpa
MSNQAESSDSKGTKRDFSTAILERKKSPNRLVVDEAINDDNSVVSLHPETMEKLQLFRGDTILIKGKKRKDTICIALADDSCDEPKIRMNKVVRSNLRVRLGDVVSVHQCPDVKYGKRVHILPIDDTIEGVTGNLFDAYLKPYFLEAYRPVRKGDLFLVRGGMRSVEFKVIETDPPEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVDLERIAKDTHGYVGADLAALCTEAALQCIREKMDVIDLEDETIDAEILNSMAVTDEHFKTALGISNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDEESRFQIFKSCLRKSPVSKDVDLRALAKYTQGFSGADITEICQRACKYAIRENIEKDIEKERRQKENPEAMEEDVEDEVAEIKAAHFEESMKYARRSVSDADIRKYQAFAQTLQQSRGFGTEFRFAEASAGSDPFAASAGGADEDDLYS

SEQ ID NO: 13451 - protein, 808 aa, Triphysaria pusilla
MTDKAESSDPKGTKRDFSTAILERKKAPNRLVVDEAINDDNSVVTIHPSTMEKLELFRGDTILIKGKKRKDTICIALADDCCEEPKIRMNKVVRSNLRVRLGDVISVHQCADVKYGKRVHILPVDDTIEGVTGNLFDAFLKPYFSEAYRPVRKGDMFLVRGGMRSVEFKVIETDPAEYCVVAPDTEIFCEGEPIKREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKARAHIIVMGATNRPNSIDPALRRFGRFDREIDIGVPDEVGRLEVFRIHTKNMKLAEDVDLERIAKETHGFVGADLAALCTEAALQCIREKMDVIDLEDDTIDAEILNSMAVTNEHFQTALGISNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSSGDGGGAADRVLNQLLTEMDGMNAKKTVFIIGATNRPDIIDSALLRPGRLDQLIYIPLPDEDSRHNIFKACLRKSPISKDVDIKALAKYTQGFSGADITEICQRACKYAIRENIEKDIEREKRRSENPEAMEEDEDEVPEIKAAHFEESMKYARRSVSDADIRKYQSFAQTLQQARGFGSEFRFADNSSGGGATTGTADAFAAPAGAADDDDLYS

SEQ ID NO: 13452 - protein, 807 aa, Cucumis melo
MANQPESSDSKGPKRDFSTAILERKKAANRLVVDEAINDDNSVVALHPDTMEKLQLFRGDTILIKGKKRKDTICIALADDTCDEPKIRMNKVVRSNLRVRLGDVVSVHQCADVKYGKRVHILPVDDTIEGVTGNLFDAYLKPYFLEAYRPVRKGDLFLVRGGMRSVEFKVIETDPPEYCVVAPDTEIFCDGEPVKREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERIAKDTHGYVGADLAALCTEAALQCIREKMDVIDLEDETIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRRRDNPEAMEEDVEDEVAEIKAAHFEESMKFARRSVSDADIRKYQAFAQTLQQSRGFGSEFRFSDNPSSGTAAADPFATSAGGGADDDDLYN

SEQ ID NO: 13453 - protein, 807 aa, Solanum phureja
MSNKAESSDSKGPKKDFSTAILERKKSPNRLVVDEAINDDNSVVSLHPDTMEKLQFFRGDTILIKGKKRKDTICIALVDETCDEPKIRMNKVVRNNLRVRLGDVVSVHQCPDVKYGKRVHILPIDDSIEGVSGNLFDAYLKPYFLEAYRPVRKGDLFLVRGGMRSVEFKVIETDPPEYCVVAPDTEIFCEGEPVNREDENRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLERIGKETHGYVGADLAALCTEAALQCIREKMDVIDLEDESIDAEILNSMAVTNEHFSTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGGSSGDAGGAADRVLNQLLTEMDGMNAKKTVFIIGATNRPDIIDPALLRPGRLDQLIYIPLPDEDSRHQIFKACLRKSPLSKDIDLRALAKYTQGFSGADITEICQRACKYAIRENIEKDIERERRRRDNPEAMEEDVDDEVSEIKPAHFEESMKYARRSVSDADIRKYQAFAQTLQQSRGFGSEFRFAEATTGPTTGTADPFATSAGGADEDDLYS

SEQ ID NO: 13454 - protein, 806 aa, Euphorbia peplus
MSQPAESSDPKSAKKDFSTAILERKKSPNRLVVDEAVNDDNSVVSMHPETMEKLQLFRGDTILIKGKKRKDTVCIALADDTCEPAKIRMNKVVRSNLRVRLGDVVSVHQCPDVKYGKRVHILPIDDTIEGVTGSLFDAYLKPYFLEAYRPVRKGDFFLVRGGMRSVEFKVIETDPGEYCVVAPDTEIFCEGEPVRREDEEKLNEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEIGRLEVLRIHTKNMKLSEEVNLERISKDTHGYVGADLAALCTEAALQCIREKMDVIDLEDDTIDAEILNSMAVTNEHFQTALGTSNPSALRETVVEVPNCSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSQGDAGGAADRVLNQLLTEMDGMSAKKTVFIIGATNRPDIIDPALLRPGRLDQLIYIPLPDEDSRHQIFKACLRKSPVAKDVDLRALTKYTQGFSGADITEICQRACKYAIRENIEKDIEKEKRRAENPEAMDEDVEEVAEIKAAHFEESMKYARRSVSDADIRKYQAFAQTLQQSRGFGSEFRFADSRTDGAAGASDPFATAAGGVDEDDLYS

SEQ ID NO: 13455 - protein, 805 aa, Manihot esculenta
MSNQAESSESKGTKRDFSTAILERKKAPNRLVVDEATNDDNSVVSLHPDTMEKLQLFRGDTILIKGKKRKDTVCIALADDTCDEPKIRMNKVVRSNLRVRLGDVVSVHQCPDVKYGKRVHILPIDDTIEGVTGNIFDAYLKPYFLEAYRPVRKGDLFLVRGGMRSVEFKVIETDPSEYCVVAPDTEIFCEGEPVRREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERIAKDTHGYVGADLAALCTEAALQCIREKMDVIDLEDETIDAEILNSMAVSNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEESRHQIFKACLRKSPVSKDVDLRALAKYTQGFSGADITEICQRACKYAIRENIEKDIERERRRRDNPEAMEEDVEDDVAEIKAAHFEESMKYARRSVSDADIRKYQAFAQTLQQSRGFGSEFRFSEASGAATGSDPFAASAGGADDDDLYN

SEQ ID NO: 13456 - protein, 805 aa, Amsonia hubrichtii
MSNQAESSDSKGTKRDFSTAILERKKAANRLIVDEAVNDDNSVVALHPDTMEKLQLFRGDTILIKGKKRRDTICIALADDTCDEPKIRMNKVVRSNLRVRLGDVVSVHQCPDVKYGKRVHILPIDDTVEGVTGNLFDAYLKPYFLEAYRPVRKGDLFLVRGGMRSVEFKVIETDPAEYCVVAPDTEIFCEGEPVRREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERIAKDTHGYVGADLAALCTEAALQCIREKMDVIDLEDDSIDAEILNSMAVSNEHFQTALGTSNPSALRETVVEVPNVTWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEESRYQIFKSCLRKSPISKDVDLRALAKYTQGFSGADITEICQRACKYAIRENIEKDIERERRRRDNPEAMEEDVEDEVAEIKAAHFEESMKYARRSVSDADIRKYQAFAQTLQQSRGFGSEFRFSDSTAGATGSDPFATSAGGADEDDLYS

SEQ ID NO: 13457 - protein, 807 aa, Unknown
  Sequence found in Organisms: Citrus sinensis, Citrus clementina, Citrus sinensis
MSNQAESSDAKGTKRDFSTAILERKKAPNRLVVDEAINDDNSVVVLHPDTMEKLQFFRGDTILIKGKKRKDTVCIALADDTCEEPKIRMNKVVRSNLRVRLGDVVSVHQCADVKYGKRVHILPVDDTIEGVTGNLFDAYLKPYFTEAYRPVRKGDLFLVRGGMRSVEFKVIETDPPEYCVVAPDTEIFCEGEPVRREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSDDVDLERIAKDTHGYVGADLAALCTEAALQCIREKMDVIDLEDETIDAEILNSMAVTDEHFKTALGTSNPSALRETVVEVPNVNWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEESRLQIFKACLRKSPVSKDVDLRALAKYTQGFSGADITEICQRACKYAIRENIEKDIERERRRSENPEAMEEDVEDEVAEIKAVHFEESMKYARRSVSDADIRKYQAFAQTLQQSRGFGSEFRFPDAAPPGADGGSDPFASSAGGADDDDLYS

SEQ ID NO: 13458 - protein, 806 aa, Vitis vinifera
MSNQAESSDSKGTKRDFSTAILERKKAANRLVVDEAVNDDNSVVALHPDTMEKLQLFRGDTILIKGKKRKDTICIALADDTCDEPKIRMNKVVRSNLRVRLGDVVSVHQCPDVKYGKRVHILPVDDTIEGVTGNLFDAYLKPYFLEAYRPVRKGDLFLVRGGMRSVEFKVIETDPAEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSEDVDLERIAKDTHGYVGADLAALCTEAALQCIREKMDVIDLEDESIDAEILNSMAVTDEHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDSERERRRRENPEAMEEDVDEEVAEIKAAHFEESMKYARRSVSDADIRKYQAFAQTLQQSRGFGTEFRFSETGTGAAGSDPFAASAGGAADEDDLYS

SEQ ID NO: 13459 - protein, 805 aa, Solanum lycopersicum
MTNQAESSDSKGAKKDFSTAILERKKSPNRLVVDEAVNDDNSVVALHPATMEKLQLFRGDTILIKGKKRKDTVVIALADETCDEPKIRMNKVVRSNLRVRLGDVVSVHQCPDVKYGKRVHILPIDDTIEGLTGDLFDAFLKPYFLEAYRPLRKGDNFLVRGGMRSVEFKVIETDPGEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEEVDLERISKDTHGYVGADLAALCTEAALQCIREKMDVIDLEDDSIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSSGDAGGAADRVLNQLLTEMDGMNAKKTVFIIGATNRPDIIDPALLRPGRLDQLIYIPLPDEDSRHQIFKACLRKSPLSKDIDLRALAKYTQGFSGADITEICQRACKYAIRENIEKDIEKEKRRAENPDSMDEDADDEISEIKPAHFEESMKYARRSVSDADIRKYQAFAQTLQQSRGFGTEFRFSETSGGAAASDPFTTSNAGADDDDLYS

SEQ ID NO: 13460 - protein, 805 aa, Solanum phureja
MTNQAESSDSKGAKKDFSTAILERKKSPNRLVVDEAVNDDNSVVALHPATMEKLQLFRGDTILIKGKKRKDTVVIALADETCDEPKIRMNKVVRSNLRVRLGDVVSVHQCPDVKYGKRVHILPIDDTIEGLTGDLFDAFLKPYFLEAYRPLRKGDNFLVRGGMRSVEFKVIETDPGEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEIGRLEVLRIHTKNMKLAEEVDLERISKDTHGYVGADLAALCTEAALQCIREKMDVIDLEDDSIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSSSGDAGGAADRVLNQLLTEMDGMNAKKTVFIIGATNRPDIIDPALLRPGRLDQLIYIPLPDEDSRHQIFKACLRKSPLSKDIDLRALAKYTQGFSGADITEICQRACKYAIRENIEKDIEKEKRRAENPDSMDEDADDEISEIKPAHFEESMKYARRSVSDADIRKYQAFAQTLQQSRGFGTEFRFSETSGGAAASDPFTTSNAGADDDDLYS

SEQ ID NO: 13461 - protein, 805 aa, Gossypium hirsutum
MSNQAESSDSKGTKKDFSTAILERKKAPNRLVVDEAINDDNSVVALHPDTMEKLQLFRGDTILIKGKKRKDTICIALADDACDEPKIRMNKVVRSNLRVRLGDVVSVHQCPDVKYGKRVHILPVDDTIEGVTGNLFDAYLKPYFLEAYRPVRKGDLFLVRGGMRSVEFKVIETDPPEYCVVAPDTEIFCEGEPVRREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSDDVDLERIAKDTHGYVGADLAALCTEAALQCIREKMDVIDLEDESIDAEILNSMAVSNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVAKEVDLRALAKYTQGFSGADITEICQRACKYAIRENIEKDIERERRRAENPEAMEEDVEDEVAEIKPAHFEESMKFARRSVSDADIRKYQAFAQTLQQSRGFGSEFRFAETGARPAASDPFAASAGGADEDDLYS

SEQ ID NO: 13462 - protein, 805 aa, Gossypium hirsutum
MSNQAESSDSKGAKKDFSTAILERKKAANRLVVDEAINDDNSVVSLHPDTMEKLQLFRGDTILIKGKKRKDTICIALADDTCDEPKIRMNKVVRSNLRVRLGDVVSVHQCPDVKYGKRVHILPVDDTIEGVTGNLFDAYLKPYFLEAYRPVRKGDLFLVRGGMRSVEFKVIETDPPEYCVVAPDTEIFCEGEPVKREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNTKLAEDVDLERISKETHGYVGADLAALCTEAALQCIREKMDVIDLEDETIDAEILNSMAVSNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPIAKEVDLRALARYTQGFSGADITEICQRACKYAIRENIEKDIERERRRSENPEAMEEDVEDEVAEIKPAHFEESMKFARRSVSDADIRKYQAFAQTLQQSRGFGSEFRFAETGSRTAASDPFAAAAGGADEDDLYS

SEQ ID NO: 13463 - protein, 399 aa, Manihot esculenta
MSHQAESSDSKSAKKDFSTAILERKKSPNRLIVDEAVNDDNSVVSMHSETMEKLQLFRGDTILIKGKKRKDTICIALADDTCEPPKIRMNKVVRSNLRVRLGDVVSVHQCPDVKYGKRVHILPIDDTIEGVTGNLFDAYLKPYFLEAYRPVRKGDLFLVRGGMRSVEFKVIETDPGEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDELDSIAPKREKTHGEVERRIVSQLLTLMDGLKSRAHVIVIGATNRPNSIDPALRRFGRFDREIDIGVPDEIGRLEVLRIHTKNMKLSDEAS

SEQ ID NO: 13464 - protein, 818 aa, Valeriana officinalis
MSNPPAPATQPESSDSKGTKRDFSTAILERKKAANRLVVDEAINDDNSVVSLHPETMEKLQLFRGDTILIKGKKRKDTICIALADDTCDEPKIRMNKVVRSNLRVRLGDVISVHQCPDVKYGKRVHILPIDDSVEGVSGNIFDAYLKPYFVEAYRPLRKGDLFLVRGGMRSVEFKVIETDPAEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLEKISKETHGYVGADLAALCTEAALQCIREKMDVIDLEDDSIDAEILNSMAVSNEHFSTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSHGDAGGAADRVLNQLLTEMDGMSAKKTVFIIGATNRPDIIDPALLRPGRLDQLIYIPLPDEESRLNIFKSCLRKSPVSKDVDLKALAKYTQGFSGADITEICQRACKYAIRENIEKDIEKEKRRSENPEAMEEDNIDDEVSEIKAAHFEESMKYARRSVSDADIRKYQAFAQTLQQSRGFGSEFRFPETSGGAGGGAADTADPFAASAGGAADEDDLYS

SEQ ID NO: 13465 - protein, 807 aa, Populus trichocarpa
MSNQAEAESSDSKGTKRDFSTAILERKKAPNRLVVDEAVNDDNSVVSLHPETMEKLQLFRGDTILIKGKKRKDTICIALADDSCDEPKIRMNKVVRSNLRVRLGDVVSVHQCPDVKYGKRVHILPIDDTIEGVTGNLFDAYLKPYFLEAYRPVRKGDLFLVRGGMRSVEFKVIETDPPEYCVVAPDTEIFCEGEPVLREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMRLAEDVDLERIAKDTHGYVGADLAALCTEAALQCIREKMDVIDLEDETIDAEILNSMAVTDEHFKTALGTSNPSALRETVVEVPNVSWEDIGGLETVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEESRFQIFKSCLRKSPVSKDVDLTALAKYTQGFSGADITEICQRACKYAIRENIEKDIERERRRSENPEAMEEDVEDEVSEIKASHFEESMKYARRSVSDADIRKYQAFAQTLQQSRGFGSEFRFAEASAGATGSDPFAASAGGADEDDLYS

SEQ ID NO: 13466 - protein, 530 aa, Flaveria ramosissima
MSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLADDVDLEKISKETHGYVGADLAALCTESALQCIREKMDVIDLEDESIDVEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSQGDAGGAADRVLNQLLTEMDGMSAKKTVFIIGATNRPDIIDPALLRPGRLDQLIYIPLPDEESRYQIFKSALRKSPVAKDVDLHALAKYTQGFSGADITEICQRACKYAIRENIEKDIEREKRRSENPEAMEEDVEDEVAEIKAAHFEESMKFARRSVSDADIRKYQAFAQTLQQSRGFGSEFRFSETSGAAAGAGGSDPFAASAGAADDDDLYN

SEQ ID NO: 13467 - protein, 808 aa, Ambrosia trifida
MSNQPESSDSKGTKRDFSTAILERKKAANRLVVDEAINDDNSVVALHPETMEKLQLFRGDTILIKGKKRKDTICIALADDTCEEPKIRMNKVVRANLRVRLGDVVSVHQCPDVKYGKRVHILPVDDTIEGVTGNLFDAYLKPYFLEAYRPVRKGDFFLVRGGMRSVEFKVIETDPAEYCVVAPDTEIFCEGEPIRREDEDRLDEIGYDDVGGVRKQMAQIRELVELPLRHPQLFKSIGVKPPKGILLYGPPGSGKTLIARAVANETGAFFFCINGPEIMSKMAGESESNLRKAFEEAEKNAPSIIFIDEIDSIAPKRDKTNGEVERRIVSQLLTLMDGLKSRAHVIVMGATNRPNSIDPALRRFGRFDREIDIGVPDEVGRLEVLRIHTKNMKLAEDVDLEKISKETHGYVGADLAALCTESALQCIREKMDVIDLEDESIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSQGDAGGAADRVLNQLLTEMDGMSAKKTVFIIGATNRPDIIDPALLRPGRLDQLIYIPLPDEESRYSIFKSALRKSPVAKDVDLHALAKYTQGFSGADITEICQRACKYAIRENIEKDIEREKRRSENPEAMEEDVEDDVPEIKAAHFEESMKFARRSVSDADIRKYQAFAQTLQQSRGFGSEFRFSETSSAAAGAGGSDPFAASAGAADDDDLYN

SEQ ID NO: 13468 - protein, 805 aa, Theobroma cacao
MSNQAESSDSKGTKRDFSTAILERKKAPNRLVVDEAINDDNSVVSLHPDTMEKLQLFRGDTILIKGKKRKDTICIALADDTCDEPKIRMNKVVRSNLRVRLGDVVSVHQCPDVKYGKRVHILPVDDTIEGVTGNLFDAYLKPYFLEAYRPVRKGDLFLVRGGMRSVEFKVIETDPPEYCVVAPDTEIFCEGEPVRREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERIAKDTHGYVGADLAALCTEAALQCIREKMDVIDLEDESIDAEILNSMAVSNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVAKEVDLRALAKYTQGFSGADITEICQRACKYAIRENIEKDIERERRRRDNPEAMEEDVEDDVAEIKPAHFEESMKFARRSVSDADIRKYQAFAQTLQQSRGFGSEFRFAETGSRAAASDPFAASAGGADEDDLYS

SEQ ID NO: 13469 - protein, 808 aa, Chelidonium majus
MSNQAESSDSKGTKRDFSTAILERKKAANRLVVDEAINDDNSVVSMNPETMEKLQLFRGDTILIKGKKRKDTICIALADDTCDEPKIRMNKVVRSNLRVRLGDVVSVHQCPDVKYGKRVHILPVDDTIEGVSGNLFDAYLKPYFLEAYRPVRKGDLFLVRGGMRSVEFKVIETDPAEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLSDDVDLERIAKDTHGYVGADLAALCTEAALQCIREKMDVIDLEDEEIDAEILNSMAVTDEHFKTALGTSNPSALRETVVEVPNCSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEASRHQIFKACLRKSPISKDVDLAALAKYTQGFSGADITEICQRACKYAIRENIEKDIERERRRSENPEAMEEDVEDEVAEIKAAHFEESMKYARRSVSDADIRKYQAFAQTLQQSRGFGSEFRFSEASTGAGTTGGSDPFAASAGGADEDDLYS

SEQ ID NO: 13470 - protein, 808 aa, Trigonella foenum-graecum
MANQPESSDAKGTKRDFSTAILERKKAPNRLVVDEAVNDDNSVVALHPETMEKLQLFRGDTILIKGKKRKDTICIALADETCEEPKIRMNKVVRNNLRVRLGDVVSVHQCADVKYGKRVHILPVDDTIEGVTGNLFDAYLKPYFLEAYRPVRKGDFFLVRGGMRSVEFKVIETDPHEYCVVAPDTEIFCEGEPIKREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLEKISKDTHGYVGADLAALCTEAALQCIREKMDVIDLEDETIDAEILNSMAVSNEHFATALGSSNPSALRETVVEVPNCSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPISKDVDIRALAKYTQGFSGADITEICQRACKYAIRENIEKDIEKERRRSENPEAMEEDVEDEVAEIKAAHFEESMKYARRSVSDADIRKYQAFAQTLQQSRGFGSEFRFADSSTSGAAAAGASDPFTSAAGADDDDLYN

SEQ ID NO: 13471 - protein, 805 aa, Gossypium hirsutum
MSNQAESSDSKGTKRDFSTAILERKKAPNRLVVDEAINDDNSVVSLHSDTMEKLQLFRGDTILIKGKKRKDTICIALADDTCDEPKIRMNKVVRSNLRVRLGDVVSVHQCPDVKYGKRVHILPVDDTIEGVTGNLFDAYLKPYFLEAYRPVRKGDLFLVRGGMRSVEFKVIETDPPEYCVVAPDTEIFCEGEPVRREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEEVDLERIAKDTHGYVGADLAALCTEAALQCIREKMDVIDLEDESIDAEILNSMAVSNDHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEESRHQIFKACLRKSPIAKDVDVRALAKYTQGFSGADITEICQRACKYAIRENIEKDIERERRRSENPEAMEEDVEDEVAEIKPAHFEESMKFARRSVSDADIRKYQAFAQTLQQSRGFGSEFRFAETGSRTAASDPFAASAGGADEDDLYS

SEQ ID NO: 13472 - protein, 804 aa, Cucumis sativus
MANQPESSDSKGTKRDFSTAILERKKAPNRLVVDEAINDDNSVVALHPDTMEKLQLFRGDTILIKGKKRKDTICIALADDTCDEPKIRMNKVVRSNLRVRLGDVVSVHQCADVKYGKRVHILPVDDTIEGVTGNLFDAYLKPYFLEAYRPLRKGDLFLVRGGMRSVEFKVIETDPAEYCVVAPDTEIFCDGEPVKREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVIGATNRPNSIDPALRRFGRFDREIDIGVPDEVGRLEVLRIHTKNMKLAEEVDLERIAKDTHGYVGADLAALCTEAALQCIREKMDVIDLEDDSIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEESRLQIFKACLRKSPISKDVELRALAKYTQGFSGADITEICQRACKYAIRENIEKDIEKERRKSENPEAMEEDADDEVAEIRAAHFEESMKYARRSVSDADIRKYQAFAQTLQQSRGFGAEFRFEQSSAPAASDPFATSAGGGDEDDLYN

SEQ ID NO: 13473 - protein, 805 aa, Capsicum annuum
MTNQAESSDSKGAKKDFSTAILERKKAANRLVVDEAVNDDNSVVALHPATMEKLQLFRGDTILIKGKKRKDTVVIALADETCDEPKIRMNKVVRSNLRVRLGDVVSVHQCPDVKYGKRVHILPIDDTIEGLTGDLFDAFLKPYFLEAYRPLRKGDNFLVRGGMRSVEFKVIETDPGEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEEVDLERISKDTHGYVGADLAALCTEAALQCIREKMDVIDLEDDTIDAEVLNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSSGDAGGAADRVLNQLLTEMDGMNAKKTVFIIGATNRPDIIDPALLRPGRLDQLIYIPLPDEDSRHQIFKACLRKSPLSKDIDLRALAKHTQGFSGADVTEICQRACKYAIRENIEKDIEREKRRQENPDSMDEDVDEVPEIKPAHFEESMKYARRSVSDADIRKYQAFAQTLQQSRGFGTEFRFADTSGGATAAADPFATSNAAADDDDLYS

SEQ ID NO: 13474 - protein, 471 aa, Arachis hypogaea
MDGLKSRAHVIVIGATNRPNSIDPALRRFGRFDREIDIGVPDEVGRLEVLRIHTKNMKLSDEVDLERISKDTHGYVGADLAALCTEAALQCIREKMDVIDLEDETIDAEVLNSMAVTNEHFQTALGTSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEESRYQIFKACMRKSPVSKDVDLSALAKYTQGFSGADITEICQRACKYAIRENIEKDLERERKRRDNPEAMDEDVDDEVAEIKAGHFEESMKYARRSVSDADIRKYQAFAQTLQQSRGFGTEFRFPETGSRTTGSADPFATSAGGADEDDLYS

SEQ ID NO: 13475 - protein, 805 aa, Gossypium hirsutum
MSNQAESSDSKGTKRDFSTAILERKKAPNRLVVDEAINDDNSVVSMHPDTMEKLQLFRGDTILIKGKKRKDTICIALADDTCDEPKIRMNKVVRSNLRVRLGDVVSVHQCPDVKYGKRVHILPVDDTIEGVTGSLFDAYLKPYFLEAYRPVRKGDFFLARGGMRSVEFKVIETDPPEYCVVAPDTEIFCEGEPVKREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVIGATNRPNSIDPALRRFGRFDREIDIGVPDEVGRLEVLRIHTKNMKLAEDVDLEKISKETHGYVGADLAALCTEAALQCIREKMDVIDLEDDSIDAEILNSMAVTNEHFATALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGVADRVLNQLLTEMDGMSAKKTVFIIGATNRPDIIDPALLRPGRLDQLIYIPLPDEDSRHQIFKACLRKSPLAKEVDLRALAKYTQGFSGADITEICQRASKYAIREDIEKDIERERRRRENPEAMEEDVDDEVAEIKPAHFEESMKFARRSVSDADIRKYQAFAQTLQQSRGFGSEFKFAETGSRAATSDPFATTAGGADEDDLYS

SEQ ID NO: 13476 - protein, 806 aa, Plantago ovata
MSHQAESSDSKGVKKDFSTAILEKKKAPNRLVVEDAVNDDNSVVALHPATMEKLQLFRGDTILIKGKKRKDTVCIALADESCEEPKIRMNKVIRTNLRVRLGDVVSVHQCPDVKYGKRVHILPLDDTIEGLTGDLFDAYLKPYFLEAYRPVRKGDHFLVRGGMRSVEFKVIETEPGEYCVVAPDTEIFCEGEPVRREDEDRLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLSEDVDLERISKDTHGYVGADLAALCTEAALQCIREKMDVIDLEDDEIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEDSRHQIFKACLRKSPLHKDVDIRALAKFTQGFSGADITEICQRACKYAIRENIEKDIERERRSKDNPDSMEEDEVDEVSEIKPAHFEESMKYARRSVSDADIRKYQAFAQTLQQSRGFGTEFRFTESTAAATTGSDPFAASAGGADEDDLYS

SEQ ID NO: 13477 - protein, 807 aa, Silene vulgaris
MAGDHAESSDSKGAKKDFSTAILERKKAANRLVVDEAVNDDNSVVSMHPDTMEKLQIFRGDTILVKGKKRKDTICIALADETCEEPKIRMNKVVRLNLRVRLGDVVSVHQCPDVKYGKRVHILPVDDTVEGVTGNLFDAYLKPYFLEAYRPVRKGDMFLVRGGMRSVEFKVIETDPAEYCVVAPDTEIFCEGEPVKREDEDRLDEIGYDDVGGVRKQMAQIRELVELPLRHPQLFKSIGVKPPKGILLYGPPGSGKTLIARAVANETGAFFFCINGPEIMSKMAGESESNLRKAFEEAEKNAPSIIFIDELDSIAPKREKTNGEVERRIVSQLLTLMDGLKSRAHVIVMGATNRPNSIDPALRRFGRFDREIDIGVPDEVGRLEVLRIHTKNMKLSEDVDLEKISKETHGYVGADLAALCTEAALQCIREKMDVIDLEDDTIDAEILNSMAVTNEHFETALGQSNPSALRETVVEVPNVSWADIGGLENVKRELQETVQYPVEHPEKFEKFGMSPSKGVLFYGPPGCGKTLLAKAIANECQANFISVKGPELLTMWFGESEANVREIFDKARQAAPCVLFFDELDSIATQRGSSSGDGGGAADRVLNQLLTEMDGMSAKKTVFIIGATNRPDIIDPALLRPGRLDQLIYIPLPDDESRLQIFKAALRKSPIAKDVDLKALANYTQGFSGADITEICQRACKYAIRENIEKDIEKERRRSENPEAMEEDVEDEVAEIKAAHFEESMKYARRSVSDADIRKYQAFAQTLQQSRGFGSEFRFASTPAGGTTTSDAFATAAGAADEDDLYN

SEQ ID NO: 13478 - protein, 807 aa, Silene vulgaris
MADKPESSDSKGTKKDFSTAILERKKAANRLVVDEAVNDDNSVVSLHPDTMEKLQIFRGDTILIKGKKRKDTICIALADDTCDEPKIRMNKVVRSNLRVRLGDVVSVHQCPDVKYGKRVHILPVDDTVEGVTGNLFDAYLKPYFLEAYRPVRKGDLFLVRGGMRSVEFKVIETDPAEFCVVAPDTEIFCEGEPVKREDENRLDEVGYDDVGGVRKQMAQIRELVELPLRHPQLFKSIGVKPPKGILLFGPPGSGKTLIARAVANETGAFFFCINGPEIMSKMAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLSEDVDMEKISKETHGYVGADLAALCTEAALQCIREKMDVIDLEDDTIDAEILNSMAVTNEHFQTALGQSNPSALRETVVEVPNVSWADIGGLENVKRELQETVQYPVEHPEKFEKFGMSPSKGVLFYGPPGCGKTLLAKAIANECQANFISVKGPELLTMWFGESEANVRELFDKARQAAPCVLFFDELDSIATQRGSSVGDAGGAADRVLNQLLTEMDGMSAKKTVFIIGATNRPDIIDPALLRPGRLDQLIYIPLPDDESRLQIFKAALRKSPIAKDVDLSALAKYTQGFSGADITEICQRACKYAIRENIEKDIERERRRSENPEAMEEDVEDEVAEIKAAHFEESMKYARRSVSDADIRKYQAFAQTLQQSRGFGSEFRFSSNTTAGGTTTSDAFAASAGAADEDDLYN

SEQ ID NO: 13479 - protein, 806 aa, Castanea mollissima
MASQPESSDSKGTKRDFSTAILERKKAPNRLVVDEAINDDNSVVALHPDTMEKLQLFRGDTILIKGKKRKDTICIALADDTCDEPKIRMNKVIRSNLRVRLGDVVSVHQCADVKYGKRVHILPVDDTIEGVTGNLFDAYLKPYFLEAYRPVRKGDLFLVRGGMRSVEFKVIETDPPEYCVVAPDTEIFCEGEPVRREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSEDVDLERIAKDTHGYVGADLAALCTEAALQCIREKMDVIDLEDETIDAEILNSMAVSNEHFQTALGTSNPSALRETVVEVPNCSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPISKDVDLRALAKYTQGFSGADITEICQRACKYAIRENIEKDIERERRRRDNPEAMEEDVEDEVAEIKAAHFEESMKYARRSVSDADIRKYQAFAQTLQQSRGFGSEFRFADNTTSGATASDPFATAAAGADEDDLYN

SEQ ID NO: 13480 - protein, 807 aa, Fragaria vesca
MTDKAESSDPKGTKRDFSTAILERKKAANRLVVDEAINDDNSVVALHPETMEKLQLFRGDTILIKGKKRKDTICIALADDTCDEPKIRMNKVVRSNLRVRLGDVVSVHQCADVKYGKRVHILPVDDTIEGVTGSLFDAYLKPYFLEAYRPVRKGDLFLVRGGMRSVEFKVIETDPSEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLEKIGKETHGYVGADLAALCTEAALQCIREKMDVIDLEDEEIDAEILNSMAVTNEHFSTALGTSNPSALRETVVEVPNVSWDAIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEESRLQIFKAALRKSPVAKDVDLNALAKYTQGFSGADITEICQRACKYAIRENIEKDIERERRRSENPEAMEEDVEDEVPEIRAAHFEESMKFARRSVSDADIRKYQAFAQTLQQSRGFGTEFRFPETGSAAATTGSDPFATSSAGADEDDLYN

SEQ ID NO: 13481 - protein, 807 aa, Eucalyptus grandis
MASQAESSDPKGTKRDFSTAILERKKAANRLVVDEAVNDDNSVVALHPETMEKLQLFRGDTILVKGKKRKDTVCIALADDTCDEPKIRMNKVVRQNLRVRLGDVVSVHQCPDVKYGKRVHILPVDDTIEGITGSLFDAFLKPYFLEAYRPVRKGDLFLVRGGMRSVEFKVIETDPGEYCVVAPDTEIFCEGEPVRREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERIAKDTHGYVGADLAALCTEAALQCIREKMDVIDLEDETIDAEILNSMAVTNEHFHTALGTSNPSALRETVVEVPNVSWQDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRSCKYAIRENIEKDIERERRRSENPEAMEEDVEDEVAEIKAAHFEESMKYARRSVSDADIRKYQAFAQTLQQSRGFGSEFRFADAGAGAGTAGSDPFAASAGGADDDDLYS

SEQ ID NO: 13482 - protein, 810 aa, Arabidopsis lyrata
MANQAESSDSKGTKRDFSTAILERKKAANRLVVDEAINDDNSVVSLHPETMEKLQLFRGDTVLIKGKKRKDTVCIALADDTCDEPKIRMNKVVRSNLRVRLGDVISVHQCPDVKYGKRVHILPIDDTIEGVSGNIFDAYLKPYFLEAYRPVRKGDLFLVRGGMRSIEFKVIETDPAEYCVVAPDTEIFCEGEPIKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDELDSIAPKREKTHGEVERRIVSQLLTLMDGLKSRAHVIVMGATNRPNSIDPALRRFGRFDREIDIGVPDEIGRLEVLRIHTKNMKLAEDVDLERVSKDTHGYVGADLAALCTEAALQCIREKMDVIDLDDEEIDAEILNSMAVTNDHFQTALGNSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGNSVGDAGGAADRVLNQLLTEMDGMNAKKTVFIIGATNRPDIIDPALLRPGRLDQLIYIPLPDEESRYQIFKSCLRKSPVAKDVDLRALAKYTQGFSGADITEICQRSCKYAIRENIEKDIEKERKRAESPEAMEEDEEEIAEIKAGHFEESMKYARRSVSDADIRKYQAFAQTLQQSRGFGSEFRFPDAPTGTGAAATVGGVDPFATSGGAADDDDLYS

SEQ ID NO: 13483 - protein, 530 aa, Arnica chamissonis
MSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVDLEKISKETHGYVGADLAALCTESALQCIREKMDVIDLEDETIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSQGDAGGAADRVLNQLLTEMDGMSAKKTVFIIGATNRPDIIDPALLRPGRLDQLIYIPLPDEESRYSIFKSALRKSPVAKDVDLHALAKYTQGFSGADITEICQRACKYAIRENIEKDIEREKRRSENPEAMEEDADDEVAEIKAAHFEESMKFARRSVSDADIRKYQAFAQTLQQSRGFGSEFKFAETGGAAAGAGGSDPFAASAGAADEDDLYN

SEQ ID NO: 13484 - protein, 807 aa, Eucalyptus grandis
MASQAESSDPKGTKRDFSTAILERKKAANRLVVDEAVNDDNSVVSLHPETMEKLQLFRGDTILVKGKKRKDTVCIALADDTCDEPKIRMNKVVRQNLRVRLGDVVSVHQCPDVKYGKRVHILPVDDTIEGITGNLFDAFLKPYFLEAYRPVRKGDLFLVRGGMRSVEFKVIETEPAEYCVVAPDTEIFCEGEPVRREDENRLDEVGYDDVGGVRKQMAQIRELVELPLRHPQLFKSIGVKPPKGILLFGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERIAKDTHGYVGADLAALCTEAALQCIREKMDVIDLEDETIDAEILNSMAVTNEHFQTALGTSNPSALRETVVEVPNVSWQDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRRRDNPEAMEEDVEDEVAEIKAAHFEESMKYARRSVSDADIRKYQAFAQTLQQSRGFGSEFRFADASAGAGAAGSDPFAASAGGADDDDLYS

SEQ ID NO: 13485 - protein, 808 aa, Plantago ovata
MSNQPESSDSKGTKRDFSTAILERKKAPNRLVVDEAVNDDNSVVALHPDTMEKLQLFRGDTILIKGKKRKDTVCIALADETCDEPKIRMNKVVRTNLRVRLGDVVSVHQCADVKYGKRVHILPVDDTIEGLTGNLFDSYLKPYFLEAYRPVRKGDMFLVRGGMRSVEFKVIETDPAEYCVVAPDTEIFCEGEPVRREDEDRLDEIGYDDVGGVRKQMAQIRELVELPLRHPQLFKSIGVKPPKGILLYGPPGSGKTLIARAVANETGAFFFCINGPEIMSKMAGESESNLRKAFEEAEKNAPSIIFIDEIDSIAPKRDKTNGEVERRIVSQLLTLMDGLKARAHIIVMGATNRPNSIDPALRRFGRFDREIDIGVPDEVGRLEVLRIHTKNMKLAEDVDLEKIGKETHGYVGADLAALCTEAALQCIREKMDVIDLEDDSIDAEILNSMAVSNEHFQTALGTSNPSALRETVVEVPNVSWQDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEDSRHQIFKACLRKSPLSKDIDLRALAKYTQGFSGADITEICQRACKYAIRENIEKDIERERRRSDNPEAMEEDVEDEVAEITAAHFEESMKYARRSVSDADIRKYQAFAQTLQQSRGFGSEFRFAENSTSGAAAAASDPFASAAGAADEDDLYN

SEQ ID NO: 13486 - protein, 810 aa, Eutrema parvulum
MANQAESSDSKGTKRDFSTAILERKKAANRLVVDEAINDDNSVVSLHPETMEKLQLFRGDTVLIKGKKRKDTVCIALADDTCDEPKIRMNKVVRSNLRVRLGDVISVHQCPDVKYGKRVHILPIDDTIEGVSGNIFDAYLKPYFLEAYRPVRKGDLFLVRGGMRSIEFKVIETDPAEYCVVAPDTEIFCEGEPIKREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDELDSIAPKREKTHGEVERRIVSQLLTLMDGLKSRAHVIVMGATNRPNSIDPALRRFGRFDREIDIGVPDEIGRLEVLRIHTKNMKLAEDVDLERVSKDTHGYVGADLAALCTEAALQCIREKMDVIDLEDEEIDAEILNSMAVTNEHFQTALGNSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGNSVGDAGGAADRVLNQLLTEMDGMSAKKTVFIIGATNRPDIIDPALLRPGRLDQLIYIPLPDEESRFQIFKSCLRKSPVAKDVDLRALAKYTQGFSGADITEICQRSCKYAIRENIEKDIEKERKRTETPEAMEEDEEEIAEIKAGHFEESMKYARRSVSDADIRKYQAFAQTLQQSRGFGSEFRFPEATGTGTAATAAGGADPFATAGGAAEDDDLYS

SEQ ID NO: 13487 - protein, 810 aa, Trigonella foenum-graecum
MANQPESSDSKGTKRDFSTAILERKKAPNRLVVDEAVNDDNSVVALHPETMEKLQLFRGDTILIKGKKRKDTICIALADETCEEPKIRMNKVVRNNLRVRLGDVVSVHQCPDVKYGKRVHILPVDDTIEGVTGNLFDAYLKPYFLEAYRPVRKGDMFLVRGGMRSVEFKVIECDPAEYCVVAPDTEIFCEGEPVKREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVIGATNRPNSIDPALRRFGRFDREIDIGVPDEVGRLEVLRIHTKNMKLAEDVDLEKIAKETHGYVGADLAALCTEAALQCIREKMDVIDLEDETIDAEILNSMAVTNEHFQTALGSSNPSALRETVVEVPNCSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEDSRHQIFKAALRKSPIAKDVDIRALAKYTQGFSGADITEICQRACKYAIRENIEKDIERERRRSDNPEAMEEDNEDDEVAEIKAAHFEESMKYARRSVSDADIRKYQAFAQTLQQSRGFGSEFRFADTSAGGTTAAAADPFAVASAGGADEDDLYS

SEQ ID NO: 13488 - protein, 806 aa, Tripterygium wilfordii
MANQAESSDSKGTKRDFSTAILERKKAANRLVVDEAVNDDNSVVALHPDTMEKLQLFRGDTILIKGKKRKDTICIALADDTCDEPKIRMNKVVRSNLRVRLGDVVSVHQCPDVKYGKRVHILPVDDTIEGVTGNLFDAYLKPYFLEAYRPVRKGDLFLVRGGMRSVEFKVIETDPPEYCVVAPDTEIFCEGEPVRREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLERISKDTHGYVGADLAALCTEAALQCIREKMDVIDLEDETIDAEILNSMAVSNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEESRLQIFKSCLRKSPVSKDVDLRALAKYTNGFSGADLTEICQRACKYAIRENIEKDIERERRRSDNPEAMEEDVEDEVAEIKAAHFEESMKYARRSVSDADIRKYQAFAQTLQQSRGFGTEFRFADASSGGAAASDPFAASAGGADEDDLYS

SEQ ID NO: 13489 - protein, 804 aa, Vinca minor
MSNPAESSDSKGKKDFSTAILERKKAPNRLIVDEAVNDDNSVVALHPATMEKLKLFRGDTILIKGKKRKDTVCIALADETCEEPKIRMNKVVRSNLRVRLADVVSVHQCPDVKYGTRIHVLPLDDTIEGVTGDLFDAYLKPYFLEAYRPVRKGDHFLVRGGMRSVEFKVIETDPGEYCVVAPDTEIFCEGEPVKREDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVIGATNRPNSIDPALRRFGRFDREIDIGVPDEVGRLEVLRIHTKNMKLSEDVDLERIAKDTHGYVGADLAALCTEAALQCIREKMDVIDLEDDSIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSSGGDAGGAADRVLNQLLTEMDGMSAKKTVFIIGATNRPDIIDPALLRPGRLDQLIYIPLPDEDSRHQIFKACLRKSPISKDVDLRALAKYTQGFSGADITEICQRACKYAIRENIEKDIEKERRRKDNPDSMDEDVEEEVAEIKAGHFEESMKYARRSVSDADIRKYQAFAQTLQQSRGFGSEFRFADSATGASGSDPFATPAGAGDEDDLYN

SEQ ID NO: 13490 - protein, 399 aa, Manihot esculenta
MADQAGSSDSKSGKKDFSTAILERKKSPNRLVVDEAVNDDNSVVSMHPDTMEKLQLFRGDTILIKGKKRKDTICIALADDTCEPPKIRMNKVVRSNLRVRLGDVVSVHQCPDVKYGKRVHILPIDDTIEGVTGSLFDAYLKPYFLEAYRPVRKGDLFLVRGGMRSVEFKVIETDPAEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSDEAS

SEQ ID NO: 13491 - protein, 803 aa, Cannabis sativa
MTDKAESSETKKDFSTAILERKKSPNRLVVDEAINDDNSVVSIHPNTMEKLQLFRGDTILIKGKKRKDTVCIALADDTCEEAKIRMNKVVRSNLRVRLGDVVSVHQCPDVKYGKRVHILPVDDTIEGVTGNLFDAFLKPYFLEAYRPVRKGDLFLVRGGMRSVEFKVIETEPGEYCVVSPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEIGRLEVLRIHTKNMKLSDDVDLERISKETHGYVGADLAALCTEAALQCIREKMDVIDLEDETIDAEILNSMAVTNEHFQTALGTSNPSALRETVVEVPNVSWDDVGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEDSRHQIFKANLRKSPISKDVDLRALAKYTQGFSGADITEICQRACKYAIRENIEKDIEKERRRKDNPEAMDEDMEEDEVSEIKAAHFEESMKYARRSVSDADIRKYQAFAQTLQQSRGFGTEFRFAESATGGSGSDPFAASAGAAEEDDLYS

SEQ ID NO: 13492 - protein, 806 aa, Euonymus alatus
MSNQAESSDSKGTKRDFSTAILERKKAANRLVVDEAVNDDNSVVALHPDTMEKLQLFRGDTILIKGKKRKDTICIALADDTCDEPKIRMNKVVRSNLRVRLGDVVSVHQCPDVKYGKRVHILPVDDTIEGVTGNLFDAYLKPYFLEAYRPVRKGDLFLVRGGMRSVEFKVIETDPPEYCVVAPDTEIFCEGEPVRREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVDLERIAKDTHGYVGADLAALCTEAALQCIREKMDVIDLEDETIDAEILNSMAVSNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEESRFQIFKSCLRKSPVAKEVDLRALAKYTNGFSGADITEICQRSCKYAIRENIEKDIERERRRRDNPEAMEEDVEDEVSEIKAAHFEESMKYARRSVSDADIRKYQAFAQTLQQSRGFGTEFRFAEASTGGAAASDPFAASAGGADEDDLYS

SEQ ID NO: 13493 - protein, 807 aa, Citrus sinensis
MSHPAESSDANSGKKDYSTAILERKKSPNRLVVDEAINDDNSVVGLHPDTMDKLQIFRGDTILIKGKKRKDTICIALADDTCEQPKIRMNKVVRSNLRVRLGDVVSVHQCPDVKYGKRVHILPIDDTIEGVTGNLFDAFLRPYFTEAYRPVRKGDLFLVRGGMRSVEFKVIETDPGEYCVVAPDTEIFCEGEPIKREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSDDVDLERIAKDTHGYVGADLAALCTEAALQCIREKMDVIDLEDETIDAEILNSMAVSNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRRRDNPEAMDEDAAEDEVSEIKAAHFEESMKFARRSVSDADIRKYQAFAQTLQQSRGIGSEFRFAEAGTGATTGADPFSTSAGGADDDDLYS

SEQ ID NO: 13494 - protein, 805 aa, Solanum phureja
MSHQAESSDSKNAKKDFSTAILERKKAANRLIVDETVNDDNSVVALHPATMEKLQLFRGDTILIKGKKRKDTVVIALADETCDEPKIRMNKVVRSNLRVRLGDVVSVHQCPDVKYGKRVHILPIDDTIEGLTGDLFDAFLKPYFLEAYRPLRKGDNFLVRGGMRSVEFKVIETDPGEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEEVDLERIGKDTHGYVGADLAALCTEAALQCIREKMDVIDLEDDTIDAEVLNSMAVTNEHFQTALGTSNPSALRETVVEVPNVSWQDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSSSGDAGGAADRVLNQLLTEMDGMNAKKTVFIIGATNRPDIIDPALLRPGRLDQLIYIPLPDEDSRHQIFKACLRKSPLSKDIDLRALAKHTQGFSGADITEICQRACKYAIRENIEKDIEREKRRQENPDSMDEDVDEVPEIKPAHFEESMKYARRSVSDADIRKYQAFAQTLQQSRGFGTEFRFAEASSGGTAAADPFATSNAAADDDDLYS

SEQ ID NO: 13495 - protein, 805 aa, Solanum lycopersicum
MSHQAESSDSKNSKKDFSTAILERKKAANRLIVDETVNDDNSVVALHPATMEKLQLFRGDTILIKGKKRKDTVVIALADETCDEPKIRMNKVVRSNLRVRLGDVVSVHQCPDVKYGKRVHILPIDDTIEGLTGDLFDAFLKPYFLEAYRPLRKGDNFLVRGGMRSVEFKVIETDPGEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEEVDLERIGKDTHGYVGADLAALCTEAALQCIREKMDVIDLEDDTIDAEVLNSMAVTNEHFQTALGTSNPSALRETVVEVPNVSWQDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSSGDAGGAADRVLNQLLTEMDGMNAKKTVFIIGATNRPDIIDPALLRPGRLDQLIYIPLPDEDSRHQIFKACLRKSPLSKDIDLRALAKHTQGFSGADITEICQRSCKYAIRENIEKDIEREKRRQENPDSMDEDVDEVPEIKPAHFEESMKYARRSVSDADIRKYQAFAQTLQQSRGFGTEFRFAETSSGGTAAADPFATSNAAADDDDLYS

SEQ ID NO: 13496 - protein, 808 aa, Phalaenopsis aphrodite
MANQGEGSSDPKSVKKDFSTAILERKKSPNRLVVDEAINDDNSVVSMHPETMEKLQLFRGDTILLKGKKRKDTICIALADDTCEEPKIRMNKVVRSNLRVRLGDVVSVHQCQDVKYGKRVHILPIDDTIEGVTGNLFDAYLKPYFLEAYRPVRKGDLFLVRGGMRSVEFKIIETDPPEYCVVAPDTEIYCEGEPVKREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEIGRLEVLRIHTKNMKLSDDVDLERIAKDTHGYVGADLAALCTEAALQCIREKMDVIDLEDESIDAEVLNSMAVTNEHFKTALGSSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEASRHQIFKACLRKSPVSKDVDLWALAKYTQGFSGADITEICQRAVKYAIRENIEKDIERERRARENPEAMEEDEGDEVAEIKAVHFEESMKYARRSVSDADIRKYQAFAQTLQQSRGFGSEFRFADHSDAAAGAGSDPFAASGAAGDDDDLYS

SEQ ID NO: 13497 - protein, 256 aa, Gossypium hirsutum
MSNQAESSDSKGTKRDFSTAILERKKAPNRLVVDEAINDDNSVVSMHPDTMEKLQLFRGDTILIKGKKRKDTICIALADDTCDEPKIRMNKVVRSNLRVRLGDVVSVHQCSDVKYGKRVHILPVDDTIEGVTGNLFDAYLKPYFLEAYRPVRKGDFFLARGGMRSVEFKVIETDPPEYCVVAPDTEIFCEGEPVKREDENRLDEVGYDDVGGVRKQMAQIRELVELPLRHPQLFKSIGVKPPKEFCFTDLLDQERL

SEQ ID NO: 13498 - protein, 815 aa, Arabidopsis thaliana
MANQAESSDSKGTKKDFSTAILEKKKAANRLVVDEAINDDNSVVSLHPDTMEKLQLFRGDTILIKGKKRKDTVCIALADETCDEPKIRMNKVVRSNLRVRLGDVISVHQCPDVKYGNRVHILPLDDTIEGVSGNIFDAYLKPYFLEAYRPVRKGDLFLVRGGMRSIEFKVIETDPAEYCVVAPDTEIFCEGEPIKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEIGRLEVLRIHTKNMKLAEDVDLERVSKDTHGYVGADLAALCTEAALQCIREKMDVIDLDDEEIDAEILNSMAVSNDHFQTALGNSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGNSVGDAGGAADRVLNQLLTEMDGMNAKKTVFIIGATNRPDIIDPALLRPGRLDQLIYIPLPDEESRYQIFKSCLRKSPVAKDVDLRALAKYTQGFSGADITEICQRSCKYAIRENIEKDIEKERKRAESPEAMEEDEEEIAEIKAGHFEESMKYARRSVSDADIRKYQAFAQTLQQSRGFGSEFRFPDAPTGTTGAFPGAAATVGGVDPFATSGGAADDDDLYS

SEQ ID NO: 13499 - protein, 804 aa, Theobroma cacao
MSHSAESSDSKSGKKDFSTAILERKKSPNRLVVDETVNDDNSVVSMHPDTMEKLQLFRGDTILIKGKKRKDTICIALADETCETAKIRMNKVVRSNLRVRLGDVVSVHQCPDVKYGKRVHILPIDDTIEGVTGNLFDAYLKPYFLEAYRPVRKGDLFLVRGGMRSVEFKVIETDPGEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNTIDPALRRFGRFDREIDIGVPDEVGRLEVLRIHTKNMKLSDDVDLERISKDTHGYVGADLAALCTEAALQCIREKMDVIDLEDESIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEESRHQIFKACLRKSPISKDVDLRALARYTQGFSGADITEICQRACKYAIRENIEKDIERERRRSENPEAMDEDVEEDVAEINAAHFEESMKFARRSVSDADIRKYQAFAQTLQQSRGFGSEFRFSETGTTAAPDPFSTSAAGADEDDLYS

SEQ ID NO: 13500 - protein, 807 aa, Glycine max
MSQQGESSDPKSGKKDFSTAILERKKSPNRLVVDEAVNDDNSVVTMHPQTMEKLQLFRGDTILIKGKKRKDTICIALADENCEEPKIRMNKVVRSNLRVRLGDVVSVHQCPDVKYGKRVHILPIDDTIEGVTGNLFDAFLKPYFLEAYRPVRKGDLFLVRGGMRSVEFKVIETDPGEYCVVAPDTEIFCEGEPLKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSDDVDLERIAKDTHGYVGADLAALCTEAALQCIREKMDVIDLEDETIDAEVLNSMAVTNEHFQTALGTSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVAKNVDLRTLARHTQGFSGADITEICQRACKYAIRENIEKDIERERKSKENPEAMDEDTVDDEVAEIKAAHFEESMKFARRSVSDADIRKYQAFAQTLQQSRGFGSEFRFPESGDRTTTGSDPFATSAGGADEDDLYS

SEQ ID NO: 13501 - protein, 808 aa, Glycine max
MADQPESSDAKGTKRDFSTAILERKKALNRLVVDEAVNDDNSVVALHPDTMEKLQLFRGDTILIKGKKRKDTVCIALADETCEEPKIRMNKVVRNNLRVRLGDVVSVHQCPDVKYGKRVHILPVDDTIEGVTGNLFDAYLKPYFLEAYRPVRKGDLFLVRGGMRSVEFKVIETDPSEYCVVAPDTEIFCEGEPVKREDENRLDEVGYDDVGGVRKQMAQIRELVELPLRHPQLFKSIGVKPPKGILLYGPPGSGKTLIARAVANETGAFFFCINGPEIMSKLAGESESNLRRAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERISKDTHGYVGADLAALCTEAALQCIREKMDVIDLEDETIDAEILNSMAVTNEHFQTALGSSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRKRDNPEAMEEDDVEDEIAEIKAAHFEESMKYARRSVSDADIRKYQAFAQTLQQSRGFGSEFRFADSTSSGGAATASDPFASAGGADEDDLYS

SEQ ID NO: 13502 - protein, 804 aa, Malus domestica
MAHPAESSDSKKKDFSTAILERKKSPNRLVVDEALNDDNSVVSMHPETMEKLQLFRGDTILIKGKKRKDTICIALADDTCEEPRIRMNKVVRSNLRVRLGDVVSVHQCPDVKYGKRVHILPIDDSIEGVTGNLFDAFLKPYFLEAYRPVRKGDLFLVRGGMRSVEFKVIETDPGEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDAALRRFGRFDREIDIGVPDEVGRLEVLRIHTKNMKLSDDVDLERISKDTHGYVGADLAALCTEAALQCIREKMDVIDLEDESIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARSSAPCVLFFDELDSIATQRGSSSGDAGGAADRVLNQLLTEMDGMSAKKTVFIIGATNRPDIIDPALLRPGRLDQLIYIPLPDEESRFQIFKSCLRKSPVSKDVDLRALARYTQGFSGADITEICQRSCKYAIRENIEKDIERERRRAENPDSMDEDIDDEVAEIKAAHFEESMKYARRSVSDADIRKYQAFAQTLQQSRGFGTEFKFTENTQTGTTGSDAFATSAGAADEDDLYG

SEQ ID NO: 13503 - protein, 807 aa, Citrus clementina
MSHPAESSDANSGKKDYSTAILERKKSPNRLVVDEAINDDNSVVGLHPDTMDKLQIFRGDTILIKGKKRKDTICIALADDTCEQPKIRMNKVVRSNLRVRLGDVVSVHQCPDVKYGKRVHILPIDDTIEGVTGNLFDAFLRPYFTEAYRPVRKGDLFLVRGGMRSVEFKVIETDPGEYCVVAPDTEIFCEGEPIKREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSDDVDLERIAKDTHGYVGADLAALCTEAALQCIREKMDVIDLEDETIDAEILNSMAVSNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPISKDVDLRALAKYTQGFSGADITEICQRACKYAIRENIEKDIERERRRRDNPEAMDEDAAEDEVAEIKAAHFEESMKFARRSVSDADIRKYQAFAQTLQQSRGIGSEFRFAEAGTGATTGADPFSTSAGGADDDDLYS

SEQ ID NO: 13504 - protein, 801 aa, Euonymus alatus
MSNQAESSDSKGTKRDFSTAILERKKAANRLVVDEAVNDDNSVVALHPDTMEKLQLFRGDTILIKGKKRKDTICIALADDTCDEPKIRMNKVVRSNLRVRLGDVVSVHQCPDVKYGKRVHILPVDDTIEGVTGNLFDAYLKPYFLEAYRPVRKGDLFLVRGGMRSVEFKVIETDPPEYCVVAPDTEIFCEGEPVRREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLERISKDTHGYVGADLAALCTEAALQCIREKMDVIDLEDETIDAEILNSMAVSNEHFHTALGTSNPSALRETVVEVPNVNWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSSVGDAGGAGDRVLNQLLTEMDGMSAKKTVFIIGATNRPDIIDPALLRPGRLDQLIYIPLPDEESRLQIFKSCLRKSPVSKDVDLRALAKYTNGFSGADITEICQRACKYAIREDIEKDIEREKGDNPEAMEEDEVPEIKAAHFEESMKYARRSVSDADIRKYQAFAQTLQQSRGFGTEFRFADASTGGAATSDPFAASAGVADEDDLYS

SEQ ID NO: 13505 - protein, 808 aa, Glycine max
MASQPESSDAKGTKRDFSTAILERKKAPNRLVVDEAVNDDNSVVALHPDTMEKLQLFRGDTILIKGKKRKDTICIALADETCEEPKIRMNKVVRNNLRVRLGDVVSVHQCPDVKYGKRVHILPVDDTIEGVTGNLFDAYLKPYFLEAYRPVRKGDLFLVRGGMRSVEFKVIETDPSEYCVVAPDTEIFCEGEPVKREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLEKIAKDTHGYVGADLAALCTEAALQCIREKMDVIDLEDETIDAEILNSMAVTNEHFQTALGSSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRKRDNPEAMEEDDVEDEIAEIKAAHFEESMKYARRSVSDADIRKYQAFAQTLQQSRGFGSEFRFADSTSAGGTAAASDPFSSAGGADEDDLYN

SEQ ID NO: 13506 - protein, 807 aa, Valeriana officinalis
MADQPESSDSKGGKRDFSTAILERKKAANRLVVDEAINDDNSVVALHPETMEKLQLFRGDTILIKGKKRKDTICIALADDTCDEPKIRMNKVVRSNLRVRLGDVVSVHQCADVKYGKRVHILPIDDTIEGVSGNLFDAYVKPYFLEAYRPVRKGDFFLVRGGMRSVEFKVIETDPAEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEIGRLEVLRIHTKNMKLAEDVDLEKISKETHGYVGADLAALCTEAALQCIREKMDVIDLEDDSIDAEILNSMAVSNEHFATALGTSNPSALRETVVEVPNVKWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSAGDSGGADRVLNQLLTEMDGMSAKKTVFIIGATNRPDIIDPALLRPGRLDQLIYIPLPDVESRFQIFKSCLRKSPVAKDVDLRALSEYTQGFSGADITEICQRACKYAIRENIEKDIEKERRRSENPEAMEEDDADDEVSEIKAAHFEESMKYARRSVSDADIRKYQAFAQTLQQSRGFGSEFRFSETSSAATTTAADPFAASAGAADEDDLYG

SEQ ID NO: 13507 - protein, 807 aa, Mimulus guttatus
MSHQAESSDAKGGKKDFSTAILERKKAANRLVVDEAVNDDNSVVALHPATMEKLQLFRGDTILIKGKKRKDTVCIALADETCEEPKIRMNKVVRSNLRVRLGDVVSVHQCPDVKYGKRVHILPLDDTIEGITGDLFDAYLKPYFLEAYRPVRKGDHFLVRGGMRSVEFKVVEADPGEYCVVAPDTEIFCEGEPVRREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLSDDVDLERISKDTHGYVGADLAALCTEAALQCIREKMDVIDLEDDTIDAEILNSMAVSNEHFHTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSSGGDAGGAADRVLNQLLTEMDGMNAKKTVFIIGATNRPDIIDPALLRPGRLDQLIYIPLPDEDSRHQIFKACLRKSPLSKNIDLRALAKYTQGFSGADITEICQRACKYAIRENIEKDIERETRRKNNPDSMEEDIDDEVSEITPAHFEESMKYARRSVSDADIRKYQAFAQTLQQSRGFGTEFRFTESAPGAAASGSDPFAASAVGADEDDLYS

SEQ ID NO: 13508 - protein, 803 aa, Prunus persica
MAHPAESSDSKKKDFSTAILERKKSPNRLVVDEAINDDNSVVSMHPETMEKLQLFRGDTILIKGKKRKDTICIALADDTCEEPRIRMNKVVRSNLRVRLGDVVSVHQCPDVKYGKRVHILPIDDSIEGVTGNLFDAFLKPYFLEAYRPVRKGDLFLVRGGMRSVEFKVIETDPGEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDELDSIAPKREKTHGEVERRIVSQLLTLMDGLKSRAHVIVIGATNRPNSIDSALRRFGRFDREIDIGVPDEVGRLEVLRIHTKNMKLSDDVDLERISKDTHGYVGADLAALCTEAALQCIREKMDVIDLEDETIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARASAPCVLFFDELDSIATQRGSSSGDAGGAADRVLNQLLTEMDGMTAKKTVFIIGATNRPDIIDPALLRPGRLDQLIYIPLPDEESRFQIFKSCLRKSPVSKDVDLRALARYTQGFSGADITEICQRSCKYAIRENIEKDIERERRRGENPDSMDEDIDDEVAEIKAAHFEESMKYARRSVSDADIRKYQTFAQTLQQSRGFGTEFRFADNQTGATGADPFATSAGGADEDDLYS

SEQ ID NO: 13509 - protein, 806 aa, Actinidia deliciosa
  misc_feature (384)..(384): Xaa can be any naturally occurring amino acid
  misc_feature (391)..(391): Xaa can be any naturally occurring amino acid
MSNQAESSDSKGAKKDFSTAILERKKSPNRLVVDEAVNDDNSVVAMHPATMEKLQLFRGDTILIKGKKRKDTVCIALADDTCEEPKIRMNKVVRSNLRVRLGDIVSVHQCPDVKYGKRVHILPLDDTIEGITGDLFDAYLKPYFLEAYRPVRKGDHFLVRGGMRSVEFKVIETEPGEYCVVAPDTEIFCEGEPVRRDDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDELDSIAPKREKTHGEVERRIVSQLLTLMDGLKSRAHVIVMGATNRPNSIDPALRRFGRFDREIDIGVPDEVGRLEXLRIHTKXMKLSDEVDLERISKDTHGYVGADLAALCTEAALQCIREKMDVIDLEDDSIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEESRLQIFKACLRKSPISKDVDLRALAKYTQGFSGADITEICQRACKYAIRENIEKDIEKERRRGENPDSMDEDIDDEVAEIKAAHFEESMKYARRSVSDADIRKYQAFAQTLQQSRGFGTEFRFSESGTGAQSGSDPFAASAGGADEDDLYS

SEQ ID NO: 13510 - protein, 808 aa, Orobanche aegyptiaca
MSNQAESSDAKGTKRDFSTAILERKKAPNRLVVDEAINDDNSVVSLHPDTMEKLQLFRGDTILIKGKKRKDTICIALADETCDPPKIRMNKVVRSNLRVRLGDVVSVHQCADVKYGKRVHILPLDDTIEGITGNLFDAYLKPYFLEAYRPVRKGDLFLVRGGMRSVEFKIIETDPSEYCVVAPDTEIFCEGEPIKREDEDRLNEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPAIIFIDEIDSIAPKREKTNGEVERRIVSQLLTLMDGLKARAHIIVMGATNRPNSIDPALRRFGRFDREIDIGVPDEVGRLEVLRIHTKNMKLAEDVDLERVGKDTHGYVGADLAALCTESALQCIREKMDVIDLEDDTIDAEVLNSMAVTNEHFLTALGISNPSALRETVVEVPNVNWADIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSSGDGGGAADRVLNQLLTEMDGMNAKKTVFIIGATNRPDIIDSALLRPGRLDQLIYIPLPDMESRHQIFKACLRKSPVSKDVDLRALAEYTQGFSGADITEICQRACKYAIRENIEKDIEREKRRSENPDSMEEDVEDEVPEIKAAHFEESMKYARRSVSDGDIRKYQAFAQTLQQSRGFGSEFRFQNNTTTATTGPAADPFGAASGAADDDDLYS

SEQ ID NO: 13511 - protein, 811 aa, Glycine max
MANQPESSDAKGTKRDFSTAILERKKAPNRLVVDEAVNDDNSVVVLHPDTMEKLQLFRGDTILLKGKKRKDTICIALADETCEEPKIRMNKIVRNNLRVRLGDVVSVHQCADVKYGKRVHILPVDDTIEGVTGNLFDAYLKPYFLEAYRPVRKGDMFLVRGGMRSVEFKVIETDPAEYCVVAPDTEIFCEGEPVKREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERIAKDTHGYVGADLAALCTEAALQCIREKMDVIDLEDETIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRKRDNPEAMEEDIEEEEVAEIKAAHFEESMKYARRSVSDADIRKYQAFAQTLQQSRGFGSDFTFANTSSGGGGAATGTASDPFASAGGADEDDLYS

SEQ ID NO: 13512 - protein, 807 aa, Glycine max
MSQQGESSDPKSGKKDFSTAILERKKSPNRLVVDEAVNDDNSVVTMHPQTMEKLQLFRGDTILIKGKKRKDTICIALADENCEEPKIRMNKVVRSNLRVRLGDVVSVHQCPDVKYGKRVHILPIDDTIEGVTGNLFDAFLKPYFLEAYRPVRKGDLFLVRGGMRSVEFKVVETDPGEYCVVAPDTEIFCEGEPLKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSDDVDLERIAKDTHGYVGADLAALCTEAALQCIREKMDVIDLEDETIDAEVLNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPIAKNVDLRALARHTQGFSGADITEICQRACKYAIRENIEKDIERERKSRENPEAMDEDTVDDEVAEIKAAHFEESMKFARRSVSDADIRKYQAFAQTLQQSRGFGSEFRFPESGDRTTTGSDPFAASAGGADEDDLYS

SEQ ID NO: 13513 - protein, 801 aa, Tripterygium wilfordii
ESSDSKGTKRDFSTAILERKKATNRLVVDEAINDDNSVVALHPDTMEKLQLFRGDTILIKGKKRKDTICIALADDTCDEPKIRMNKVVRSNLRVRLGDVVSVHQCPDVKYGKRVHILPVDDTIEGVTGNLFDAYLKPYFLEAYRPVRKGDLFLVRGGMRSVEFKVIETDPPEYCVVAPDTEIFCEGEPVKREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERIAKDTHGYVGADLAALCTEAALQCIREKMDVIDLEDETIDAEILNSMAVTQEHFQTALGTSNPSALRETVVEVPNVSWQDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSSTGDAGGAADRVLNQLLTEMDGMSAKKTVFIIGATNRPDIIDPALLRPGRLDQLIYIPLPDEESRLQIFKACLRKSPVSKDVDLRALAKYTNGFSGADITEICQRSCKYAIRENIEKDIERERRRRDNPEAMEEDVDDEVAEIKAAHFEESMKYARRSVSDADIRKYQAFAQTLQQSRGFGTEFRFAEAGTGGAAASDPFAASAGGAEEDDLYS

SEQ ID NO: 13514 - protein, 810 aa, Saccharum officinarum
MASQGEPSASASDPKEKKDYSTAILERKKSPNRLVVDEATNDDNSVVALHPDTMERLQLFRGDTVLLKGKKRKDTICIVLADETCEEPKVRMNKVVRQNLRVRLGDVVSVHQCQDVKYGKRVHILPIDDTVEGITGNLFDAFLKPYFLEAYRPVRKGDLFLVRGGMRSVEFKVIETDPAEYCIVAPDTEIFCDGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKSRSHVIVMGATNRPNSIDPALRRFGRFDREIDIGVPDEVGRLEVLRIHTKNMKLAEDVNLELISKDTHGYVGADLAALCTEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIEREKRRKDNPEAMEEDEVDEIAEIKAAHFEESMKYARRSVSDADIRKYQAFAQTLQQSRGFGSEFRFSEQSATAGAAAADPFASAGAAADDDDLYS

SEQ ID NO: 13515 - protein, 799 aa, Euonymus alatus
DSKGTKKDFSTAILERKKAANRLVVDEAVNDDNSVVALHPDTMEKLQLFRGDTILIKGKKRKDTICIALADDTCDEPKIRMNKVVRSNLRVRLGDVVSVHQCPDVKYGKRVHILPVDDTIEGVTGNLFDAYLKPYFLEAYRPVRKGDLFLVRGGMRSVEFKVIETDPPEYCVVAPDTEIFCEGEPVRREDEDSRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLERIAKDTHGYVGADLAALCTEAALQCIREKMDVIDLEDETIDAEILNSMAVSNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSSGDAGGAADRVLNQLLTEMDGMSAKKTVFIIGATNRPDIIDPALLRPGRLDQLIYIPLPDEESRLQIFKSCLRKSPVSKDVDLRALAKYTSGFSGADITEICQRACKYAIRENIEKDIERERRRSDNPEAMEEDVEDEVSEIKAAHFEESMKYARRSVSDADIRKYQAFAQTLQQSRGFGTEFRFADSSTGGAAASDPFAASAGGADEDDLYS

SEQ ID NO: 13516 - protein, 808 aa, Solanum lycopersicum
MSNKAESSDSKGTKKDFSTAILERKKSPNRLVIDEAINDDNSVVSLHPDTMQKLQFFRGDTILIKGKKRKDTICIAIVDDKCDESKIRMNKVVRNNLSVRLGDVVSVHQCPDVKYGKRVHILPIDDSIEGVTGNLFDAYLKPYFVEAYRPVRKGDLFLVRGGMRSVEFKVIETDPAEYCVVAPDTEIFCEGEPVNREDENRLDEVGYDDIGGVRKQMAQIRELVELPLRHPQMFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLRSRAHVIVMGATNRPNSIDPALRRFGRFDREIDIGVPDEVGRLEVLRIHTKNMKLAEDVDLERICKETHGYVGADLAALCTEAALQCIREKMDVIDLEDESIDAEILNSMAVTNEHFSTALGTSNPSALRETVVEVPNISWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSRGDAGGAADRVLNQLLTEMDGMNAKKTVFIIGATNRPDIIDPALLRPGRLDQLIYIPLPDEDSRYQIFKACLRKSPLSKDIDLRALAKYTQGFSGADITEICQRACKYAIRENIEKDIERERRRRDNPEAMEEDVNDEVSEIKPAHFEESMKYARRSVSDGDIRKYQAFAQTLQQSRGFGSEFRFAGPTIGPTTGTTDPFATSAGGAADEDELYN

SEQ ID NO: 13517 - protein, 808 aa, Oryza sativa
MASQGEPSSSADPKGKKDYSTAILERKKSPNRLVVDEATNDDNSVVALHPDTMERLQLFRGDTVLLKGKKRKDTICIVLADETCEEPKIRMNKVVRKNLRVRLGDVVSVHQCQDVKYGKRVHILPIDDTVEGITGNLFDAFLKPYFLEAYRPVRKGDLFLVRGGMRSVEFKVIETDPTEYCIVAPDTEIFCDGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKARSHVIVMGATNRPNSIDPALRRFGRFDREIDIGVPDEVGRLEVLRIHTKNMKLAEDVDLELIAKDTHGYVGADLAALCTEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRSKENPEAMEEDEVDDIAEIKAAHFEESMKYARRSVSDADIRKYQAFAQTLQQSRGFGSEFRFERTEAGAGAAADPFASAAAVADDDDLYS

SEQ ID NO: 13518 - protein, 813 aa, Cucumis sativus
LDPAFNAFFYFFVSSSKGPKRDFSTAILERKKAANRLVVDEAINDDNSVVALHPDTMEKLQLFRGDTILIKGKKRKDTICIALADETCDEPKIRMNKVVRSNLRVRLGDVVSVHQCADVKYGKRVHILPVDDTIEGVTGNLFDAYLKPYFLEAYRPVRKGDLFLVRGGMRSVEFKVIETDPPEYCVVAPDTEIFCDGEPVKREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERIAKDTHGYVGADLAALCTEAALQCIREKMDVIDLEDETIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRRRDNPEAMEEDVEDEVAEIKAAHFEESMKFARRSVSDADIRKYQAFAQTLQQSRGFGSEFRFSDNPSSGTAAADPFATSAGGGADDDDLYN

SEQ ID NO: 13519 - protein, 553 aa, Ambrosia trifida
MSNQPESSSSDPKASKKDFSTAILERKKSPNRLVVDEAVNDDNSVVAMHPATMEKLQLFRGDTILIKGKKRKDTVCIALADETCDEPKIRMNKVVRTNLRIRLGDVVSVHQCPDVKYGKRIHVLPLDDTIEGVTGDLFDAYLKPYFLEAYRPVRKGDHFLVRGGMRSVEFKVIETDPGEYCVVAPDTEIFCEGEPIKRDDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLSEDVDLEKISKEHMVMLVLILLLFALKLHFNALERKWMLLIWKMMLLMLRYLIPWPSPMNISLLLLELAIHLLCVKLLLRFPMLAGMILEGSRMLSVSFKRRFNIQWSIQRNLRNLACHRQKEFFSTVHLDVGKHFLQKLLQMNVKLISLVSKDPNC

SEQ ID NO: 13520 - protein, 631 aa, Prunus persica
MTDKAESSDSKGTKRDFSTAILERKKAANRLVVDDAINDDNSVVALHPDTMEKLQLFRGDTILIKGKKRKDTICIALADDTCEEPKIRMNKVVRSNLRVRLGDVVSVHQCADVKYGKRVHILPVDDTIEGVTGNLFDAYLKPYFLEAYRPVRKGDLFLVRGGMRSVEFKVIETDPPEYCVVAPDTEIFCEGEPVKREDEERLNEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVVRIHTKNMKLAEDVDLEKIAKDTHGYVGADLAALCTEAALQCIREKMDVIDLEDEEIDAEILNSMAVTNEHFKTALGTSNPSALRETVVEVPNVSWEDIGGLDNVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMTAKKTVFIIGATNSPI

SEQ ID NO: 13521 - protein, 812 aa, Amorphophallus konjac
MANQGESSAAASDPKGPKRDYSTAILERKKAANRLVVDEAVNDDNSVVSMHPETMEKLQLFRGDTVLVKGKKRRDTICIALADDTCEEPKIRMNKVVRSNLRVRLGDVVSVHQCQDVKYGKRVHILPIDDTIEGITGNIFDAYLKPYFQEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSDDVDLERIAKDTHGYVGADLAALCTEAALQCIREKMDIIDLEDESIDAEVLNSMAVTNEHFKTALGTSNPSALRETVVEVPNVSWDDIGGLDNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEASRYQIFKACLRKSPVSKDVDLAALAKYTQGFSGADITEICQRACKYAIRENIEKDIERERRRSENPEAMEEDVADEVSEIKAVHFEESMKYARRSVSDADIRKYQAFAQTLQQSRGFGSEFRFTERSEAGAGTAGSDPFGSAAAGADDDDLYS

SEQ ID NO: 13522 - protein, 804 aa, Malus domestica
MAHQAESSDSKKKDFSTAILERKKSPNRLVVDEAVNDDNSVVSMHPETMEKLQLFRGDTILIKGKKRKDTICIALADDTCEEPRIRMNKVVRSNLRVRLGDVVSVHQCPDVKYGKRVHILPIDDSIEGVTGNLFDAFLKPYFLEAYRPVRKGDLFLVRGGMRSVEFKVIETDPGEYCVVAPDTEIFCEGEPVRREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDELDSIAPKREKTHGEVERRIVSQLLTLMDGLKSRAHVIVIGATNRPNSIDAALRRFGRFDREIDIGVPDEVGRLEVLRIHTKNMKLSDDVDLERISKDTHGYVGADLAALCTEAALQCIREKMDVIDLEDESIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARASAPCVLFFDELDSIATQRGGSSGDAGGAADRVLNQLLTEMDGMTAKKTVFIIGATNRPDIIDPALLRPGRLDQLIYIPLPDEESRFQIFKSCLRKSPVSKDVDLRALARYTQGFSGADITEICQRSCKYAIRENIEKDIERERRRAENPDSMDEDIDDEVAEIKAAHFEESMKYARRSVSDADIRKYQVFAQTLQQSRGFGTEFKFTENPQTGTTGSDAFATSAGAADEDDLYS

SEQ ID NO: 13523 - protein, 808 aa, Cannabis sativa
ILIFLCGFFYLGSKGTKRDFSTAILERKKAANRLVVDEAINDDNSVVSLHPDTLEKLQLFRGDTILIKGKKRKDTVCIALADDTCDEPKIRMNKVVRSNLRVRLGDVVSVHQCADVKYGKRVHILPIDDSIEGVTGNLFDAYLKPYFLEAYRPVRKGDLFLVRGGMRSVEFKVIETDPPEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDESIDAEILNSMAVTNEHFATALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEESRFQIFKSCLRKSPVAKDVDLSALAKYTQGFSGADITEICQRACKYAIRENIEKDIEKERRRKDNPEAMEEDVDDEVAEIKAAHFEESMKYARRSVSDADIRKYQAFAQTLQQSRGFGTEFRFAESGSAAAGADPFATTAGAADEDDLYN

SEQ ID NO: 13524 - protein, 805 aa, Flaveria ramosissima
MSDQPESSDSKGTKRDFSTAILERKKAANRLVVDEAINDDNSVVSLHPETMEKLQLFRGDTILIKGKKRRDTICIALADDTCEEPKIRMNKVVRSNLRVRLGDVVSVHQCPDVKYGKRVHILPIDDTIEGVTGNLFDAYLKPYFLEAYRPVRKGDYFLVRGGMRSVEFKVIETDPAEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKMAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLSDDVDLEKVAKDTHGYVGADLAALCTEAALQCIREKMDVIDLEDESIDAEILNSMAVTNEHFQTALGTSNPSALRETVVEVPNVSWEDIGGLENVKRELQETVQYPVEHPEKFEKFGMAPSKGVLFYGPPGCGKTLLAKAIANECQANFISIKGPELLTMWFGESEANVREIFDKARGSAPCVLFFDELDSIATQRGSSQGDAGGAADRVLNQLLTEMDGMSAKKTVFIIGATNRPDIIDPALLRPGRLDQLIYIPLPDEESRYQIFKSALRKSPISKDVDLRALAKYTQGFSGADITEICQRACKYAIRENIEKDIEREKRRSENPEAMEEDVEDEVAEIKAAHFEESMKFARRSVSDADIRKYQAFAQTLQQSRGIGSEFRFSETSGRAAASDPFAAPAGAADDDDLYN

SEQ ID NO: 13525 - protein, 813 aa, Glycine max
MANQPESSSSDAKGTKRDFSTAILERKKAPNRLVVDEAVNDDNSVVALHPNTMEKLQLFRGDTILLKGKKRKDTICIALADETCEEPKIRMNKVVRNNLRVRLGDVVSVHQCADVKYGKRVHILPVDDTIEGVTGNLFDAYLKPYFLEAYRPVRKGDMFLVRGGMRSVEFKVIETDPAEYCVVAPDTEIFCEGEPVKREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERIAKDTHGYVGADLAALCTEAALQCIREKMDVIDLEDETIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRKRENPEAMEEDIEEEEVAEIKAAHFEESMKYARRSVSDADIRKYQAFAQTLQQSRGFGSDFTFANTSSVGAAAGAGAASDPFASAGGADEDDLYS

SEQ ID NO: 13526 - protein, 802 aa, Vinca minor
NPAESSDSKGKKDFSTAILERKKAPNRLIVDEAVNDDNSVVALHPATMEKLNIFRGDTILIKGKKRKDTVCIALADETCEEPKIRMNKVVRSNLRVRLADVVSVHQCPDVKYGKRIHVLPLDDTIEGVTGDLFDAYLKPYFLEAYRPVRKGDHFLVRGGMRSVEFKVIETDPGDYCVVAPDTEIFCEGEPVKREDEDRLDEVGYDDVGGVRKQMAQIRELVELPLRHPQLFKSIGVKPPKGILLYGPPGSGKTLIAKAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLSEDVDLERIAKDTHGYVGADLAALCTEAALQCIREKMDVIDLEDDSIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDVDSRHQIFKACLRKSPISKDVDLGALAKYTQGFSGADITEICQRACKYAIRENIEKDIERERKRKDNPDSMDDDVEEEVAEIKAGHFEESMKYARRSVSDADIRKYQAFAQTLQQSRGFGSEFRFADSATAASGSDPFATPAGAGDEDDLYN

SEQ ID NO: 13527 - protein, 810 aa, Sorghum bicolor
MASQGEPSASASDPKEKKDYSTAILERKKSPNRLVVDEATNDDNSVVALHPDTMERLQLFRGDTVLLKGKKRKDTICIVLADETCEEPKVRMNKVVRQNLRVRLGDVVSVHQCQDVKYGKRVHILPIDDTVEGITGNLFDAFLKPYFLEAYRPLRKGDLFLVRGGMRSVEFKVIETDPAEYCIVAPDTEIFCDGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKSRSHVIVMGATNRPNSIDPALRRFGRFDREIDIGVPDEVGRLEVLRIHTKNMKLAEDVNLELISKDTHGYVGADLAALCTEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRRKDNPEAMEEDEVDEIAEIKAAHFEESMKYARRSVSDADIRKYQAFAQTLQQSRGFGSEFRFSEQSATAGAAAADPFASAGAAADDDDLYS

SEQ ID NO: 13528 - protein, 810 aa, Zea mays
MASQGEPSASASDPKEKKDYSTAILERKKSPNRLVVDEATNDDNSVVALHPDTMERLQLFRGDTVLLKGKKRKDTVCIVLADETCEEPKVRMNKVVRQNLRVRLGDVVSVHQCQDVKYGKRVHILPIDDTVEGITGNLFDAFLKPYFLEAYRPVRKGDLFLVRGGMRSVEFKVIETDPSEYCIVAPDTEIFCDGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKSRSHVIVMGATNRPNSIDPALRRFGRFDREIDIGVPDEVGRLEVLRIHTKNMKLAEDVNLELISKDTHGYVGADLAALCTEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRMKDNPEAMEEDEVDEIAEIKAAHFEESMKYARRSVSDADIRKYQAFAQTLQQSRGFGSEFRFSEQSATAGAAAADPFASAGAAADDDDLYS

SEQ ID NO: 13529 - protein, 805 aa, Amsonia hubrichtii
MSTQAESSDTKGKKDFSTAILERKKAPNRLIVDEAVNDDNSVVALHPTTMEKLQLFRGDTILIKGKKRKDTVCIALADEACEEPKIRMNKVVRANLRVRLGDVVSVHQCPDVKYGKRIHVLPLDDTIEGVTGDLFDAYLKPYFLEAYRPVRKGDHFLVRGGMRSVEFKVIETEPGEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDELDSIAPKREKTHGEVERRIVSQLLTLMDGLKSRAHVIVIGATNRPNSIDPALRRFGRFDREIDIGVPDEIGRLEVLRIHTKNMKLSEDVDLERIAKDTHGYVGADLAALCTEAALQCIREKMDVIDLEDDSIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKHTQGFSGADITEICQRACKYAIRENIEKDIERERRILKDNPDSMDEDVEEEVAEIKAAHFEESMKYARRSVSDADIRKYQAFAQTLQQSRGFGSEFRFADSATGAPESDAFATSAGAADEDDLYS

SEQ ID NO: 13530 - protein, 801 aa, Arnica chamissonis
MSNQAEASDSKGTKRDYSTAILERKKAANRLVVDEAINDDNSVVALHPETMEKLQLFRGDTILIKGKKRKDTICIALADDTCEEPKIRMNKVVRANLRVRLGDVVSVHQCPDVKYGKRVHILPVDDTIEGVTGNLFDAYLKPYFLEAYRPVRKGDFFLVRGGMRSVEFKVIETDPAEYCVVAPDTEIFCEGEPIRREDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLADDVDLEKISKETHGYVGADLAALCTESALQCIREKMDVIDLEDESIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSQGDAGGAADRVLNQLLTEMDGMSAKKTVFIIGATNRPDIIDPALLRPGRLDQLIYIPLPDEESRYSIFKSALRKSPVAKEVDLHALAKYTQGFSGADITEICQRAVKYAIRENIEKDIEREKRRSENPEAMEEDVDEVAEIKAAHFEESMKFARRSVSDADIRKYQAFAQTLQQSRGFGSEFRFSETSGATASAGGSDPFAASAGAAR

SEQ ID NO: 13531 - protein, 806 aa, Distylium racemosum
MAKGESSEPKGTKRDYSTAILERKKAPNRLVVDEAINDDNSVVSLHPDTMEKLQLFRGDTILIKGKKRKDTICIALADETCEEPKIRMNKVVRSNLRVRLGDVVSVHQCPDVKYGKRVHILPIDDTIEGVTGNLFDAYLKPYFLEAYRPVRKGDLFLVRGGMRSVEFKVIETDPGEYCVVSPDTEIFCEGEPVKREDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERIAKDTHGYVGADLAALCTEAALQCIREKMDVIDLEDETIDAEILNSMAVTNEHFQTALGSSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDESSRYQIFKSCLRKSPVSKDVDLMALARYTHGFSGADITEICQRACKYAIRENIEKDIERERKRRDNPEAMDEDDSDEVSEIKAAHFEESMKYARRSVSDADIRKYQAFAQTLQQSRGFGSEFRFPDRPSSTVGAGSSDAFATADNKDDDDLYG

SEQ ID NO: 13532 - protein, 807 aa, Euonymus alatus
MSNQGESSDSKSAKKDFSTAILERKKSPNRLVVDEAVNDDNSVVSMHPETMEKLQLFRGDTILIKGKKRKDTICIALADDTCEQPRIRMNKVVRSNLRVRLGDVVSVHQCPDVKYGKRVHILPIDDTIEGVTGNLFDAYLKPYFLESYRPVRKGDLFLVRGGMRSVEFKVIETDPGEYCVVAPDTEIFCEGEPVRREDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDELDSIAPKREKTHGEVERRIVSQLLTLMDGLKSRAHVIVIGATNRPNSIDPALRRFGRFDREIDIGVPDEVGRLEVLRIHTKNMKLSDDVDLERIGKDTHGYVGADLAALCTEAALQCIREKMDVIDLEDETIDAEILNSMAVTNDHFQTALGTSNPSALRETVVEVPNVNWEDIGGLTNVKRELQETVQYPVEHPEKFEKFGMAPSKGVLFYGPPGCGKTLLAKAIANECQANFISVKGPELLTMWFGESEANVREIFDKARQSAPCVLFFDELDSIATQRGNSGGDAGGAADRVLNQLLTEMDGMSAKKTVFIIGATNRPDIIDPALLRPGRLDQLIYIPLPDEESRFQIFKACLRKSPIAKDVDLGALAKYTNGFSGADITEICQRACKYAIRENIEKDIEREKWRSQNPEAMEEDTGEEVDEIKAAHFEESMKFARRSVSDADIRKYQAFAQTLQQSRGFGTEFRFPETGSGAAAATDPFSTSGAAGADEDDLYS

SEQ ID NO: 13533 - protein, 805 aa, Flaveria ramosissima
MSDQPESSDPKGTKRDFSTAILERKKAANRLVVDEAINDDNSVVSLHPETMEKLQLFRGDTILIKGKKRRDTICIALADDTCEEPKIRMNKVVRSNLRVRLGDVVSVHQCPDVKYGKRVHILPIDDTIEGVTGNLFDAYLKPYFLEAYRPVRKGDYFLVRGGMRSVEFKVIETDPAEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKMAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLSDDVDLEKVAKDTHGYVGADLAALCTEAALQCIREKMDVIDLEDESIDAEILNSMAVTNEHFQTALGTSNPSALRETVVEVPNVSWEDIGGLENVKRELQETVQYPVEHPEKFEKFGMAPSKGVLFYGPPGCGKTLLAKAIANECQANFISIKGPELLTMWFGESEANVREIFDKARGSAPCVLFFDELDSIATQRGSSQGDAGGAADRVLNQLLTEMDGMSAKKTVFIIGATNRPDIIDPALLRPGRLDQLIYIPLPDEESRYQIFKSALRKSPISKDVDLRALAKYTQGFSGADITEICQRACKYAIRENIEKDIEREKRRSENPEAMEEDVEDEVAEIKAAHFEESMKFARRSVSDADIRKYQAFAQTLQQSRGIGSEFRFSETSGRAAASDPFAAPAGAADDDDLYN

SEQ ID NO: 13534 - protein, 805 aa, Aquilegia formosa
MADQPESSDPKGGKKDFSTAILERKKAANRLVVDEAINDDNSVVSLHPDTMEKLQLFRGDTILIKGKKRKDTICIALADDTCDEPKIRMNKVVRSNLRVRLGDVVSVHQCPDVKYGKRVHILPVDDTIEGLTGNLFETFLKPYFLEAYRPVRKGNLFLVRGGMRSVEFKIIETDPAEYCVVAPDTEIFCEGEPVKREDEDRLDDVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEIGRLEVLRIHTKNMKLSDDVDLEAISKNTHGYVGADLAALCTEAALQCIREKMDVIDLEDESIDAEILNSMAVTDEHFKTALNTSNPSALRETVVEVPNVSWQDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEESRFQIFKSCLRKSPVSKDVDLRALAKYTQGFSGADITEICQRACKYAIRENIEKDIERERRRSDNPEAMEEDVDDEVPEIKAAHFEESMKFARRSVSDADIRKYQAFAQTLQQSRGFGSEFRFAETGAGTTTASDPFAAAGGADEDDLYS

SEQ ID NO: 13535 - protein, 604 aa, Lactuca sativa
MSNQAESSDAKGTKRDFSTAILERKKAANRLVVDEAINDDNSVVALHPETMEKLQLFRGDTILIKGKKRKDTICIVLADDTCEEPKIRMNKVVRTNLRVRLGDVVSVHQCADVKYGKRVHILPIDDTIEGVTGNLFDAYLKPYFMEAYRPVRKGDFFLVRGGMRSVEFKVIETDPPEYCVVAPDTEIFCEGEPIRREDEDRLDEIGYDDVGGVRKQMAQIRELVELPLRHPQLFKSIGVKPPKGILLYGPPGSGKTLIARAVANETGAFFFCINGPEIMSKMAGESESNLRKAFEEAEKNAPSIIFIDEIDSIAPKREKTHGEVERRIVSQLLTLMDGLKSRAHVIVMGATNRPNSIDPALRRFGRFDREIDIGVPDEIGRLEVLRIHTKNMKLAEDVDLEKISKETHGYVGADLAALCTEAALQCIREKMDVIDLEDESIDAEILNSMAVRMSTLQLHLGLVILLLSVRLLWKCLMLVGKISEALRMSNVSSKRLFNIRLNTRRNLKNSECHHQRESSSMAHQGVGKHFSRKLSPTNAKRTSSASRDQNYSQCGSVKVKRMYARSSIKHVGPPLVFSSSTNSTPSPPREEVVKEMREVQQIGF

SEQ ID NO: 13536 - protein, 806 aa, Cephalotaxus harringtonia
MAHKGESSEPKGTKRDFSTAILERKKAANRLVVDEAINDDNSVVCLHPDTMEKLQLFRGDTILIKGKKRKDTICIALADETCEEPKIRMNKVVRSNLRVRLGDVVSVHQCPDVKYGKRVHILPIDDTIEGVTGNLFDAYLKPYFLEAYRPVRKGDLFLVRGGMRSIEFKVIETDPGEYCVVSPDTEIFCEGEPVKREDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSDDVDLERIAKDTHGYVGADLAALCTEAALQCIREKMDVIDLEDETIDAEILNSMAVTNEHFQTALGSSNPSALRETVVEVPNVTWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMTAKKTVFIIGATNRPDIIDPALLRPGRLDQLIYIPLPDESSRYQIFKSCLRKSPVSKDVDLMALARYTQGFSGADITEICQRACKYAIRENIEKDIERERKRSENPEAMDEDDSDEVSEIKAAHFEESMKYARRSVSDADIRKYQAFAQTLQQSRGFGSEFRFPDRPAGAVAGASDAFATADNKDDDDLYS

SEQ ID NO: 13537 - protein, 807 aa, Mimulus guttatus
MSNQPESSDPKGGKKDFSTAILERKKAANRLVVDEAVNDDNSVVAIHPATMEKLQLFRGDTILIKGKKRKDTVCIALADETCEEAKIRMNKVVRTNLRVRLGDVVSVHQCPDVKYGKRVHILPLDDTIEGLTGDLFDVYLKPYFLEAYRPLRKGDHFLVRGGMRSVEFKVIETDPGEYCVVAPDTEIFCEGEPVRREDEDRLDEVGYDDVGGVRRQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLSEDVDLERISKDTHGYVGADLAALCTEAALQCIREKMDVIDLEDDTIDAEILNSMAVSNEHFHTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEDSRHQIFKACLRKSPLSRDIDLRALAKYTQGFSGADITEICQRACKYAIRENIEKDIEKERKKKDNPDSMDEDLEDEFSEIKPAHFEESMKYARRSVSDADIRKYQAFAQTLQQSRGFGTEFRFAESAGGATTGSDPFAAPAGGAADEDDLYS

SEQ ID NO: 13538 - protein, 806 aa, Sciadopitys verticillata
MAHKGESSEPKGTKRDYSTAILERKKAPNRLVVDEAINDDNSVVCLHPDTMEKLQLFRGDTILIKGKKRKDTICIALADETCEEPKIRMNKVVRSNLRVRLGDVVSVHQCPDVKYGKRVHILPIDDTIEGVTGNLFDAYLKPYFLEAYRPVRKGDLFLVRGGMRSVEFKVIETDPGEYCVVSPDTEIFCEGEPVKREDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSDDVDLERIAKDTHGYVGADLAALCTEAALQCIREKMDVIDLEDETIDAEILNSMAVTNEHFQTALGSSNPSALRETVVEVPNVTWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMTAKKTVFIIGATNRPDIIDPALLRPGRLDQLIYIPLPDESSRYQIFKSCLRKSPVAKDVDLMALARYTHGFSGADITEICQRACKYAIRENIEKDIERERKRSENPEAMDEDDSDEVSEIKAAHFEESMKYARRSVSDADIRKYQAFAQTLQQSRGFGSEFRFPDRPATAGAGASDAFATEDNKDDDDLYS

SEQ ID NO: 13539 - protein, 806 aa, Glycine max
MSHQAESSDSKSWKKDFSTAILERKKSPNRLVVDEAVNDDNSVVAMHPQTLEKLQLFRGDTILIKGKKRKDTVCIALADDNCEESKIRMNKVVRSNLRVRLGDVVSVHACPDVKYGKRVHILPIDDTIEGVTGNLFDAYLKPYFLEAYRPVRKGDLFLVRGGMRGVEFKVIETDPGEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRVHTKNMKLSDNVDLERIAKDTHGYVGADLAALCTEAALQCIREKMDVIDLEDESIDAEVLNSMAVSNEHFHIALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSGGDAGGAADRVLNQLLTEMDGMNAKKTVFIIGATNRPDIIDSALLRPGRLDQLIYIPLPDQESRYQIFKACMKKSPVSKDVNLGALAEYTKGFSGADITEICQRACKYAIRENIEKDIEHERKRRENPEAMDEDMEGEDVSEIKAAHFEESMKYARRSVSDADIRKYQAFAQTLQQSRGFGSDFNFPAAVSRTAGSEPFATSAGGADEDDLYS

SEQ ID NO: 13540 - protein, 809 aa, Oryza sativa
MASQGEPSSSSDPKGKKDFSTAILERKKSPNRLVVDEATNDDNSVIGMHPDTMEKLQLFRGDTVLLKGKKRKDTICIVLADDTCEEPKIRMNKVVRKNLRVRLGDVVSVHQCPDVKYGKRVHILPIDDTVEGITGNLFDAFLKPYFLEAYRPLRKGDLFLVRGGMRSVEFKVIETDPAEYCIVAPDTEIFCDGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKARSHVIVMGATNRPNSIDPALRRFGRFDREIDIGVPDEVGRLEVLRIHTKNMKLAEDVDLEHIAKDTHGYVGADLAALCTEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDDQSRLQIFKACLRKSPVAKDVDLNALAKYTQGFSGADITEICQRACKYAIRENIEKDIEMEKRRKDNPEAMEEDEVDDIAEIKAAHFEESMKYARRSVSDADIRKYQAFAQTLQQSRGFGTEFRFADQPASGAGAAADPFASAAAAADDDDLYS

SEQ ID NO: 13541 - protein, 810 aa, Sorghum bicolor
MASQGEPSSSDPKGKKDYSTAILERKKSPNRLVVDEATNDDNSVVALHPDTMERLQLFRGDTVLLKGKKRKDTICIVLADDTCEEPKVRMNKVVRKNLRVRLGDVVSVHQCPDVKYGKRVHILPIDDTIEGITGNLFDAFLKPYFLEAYRPLRKGDLFLVRGGMRSVEFKVIETDPIEYCIVAPDTEIFCEGEPVKREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAENVDLELIAKDTHGYVGADLAALCTEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRRKDNPEAMEEDEVDDIAEIKAAHFEESMKFARRSVSDADIRKYQAFAQTLQQSRGFGSEFRFPDQPTAAAGSAGAADPFASAAAAADDDDLYN

SEQ ID NO: 13542 - protein, 808 aa, Artemisia annua
MSNQPEASSSSEPKGAKKDFSTAILERKKSPNRLVVDEAVNDDNSVVAMHPSTMEKLQLFRGDTILIKGKKRRDTVCIALADETCDEPKIRMNKVVRTNLRVRLGDVVSVHQCPDVKYGKRIHVLPLDDTIEGVTGDLFDAYLKPYFLEAYRPVRKNDHFLVRGGMRSVEFKVIETDPGEYCVVAPDTEIFCEGEPIKRDDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLSEDVDLEKISKETHGYVGADLAALCTEAALQCIREKMDVIDLEDESIDAEILNSMSVSNEHFSTALGTSNPSALRETVVEVPNCSWDDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEDSRHQIFKAAMRKSPVAKDVDLRALAKYTQGFSGADITEICQRACKYAIRENIEKDIERERRRSENPDSMDEDEDEVAEIKAAHFEESMKYARRSVSDADIRKYQAFAQTLQQSRGFGSEFRFSEATSGGTAAADPFAASAGGADDDDLYN

SEQ ID NO: 13543 - protein, 807 aa, Zea mays
MASQGEPSSSDPKGKKDYSTAILERKKSPNRLVVDEATNDDNSVVALHPDTMERLQLFRGDTVLLKGKKRKDTICIVLADETCEEPKVRMNKVVRKNLRVRLSDVVSVHQCPDVKYGKRVHILPIDDTIEGITGNLFDAFLKPYFLEAYRPLRKGDLFLVRGGMRSVEFKVIETDPAEYCIVAPDTEIFCEGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLEIIAKDTHGYVGADLAALCTEAALQCIREKMDIIDLEDETIDAEILNSMAVSNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRSKDNPEAMEEDEVDDIAEIKAAHFEESMKYARRSVSDADIRKYQAFAQTLQQSRGFGSEFRFPDQPTAAAAAADPFASAAAAADDDDLYS

SEQ ID NO: 13544 - protein, 811 aa, Zea mays
MASQGEPSASASDPKEKKDFSTAILERKKSPNRLVVDEATNDDNSVVALHPDTMERLQLFRGDTVLLKGKKRKDTICIVLADETCEEPKVRMNKVVRQNLRVRLGDVVSVHQCQDVKYGKRVHILPIDDTVEGITGNLFDAFLKPYFLEAYRPLRKGDLFLVRGGMRSVEFKVIETDPAEYCIVAPDTEIFCDGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKSRSHVIVMGATNRPNSIDPALRRFGRFDREIDIGVPDEVGRLEVLRIHTKNMKLAEDVNLELISKDTHGYVGADLAALCTEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRRKDNPEAMEEDEVDEIAEIRAPHFEESMKYARRSVSDADIRKYQAFAQTLQQSRGFGSEFRFSDQPATAGAAAAADPFASAGAAADDDDLYS

SEQ ID NO: 13545 - protein, 624 aa, Ambrosia trifida
MSNQPESSSSDPKASKKDFSTAILERKKSPNRLVVDEAVNDDNSVVAMHPATMEKLQLFRGDTILIKGKKRKDTVCIALADETCDEPKIRMNKVVRTNLRIRLGDVVSVHQCPDVKYGKRIHVLPLDDTIEGVTGDLFDAYLKPYFLEAYRPVRKGDHFLVRGGMRSVEFKVIETDPGEYCVVAPDTEIFCEGEPIKRDEEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLSEDVDLEKISKETHGYVGADLAALCTEAALQCIREKMDVIDLEDDSIDAEILNSVAVTNEHFSTALGTSNPSALRETVVEVPNVSWDDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKRFS

SEQ ID NO: 13546 - protein, 805 aa, Arnica chamissonis
MSNQPESSDSKGNKRDFSTAILERKKAPNRLVVDEAINDDNSVVSLHPETMEKLQLFRGDTILIKGKKRRDTICIALADDTCEEPKIRMNKVVRSNLRVRLGDVISVHQCADVKYGKRVHILPIDDTIEGVTGNLFDAYLKPYFLEAYRPVRKGDYFLVRGGMRSVEFKVIETDPAEYCVVAPDTEIFCEGEPVRREDEDRLDEIGYDDVGGVRKQMAQIRELVELPLRHPQLFKSIGVKPPKGILLYGPPGSGKTLIARAVANETGAFFFCINGPEIMSKMAGESESNLRKAFEEAEKNAPSIIFIDELDSIAPKREKTHGEVERRIVSQLLTLMDGLKSRAHVIVMGATNRPNSIDPALRRFGRFDREIDIGVPDEVGRLEVLRIHTKNMKLSDDVDLEKVGKETHGYVGADLAALCTEAALQCIREKMDVIDLEDETIDAEILNSMAVTNEHFQTALGTSNPSALRETVVEVPNVSWEDIGGLENVKRELQETVQYPVEHPEKFEKFGMAPSKGVLFYGPPGCGKTLLAKAIANECQANFISIKGPELLTMWFGESEANVREIFDKARGSAPCVLFFDELDSIATQRGSSQGDAGGAADRVLNQLLTEMDGMSAKKTVFIIGATNRPDIIDPALLRPGRLDQLIYIPLPDEESRYQIFKSALRKSPIAKDVDLRALAKYTQGFSGADITEICQRACKYAIRENIEKDIEREKKRSENPEAMEEDLEDEVAEIKAAHFEESMKFARRSVSDADIRKYQAFAQTLQQSRGIGSEFRFSETSGRAAASDPFAAPAGAVDDDDLYN

SEQ ID NO: 13547 - protein, 798 aa, Catharanthus roseus
MSNQAEPSDSKGKKDFSTAILERKKAPNRLIVDEAVNDDNSVVALHPVTMEKLQLFRGDTILIKGKKRKDTICIALADEACEEPKIRMNKVVRSNLRVRLGDVVSVHQCPDVKYGKRIHVLPLDDSIEGVTGDLFDAYLKPYFLEAYRPVRKGDHFLVRGGMRSVEFKVIETDPGEYCVVAPDTEIFCEGDPVKREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVIGATNRPNSIDPALRRFGRFDREIDIGVPDEVGRLEVLRIHTKNMKLSEDVDLERIAKDTHGYVGADLAALCTEAALQCIREKMDVIDLEDDSIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRLQIFKACLRKSPVSKDVDLRALAKYTQGFSGADITEICQRACKYAIRENIEKDIERERRRNENPDSMDEDVEEEIAEIKAAHFEESMKYARRSVSDADIRKYQAFAQTLQQSRGFGSEFRFAESATTGASGSDPFRNFGWCC

SEQ ID NO: 13548 - protein, 806 aa, Cephalotaxus harringtonia
MAHKGESSEPKGTKRDFSTAILERKKAANRLVVDEAINDDNSVVCLHPDTMEKLQLFRGDTILIKGKKRKDTICIALADDTCEEPKIRMNKVVRSNLRVRLGDVVSVHQCPDVKYGKRVHILPIDDTIEGVTGNLFDAYLKPYFLEAYRPVRKGDLFLVRGGMRSVEFKVIETDPGEYCVVSPDTEIFCEGEPVKREDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSDDVDLERIAKNTHGYVGADLAALCTEAALQCIREKMDVIDLEDETIDAEILNSMAVTNEHFQTALGSSNPSALRETVVEVPNVTWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSSGDAGGAADRVLNQLLTEMDGMTAKKTVFIIGATNRPDIIDPALLRPGRLDQLIYIPLPDESSRYQIFKSCLRKSPVSKDVDLMALARYTQGFSGADITEICQRACKYAIRENIEKDIEHERKRSENPEAMDEDDSDEVSEIKAAHFEESMKYARRSVSDADIRKYQAFAQTLQQSRGFGSEFRFPDRPAGSVAGASDAFTTADNKDDDDLYS

SEQ ID NO: 13549 - protein, 812 aa, Amorphophallus konjac
MANQGESSSAPSDSKGTKRDFSTAILERKKAANRLIVDEAANDDNSVVSMHPETMEKLQLFRGDTILIKGKKRKDTICIALADDTCDEPKIRLNKVVRSNLRVRLGDVVSVHQCQDVKYGKRVHILPIDDTIEGITGNLFDAYLKPYFSEAYRPVRKGDLFLVRGGMRSVEFKVIETDPPEYCVVAPDTEIFCDGEPVKREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSDDVDLERIAKDTHGYVGADLAALCTEAALQCIREKMDIIDLEDESIDAEILNSMAVTNEHFKTALGSSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEASRFQIFKACLRKSPVSKDVELAALAKYTQGFSGADITEICQRACKYAIRENIEKDIERERRRSENPEAMEEDAADEVAEIKAVHFEESMKFARRSVSDADIRKYQAFAQTLQQSRGFGSEFRFSERSETAAGTTASDPFGSAAAGADDDDLYN

SEQ ID NO: 13550 - protein, 336 aa, Amorphophallus konjac
MANQGESSSAPSDSKGTKRDFSTAILERKKAANRLIVDEAANDDNSVVSMHPETMEKLQLFRGDTILIKGKKRKDTICIALADDTCDEPKIRLNKVVRSNLRVRLGDVVSVHQCQDVKYGKRVHILPIDDTIEGITGNLFDAYLKPYFSEAYRPVRKGDLFLVRGGMRSVEFKVIETDPPEYCVVAPDTEIFCDGEPVKREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIILLMRLTLLHQSERKPMEKLRDVLSLNC

SEQ ID NO: 13551 - protein, 806 aa, Taxus baccata
MAHKGESSEPKGTKRDFSTAILERKKAANRLVVDEAINDDNSVVCLHPDTMEKLQLFRGDTILIKGKKRKDTICIALADETCEEPKIRMNKVVRSNLRVRLGDVVSVHQCPDVKYGKRVHILPIDDTIEGVTGNLFDAYLKPYFLEAYRPVRKGDLFLVRGGMRSVEFKVIETDPGEYCVVSPDTEIFCEGEPVKREDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDAALRRFGRFDREIDIGVPDEVGRLEVLRIHTKNMKLSDDVDLEKIAKNTHGYVGADLAALCTEAALQCIREKMDVIDLEDETIDAEILNSMAVTNEHFQTALGSSNPSALRETVVEVPNVNWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGGSVGDAGGAADRVLNQLLTEMDGMTAKKTVFIIGATNRPDIIDPALLRPGRLDQLIYIPLPDESSRYQIFKSCLRKSPVSKDVDLMALARYTQGFSGADITEICQRACKYAIRENIEKDIEHERKRSENPEAMDEDDSDEVSEIKAAHFEESMKYARRSVSDADIRKYQAFAQTLQQSRGFGSEFRFPDRPAGTAVGATDAFATADNKDDDDLYS

SEQ ID NO: 13552 - protein, 805 aa, Helianthus annuus
MSNQPESSDSKGGKKDFSTAILERKKAPNRLVVDEAINDDNSVVSMHPETMEKLQLFRGDTILIKGKKRRDTICIALADDTCEEPKIRMNKVVRSNLRVRLGDVVSVHQCADVKYGKRVHILPIDDTIEGVTGSLFDAYLKPYFLEAYRPVRKGDYFLVRGGMRSVEFKVIETDPAEYCVVAPDTEIFCEGEPVRREDEDRLDEIGYDDVGGVRKQMAQIRELVELPLRHPQLFKSIGVKPPKGILLYGPPGSGKTLIARAVANETGAFFFCINGPEIMSKMAGESESNLRKAFEEAEKNAPSIIFIDELDSIAPKREKTHGEVERRIVSQLLTLMDGLKSRAHVIVMGATNRPNSIDPALRRFGRFDREIDIGVPDEVGRLEVLRIHTKNMKLADDVDLEKVGKDTHGYVGADLAALCTEAALQCIREKMDVIDLEDESIDAEILNSMAVTNEHFQTALGTSNPSALRETVVEVPNVSWEDIGGLENVKRELQETVQYPVEHPEKFEKFGMAPSKGVLFYGPPGCGKTLLAKAIANECQSNFISIKGPELLTMWFGESEANVREIFDKARGSAPCVLFFDELDSIATQRGGSQGDAGGAADRVLNQLLTEMDGMSAKKTVFIIGATNRPDIIDPALLRPGRLDQLIYIPLPDEESRYQIFKSALRKSPISKDVDLRALARYTQGFSGADITEICQRACKYAIRENIEKDIEREKRRSENPEAMEEDMDDEVAEIKAAHFEESMKFARRSVSDADIRKYQAFAQTLQQSRGIGSEFRFSETSGRAAASDPFAAPAGTVDDDDLYN

SEQ ID NO: 13553 - protein, 808 aa, Flaveria ramosissima
MSNQPESSSSDPKGAPPSKKDFSTAILERKKSPNRLVVDEAVNDDNSVVAMHPATMEKLQLFRGDTILIKGKKRRDTVCIALADETCDEPKIRMNKVVRTNLRIRLGDVVSVHQCPDVKYGKRIHVLPLDDTIEGVTGDLFDAYLKPYFLEAYRPVRKGDHFLVRGGMRSVEFKVIETDPGEYCVVAPDTEIFCEGEPIKRDDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVIGATNRPNSIDPALRRFGRFDREIDIGVPDEVGRLEVLRIHTKNMKLSEDVDLEKISKETHGYVGADLAALCTEAALQCIREKMDVIDLEDESIDAEILNSMAVTNEHFATALGTSNPSALRETVVEVPNVSWDDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEESRYSIFKAAMRKSPVSKDVDLRALAKYTQGFSGADITEICQRACKYAIRENIEKDIERERKRSENPDSMDEDEDDVAEIKAAHFEESMKYARRSVSDADIRKYQAFAQTLQQSRGFGSEFRFPEATSGGAADPFAASAGGANDDDLYS

SEQ ID NO: 13554 - protein, 791 aa, Silene vulgaris
DFSTAILERKKAANRLVVDESVNDDNSVVSLHPDAMEKLQIFRGDTILIKGKKRKDTICIALADETCEVPKIRMNKVVRSNLRVRLGDVVSVHQCPDVKYGKRVHILPVDDTVEGVTGNLFDAYLKPYFLEAYRPVRKGDLFLVRGGMRSVEFKVIETDPAEYCVVAPDTEIFCEGEPVKREDENRLDEVGYDDVGGVRKQMAQIRELVELPLRHPQLFKSIGVKPPKGILLFGPPGSGKTLIARAVANETGAFFFCINGPEIMSKMAGESESNLRKAFEEAEKNAPSIIFIDEIDSIAPKRDKTNGEVERRIVSQLLTLMDGLKSRAHVIVMGATNRPNSIDPALRRFGRFDREIDIGVPDEVGRLEVLRIHTKNMKLAEDVDLEKVCKETHGYVGADLAALCTEAALQCIREKMDVIDLEDDTIDAEILNSMAVTNEHYQTALSQSNPSALRETVVEVPNVSWQDIGGLENVKRELQETVQYPVEHPEKFEKFGMSPSKGVLFYGPPGCGKTLLAKAIANECQANFISIKGPELLTMWFGESEANVREIFDKARQAAPCVLFFDELDSIATQRGSSVGDAGGAADRVLNQLLTEMDGMSAKKTVFIIGATNRPDIIDPALLRPGRLDQLIYIPLPDDESRLQIFKAALRKSPIAKDVDLSALAKYTQGFSGADITEICQRACKYAIRENIEKDIERERRRSENPEAMEEDVEDEVAEISAAHFEESMKYARRSVSDADIRKYQAFAQTLQQSRGFGSEFRFSNTSAGGTATSDAFAAPAAAADEDDLYN

SEQ ID NO: 13555 - protein, 813 aa, Populus trichocarpa
MEDPSSSQPSSSTDPKSGKKDFSTAILERKKSPNRLVVDEAINDDNSVVAMHPATMEKLQFFRGDTVLIKGKKRRDTVCIVLAEEQCEEPKIRMNKVVRANLRVCLGDVVSVHQCPDVKYGKRVHILPIDDTIEGVTGNLFDAYLKPYFLESYRPVRKDDLFLVRGGMRSVEFKVIETDPGEYCVVAPDTEIFCEGEPIKREDEERLNEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEEVDLEKVAKDTHGYVGADLAALCTEAALQCIREKMDVIDLEDDTIDAEVLNSMAVTNEHFRTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDEASRLQIFKACLRKSPVSKDVDLTALARYTNGFSGADITEICQRACKYAIRENIEKDIEKEKRKQENPEAMEEDDVDEVPEIKAAHFEESMKYARRSVSDADIRKYQSFAQTLQQSRGFGTEFRFPDRPENAADGGAADPFASATTAADEDDLYS

SEQ ID NO: 13556 - protein, 804 aa, Zea mays
MASQGEPSSSDPKGKKDYSTAILERKKSPNRLVVDEATNDDNSVVALHPDTMERLQLFRGDTVLIKGKKRKDTVCIVLADETCEEPKVRMNKIVRKNLRVRLGDVVSVHQCPDVKYGKRVHILPIDDTIEGITGNLFDAFLKPYFLEAYRPLRKGDLFLVRGGMRSVEFKVIETDPAEYCIVAPDTEIFCEGEPIKREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLELIAKDTHGYVGADLAALCTEAALQCIREKMDIIDLEDETIDAEILNSMAVSNDHFKTALGTSNPSALRETVVEVPNVSWEDIGGLENVKRELQETVQYPVEHPDKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLHALAKYTQGFSGADITEICQRACKYAIRENIEKDIERERRRKDNPEAMEEDEVDDIAEIMAAHFEESMKYARRSVSDADIRKYQAFAQTLQQSRGFGSEFRFSDQPTAAAGAADPFASAADDDDLYS

SEQ ID NO: 13557 - protein, 810 aa, Phalaenopsis aphrodite
MANQDEASSSDPKSAKRDFSTAILERKKAPNRLIVDEAVNDDNSVVSIHTNTMEKLQFFRGDTILLKGKKRKDTICIVLADDSCEEPKIRMNKVVRSNLKVRLGDVVSVHQCQDVKYGKRVHILPIDDTIEGVTGNLFDAYLKPYFMEAYRPVRKGDLFLVRGGMRSVEFKIIETDPAEYCVVAPDTEIYCEGEPVNREDENRLDDVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEIGRLEVLRIHTKNMKLSDDVDLERIAKDTHGYVGADLAALCTEAALQCIREKMDVIDLEDETIDAEVLNSMAVTDEHFKTALGTSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEASRYQIFKACLRKSPISKEVDLGALAKYTQGFSGADITEICQRACKYAIRENIEKDIEKERRRNENPEAMEEDEGDEVAEIKAGHFEESMKYARRSVSDADIRKYQAFAQTLQQSRGFGSEFRFSDRPTATAGAAGGADPFATSAAADEDDLYS

SEQ ID NO: 13558 - protein, 810 aa, Saccharum officinarum
MASQGESSSSDPKGKKDYSTAILERKKSPNRLVVDEATNDDNSVVALHPDTMERLQLFRGDTVLLKGKKRKDTICIVLADDTCEEPKVRMNKVVRKNLRVRLGDVVSVHQCPDVKYGKRVHTLPIDDTIEGITGNLFDVFLKPYFLEAYRPLRKGDLFLVRGGMRSVEFKVIETDPPEYCIVAPDTEIFCEGEPVKREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAENVDLELNAKDTHGYVGADLAALCTEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRRKDNPEAMEEDEVDDIAEIKAAHFEESMKFARRSVSDADIRKYQAFAQTLQQSRGFGSEFRFPDQPTAAAGSAGAADPFASAAGAADDDDLYN

SEQ ID NO: 13559 - protein, 808 aa, Artemisia annua
MSNQPESSSSSEPKGKKDFSTAILERKKSPNRLVVDEAVNDDNSVVAMHPNTMEKLQLFRGDTILLKGKKRKDTVCIALADESCDEPKIRMNKVIRTNLRVRLGDVVSVHQCPDVKYGKRIHVLPLDDTIEGVTGDLFDAYLKPYFLEAYRPVRKGDHFLVRGGMRSVEFKVIETDPGEFCVVAPDTEIFCEGEPIKRDDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVIRIHTKNMKLSDDVDLEKIAKETHGYVGADLAALCTEAALQCIREKMDVIDLEDDSIDAEILNSMAVSNEHFQTALGTSNPSALRETVVEVPNCSWDDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEDSRHQIFKAAMRKSPVAKDVDLRALAKYTQGFSGADITEICQRACKYAIRENIEKDIERERRRNENPDSMDEDEDEVAEIKAAHFEESMKYARRSVSDADIRKYQAFAQTLQQSRGFGSEFRFTESSSGAAAAASDPFAASAGGADDDDLYS

SEQ ID NO: 13560 - protein, 808 aa, Aristolochia fimbriata
MADKGQASSSESKGKKDFSTAILERKKSPNRLIVDEAVNDDNSVVSMNPATMDKLQFFRGDTILIKGKKRRDTVCIVLVDDQCEEPKIRMNKVVRSNLRVRLGDVVSVHQCPDVKYGKRVHILPIDDTIEGVTGNLFDVYLKPYFLESYRPVRKGDLFLVRGGMRSVEFKVLETDPGEYCVVAPDTEIFCEGEPVKREDEERLNEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLERVAKDTHGYVGADLAALCTEAALQCIREKMDVIDLEDESIDAEVLNSMAVTDEHFKTALGSSNPSALRETVVEVPNVSWDDVGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMTAKKTVFIIGATNRPDIIDPALLRPGRLDQLIYIPLPDEASRLQIFKACLRKSPVSKDVDLAALAKYTHGFSGADITEICQRACKYAIRENIEKDIERERKRRDNPEAMEEDETDDVPEIKAAHFEESMKYARRSVSDADIRKYQLFAQTLQQSRGFGSEFRFPDRPENAEATTAADPFSSTTAAEDDDLYN

SEQ ID NO: 13561 - protein, 809 aa, Arnica chamissonis
MSNQPESSSSDPKGPKKDFSTAILERKKSPNRLVIDEAVNDDNSVVAMHPDTMEKLQLFRGDTILIKGKKRRDTVCIALADETCDEPKIRMNKVIRTNLRVRLGDVVSVHQCPDVKYGKRIHVLPLDDTIEGVTGDLFDAYLKPYFLEAYRPVRKGDHFLVRGGMRSVEFKVIETDPGEYCVVAPDTEIFCEGEPIKRDDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVIRIHTKNMKLSDDVDLERIAKETHGYVGADLAALCTEAALQCIREKMDVIDLEDESIDAEILNSMAVSNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDGGGAADRVLNQLLTEMDGMSAKKTVFIIGATNRPDIIDPALLRPGRLDQLIYIPLPDEDSRHQIFKAAVRKSPVSKDVDLRALAKYTQGFSGADITEICQRACKYAIRENIEKDIEKERKRSANPDSMEEDEDEVAEIKAAHFEESMKYARRSVSDADIRKYQAFAQTLQQSRGFGSEFRFPEAASGAAAGGGSDPFAASAGGADDDDLYN

SEQ ID NO: 13562 - protein, 806 aa, Orobanche aegyptiaca
MSHPAESSDPKSGKKDFSTAILERKKAANRLIVDEAVNDDNSVVALHPTTMEKLQLFRGDTILIKGKKRKDTVCIALADDTSEEPKIRMNKVVRSNLRVRLGDVVSVHQCPDVKYGKRVHILPLDDTIEGLTGDLFDAYLKPYFLEAYRPVRKGDHFLVRGGMRSVEFKVVETDPGEYCVVAPDTEIFCEGEPVRREDEDRLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVIRIHTKNMKLSDDVDLERIAKDTHGYVGADLAALCTEAALQCIREKMDVIDLDDDTIDAEILNSMAVSNEHFHTALGTSNPSALRETVVEVPNVSWQDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDGDSRHQIFKACLRKSPLSKDVDLRALADYTQGFSGADITEICQRACKYAIRENIEKDMERERRRRDNPDSMDEDADDDVSEIKPAHFEESMKYARRSVSDADIRKYQAFAQTLQQSRGFGTEFRFPESAAGGASGSNPFSAPVGGADEDDLYS

SEQ ID NO: 13563 - protein, 808 aa, Eutrema halophilum
MSNQTESSDSKPSKKDLSTAILEKKKSPNRLVVDEAINDDNSLVSLHPSTMEKLNFFNGDTILIKGKKRKDTVCIALSDESCEEPKIRMNKVVRSSLRVRLGDVVSVNQCPDIKYGKRVHILPVDDTIQGVTGNLFDAYLKPYFLGTYRPVRKGDLFLVRGGMRSVEFKVIEIDPPGEYCVVAPDTEIFCEGEPIKREEEERLDEIGYDDVGGVRKQMAQIRELVELPLRHPQLFKTIGVKPPKGILLYGPPGSGKTLIARAVANETGAFFFCINGPEIMSKMAGKSESNLRNAFEEAEKNAPSIIFIDEIDSIAPKRDKTNGEIEKRIVSQLLTLMDGLKSRAHVIVMGATNRPNSIDPALRRFGRFDREIDIGVPDETGRLEVVRIHTKNMKLAEDVDLERISKNTHGYVGADLAALCTEAALQCIREKMDVIDLEDDSIDAEILNSMAVTNEHFNTALGNSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEDSRLNIFKSCLRKSPVSKDVDLTVLAKYTRGFSGADITEICQRACKYAIRENIENDIEKQRRSRDGLEAMEEDEVAEIRGAHFEESMKFARRSVSDADIRKYQAFAQTLQQSRGFGTEFRFDPSTGTGRTTGGAATDPFAISAAAANDDDLYS

SEQ ID NO: 13564 - protein, 805 aa, Setaria italica
MASQGEPSSSDPKGKKDFSTAILERKKSPNRLVVDEATNDDNSVVALHPDTMERLQLFRGDTVLLKGKKRKDTICIVLADDTCEEPKIRMNKVVRKNLRVRLGDVISVHQCPDVKYGKRVHILPIDDTVEGITGNLFDAFLKPYFLEAYRPVRKSDLFLVRGGMRSVEFKVIETDPTEYCIVAPDTELFCEGEPIKREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDAALRRFGRFDREIDIGVPDEVGRLEVLRIHTKNMKLSEDVDLEHIAKDTHGYVGADLAALCTEAALQCIREKMDIIDLDDETIDAEILNSMSVSNDHFKTALGTSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIEMERRRKDDPEAMEEDEVDEIAEIRAVHFEESMKYARRSVSDADIRKYQAFAQTLQQSRGFGSEFRFPDQPTAAAADPFAAPAAAADDDDLYS

SEQ ID NO: 13565 - protein, 807 aa, Aristolochia fimbriata
MTNQAESSDSKGTKRDFSTAILERKKAPNRLVVDEAVNDDNSVVSLNPETMEKLQLFRGDTILLKGKKRRDTVCIALADDTCDEPKIRMNKVVRSNLRVRLGDVVSVHQCPDVKYGKRVHILPVDDTVEGVTGNLFDAYLKPYFLEAYRPVRKGDLFLVRGGMRSVEFKIIETDPTEYCVVSPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSEDVDLEKIAKNTHGYVGADLAALCTEAALQCIREKMDVIDLEDETIDAEILNSMAVTDEHFKTALGTSNPSALRETVVEVPNVTWEDVGGLENVKRELQETVQYPVEHPEKFEKFGMSPSKGVLFYGPPGCGKTLLAKAIANECQSNFISIKGPELLTMWFGESEANVREIFDKARQSAPCVLFFDELDSIATQRGSSAGDAGGAADRVLNQLLTEMDGMSAKKTVFIIGATNRPDIIDPALLRPGRLDQLIYIPLPDESSRHQIFKTCLRKSPVSKDVDLRALAKYTQGFSGADITEICQRACKYAIRENIEKDIERERRRNENPEAMEEDDAEEVAEIKASHFEESMKFARRSVSDADIRKYQAFAQTLQQSRGFGTEFRFAERSEAPGGSTASDPFASNAGAEDDDLYS

SEQ ID NO: 13566 - protein, 808 aa, Artemisia annua
MAANQPESSDSKGTKRDFSTAILERKKAPNRLVVDEAVNDDNSVVAIHPDTMEKLQLFRGDTILLKGKKRKDTICIALADETCEEPKIRMNKVVRANLRVRLGDVVSVHQCADVKYGKRVHILPVDDTIEGMTGNLFDAYLKPYFMEAYRPVRKGDFFLVRGGMRSVEFKVIETDPAEYCVVAPDTEIFCEGEPIRREDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLSDDVNLEKISKETHGYVGADLAALCTESALQCIREKMDVIDLEDETIDAEILNSMFVTNEHFQTALTTSNPSALRETVIEVPNVSWEDIGGLENVKRELQETVQYPVEHPEKFEKFGMSPSRGVLFYGPPGCGKTLLAKAIASECQANFISIKGPELLTMWFGESEANVREIFDKARGSAPCVLFFDELDSIATQRGSSQGDAGGAADRVLNQLLTEMDGMSAKKTVFIIGATNRPDIIDPALLRPGRLDQLIYIPLPDEGSRYSIFKSALRKSPVAKDVDLHALAKYTQGFSGADITEICQRACKYAIRENIEKDIEREKRRSENPEAMEEDVEDEVPEIKAAHFEESMKFARRSVSDGDIRKYQAFAQTLQQSRGFGSEFKFAETSSAAATGGSDPFAAPAGAADDDDLYN

SEQ ID NO: 13567 - protein, 359 aa, Cedrus atlantica
MAVTNEHFQTALGSSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLLYIPLPDESSRHQIFKACLRKSPVSKDVDLAALARYTQGFSGADITEICQRACKYAIRENIEKDIERERKRKENPEAMDEDDSEEVSEIKAAHFEESMKFARRSVSDADIRKYQAFAQTLQQSRGFGSEFRFADRPAGTAGATASDPFTTAENKDDDDLYS

SEQ ID NO: 13568 - protein, 810 aa, Panicum virgatum
MASQGEPSASASDPKGKKDYSTAILERKKSPNRLVVDEATNDDNSVVALHPDTMERLQLFRGDTVLLKGKKRKDTICIVLADETCEEPKVRMNKVVRQNLRVRLGDVVSVHQCQDVKYGKRVHILPIDDTVEGITGNLFDVFLKPYFLEAYRPVRKGDLFLVRGGMRSVEFKVIETDPAEYCIVAPDTEIFCDGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKARSHVIVMGATNRPNSIDPALRRFGRFDREIDIGVPDEVGRLEVLRIHTKNMKLAEDVNLELIAKDTHGYVGADLAALCTEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKEVDLNALAKYTQGFSGADITEICQRAVKYAIRENIEKDIERERRRKDNPEAMEEDEVDDIAEIKAAHFEESMKYARRSVSDADIRKYQAFAQTLQQSRGFGSEFRFSEQSTTAATTAAADPFASTGAADDDDLYS

SEQ ID NO: 13569 - protein, 815 aa, Zostera marina
MVAPGESSSSAVDPKGTKRDFSTAILERKKAANRLVVDEAVNDDNSVVSMNQDTMDKLQIFRGDTILLKGKKRRDTICIALADETCEEPKIKMNKVVRSNLRVRLGDVVSVHQCEDVKYGKRVHILPIDDSIEGVTGNLFDAYLKPYFLEAYRPVRKGDLFLVRGGMRSVEFKVIETDPAEYCVVSPDTEIFCEGEPVKREDEDNLNDIGYDDVGGVRKQMAQIRELVELPLRHPQLFKSIGVKPPKGILLFGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLSEDVDLERIGRDTHGYVGADLAALCTEAALQCIREKMDVIDLEDDSIDAEILNSMAVSDEHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGSGGDAGGAADRVLNQLLTEMDGMSAKKTVFIIGATNRPDIIDSALLRPGRLDQLIYIPLPDEASRFMIFKACLRKSPIAKDVDLNALAKYTQGFSGADITEICQRSCKYAIRENIEKDIEREKKRSDNPEAMEEDFVDDVAEIKAVHFEESMKFARRSVSDADIRKYQAFAQTLQQSRGFGTEFRFNERSDTDAPATAGASDPFASSDVAAADDDDLYS

SEQ ID NO: 13570 - protein, 785 aa, Flaveria ramosissima
MSNQAESSESKGTKRDYSTAILERKKAANRLVVDEAVNDDNSVVALHPETMEKLQLFRGDTILIKGKKRKDTICIALADDTCEEPKIRMNKVVRANLRVRLGDVVSVHQCPDVKYGKRVHILPVDDTIEGVTGNLFDAYLKPYFLEAYRPVRKGDFFLVRGGMRSVEFKVIETDPAEYCVVAPDTEIFCEGEPVRREDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLADDVDLEKISKETHGYVGADLAALCTESALQCIREKMDVIDLEDESIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSQGDAGGAADRVLNQLLTEMDGMSAKKTVFIIGATNRPDIIDPALLRPGRLDQLIYIPLPDEESRYQIFKSALRKSPVAKDVDLHALAKYTQGFSGADITEICQRACKYAIRENIEKDIEREKRRSENPEAMEEDVEDEVAEIKAAHFEESMKFARRSVSDADIRKYQAFAQTLQQSRGFGSEFRFSETSGAA

SEQ ID NO: 13571 - protein, 804 aa, Pinus taeda
MAHKGESSEPKGVKRDFSTAILERKKAPNRLVVDEAINDDNSVVCLHPDTMEKLQLFRGDTILIKGKKRKDTICIALADETCEEPRIRMNKVVRSNLRVRLGDVVSVHQCPDVKYGKRVHILPIDDTIEGVTGNLFDAYLKPYFMEAYRPVRKGDLFLVRGGMRSVEFKVIETDPGEYCVVSPDTEIFCEGEPVKREDEDRLDEVGYDDVGGVRRQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTHGEVERRIVSQLLTLMDGLKARAHVIVIGATNRPNSIDPALRRFGRFDREIDIGVPDEVGRLEVLRIHTKNMKLSDDVDLERIAKDTHGYVGADLAALCTEAALQCIREKMDVIDLEDETIDAEILNSMAVTNEHFQTALGTSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDESSRLQIFKACLRKSPVAKDVDLTALARYTQGFSGADITEICQRACKYAIRENIEQDIERERKRKENPEAMDEDDSEELSEIKAAHFEESMKYARRSVSDADIRKYQAFAQTLQQSRGFGTEFRFAERPGGTAAAGSSEPAENKEDDDLYS

SEQ ID NO: 13572 - protein, 805 aa, Pseudotsuga menziesii
MADKGESSEPKGTKRDYSTAILERKKAANRLVVDEAINDDNSVVSLHPDTMEKLQLFRGDTILIKGKKRKDTICIALADETCEEPRIKMNKVVRSNLRVRLGDVVSVHQCPDVKYGKRVHILPIDDTIEGVTGNLFDAYLKPYFMEAYRPVRKGDLFLVRGGMRSVEFKVIETDPGEYCVVSPDTEIFCEGEPVKREDEDRLDEVGYDDVGGVRRQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSEDVDLERIAKDTHGYVGADLAALCTEAALQCIREKMDVIDLEDETIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDESSRLQIFKACLRKSPVSKHVNLTDLARYTQGFSGADITEICQRACKYAIRENIEKDIERERKRKENPEAMEEDENEVAEIKAAHFEESMKYARRSVSDADIRKYQAFAQTLQQSRGFGSEFRFADRPASTSAAASDPFTTADNKEDDDLYS

SEQ ID NO: 13573 - protein, 813 aa, Hordeum vulgare
MAAPTPQGEASSSDPKSKKDYSTAILERKKSPNRLVVDEATNDDNSVVALHPDTMERLQLFRGDTVLLKGKKRKDTICIVLADDTCEEPKIRMNKTVRKNLRVRLGDVVSVHQCPDVKYGKRVHILPIDDTVEGITGNLFDAFLKPYFLEAYRPLRKGDLFLVRGGMRSVEFKVIETDPAEYCIVAPDTEIFCDGEPVKREDEERLDDVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVELEHISRDTHGYVGADLAALCTEAALQCIREKMDIIDLEDETIDAEILNSMAVTNDHFKTALTTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMNAKKTVFIIGATNRPDIIDPALLRPGRLDQLIYIPLPDVDSRHQIFKACLRKSPLAKDIDLSALAKYTQGFSGADITEICQRACKYAIRENIEKDIERERRRKDNPEAMEEDEVDEVAEIRAAHFEESMKYARRSVSDADIRKYQAFAQTLQQSRGFGSEFRFADQPAAGAASAAAADPFASAASAADDDDLYS

SEQ ID NO: 13574 - protein, 809 aa, Pennisetum glaucum
MASQGEPSASASDPKGKKDYSTAILERKKSPNRLVVDEATNDDNSVVALHPDTMERLQLFRGDTVLLKGKKRKDTICIVLADETCEEPKVRMNKVVRQNLRVRLGDVVSVHQCQDVKYGKRVHILPIDDSVEGITGNLFDAFLKPYFLEAYRPVRKGDLFLVRGGMRSVEFKVIETDPAEYCIVAPDTEIFCDGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKARSHVIVMGATNRPNSIDPALRRFGRFDREIDIGVPDEVGRLEVLRIHTKNMKLAEDVNLELIAKDTHGYVGADLAALCTEAALQCIREKMDIIDLEDETIDAEILNSMAVTNDHFKTALGTSNPSALRETVVEVPNVSWEDIGGLDNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKEVDLNALAKYTQGFSGADITEICQRAVKYAIRENIEKDIERERRRKDNPEAMEEDEVDDIAEIKAAHFEESMKYARRSVSDADIRKYQAFAQTLQQSRGFGSEFRFEQSTTAGPAAAADPFASTAGADDDDLYS

SEQ ID NO: 13575 - protein, 805 aa, Ambrosia trifida
MSNQPESSDSKGGKKDFSTAILERKKAPNRLVVDEALNDDNSVVCMHPETMEKLQLFRGDTILLKGKKRRDTICIALADDTCEEPKIRINKVVRSNLRVRLGDVVSVHQCADVKYGKRVHILPIDDTIEGVTGNLFDAYLKPYFLEAYRPVRKGDYFLVRGGMRSVEFKVIETDPAEYCVVAPDTEIFCEGEPVRREDEDRLDEIGYDDVGGVRKQMAQIRELVELPLRHPQLFKSIGVKPPKGILLYGPPGSGKTLIARAVANETGAFFFCINGPEIMSKMAGESESNLRKAFEEAEKNAPSIIFIDELDSIAPKREKTHGEVERRIVSQLLTLMDGLKSRAHVIVMGATNRPNSIDPALRRFGRFDREIDIGVPDEIGRLEVLRIHTKNMKLSDDVGLEKVGKDTHGYVGADLAALCTEAALQCIREKMDVIDLEDESIDAEILNSMAVTNEHFQTALGTSNPSALRETVVEVPNVSWEDIGGLENVKRELQETVQYPVEHPEKFEKFGMAPSKGVLFYGPPGCGKTLLAKAIANECQANFISIKGPELLTMWFGESEANVREIFDKARGSAPCVLFFDELDSIATQRGSSQGDAGGAADRVLNQLLTEMDGMSAKKTVFIIGATNRPDIIDPALLRPGRLDQLIYIPLPDEESRYQIFKSALRKSPISKDVDLRALARFTQGFSGADITEICQRACKYAIRENIEKDIEREKRISENPEAMEEDMDDEVAEIKAAHFEESMKFARRSVSDADIRKYQAFAQTLQQSRGIGSEFRFSETSGRAAASDPFAAPAGTVDDDDLYN

SEQ ID NO: 13576 - protein, 807 aa, Abies balsamea
MAGKGESSEPKGIKRDYSTAILERKKAANRLVVDEAINDDNSVVCLHPDTMEKLQLFRGDTILIKGKKRKDTICIALADETCEEPRIRMNKVVRSNLRVRLGDVVSVHQCPDVKYGKRVHILPIDDTIEGVTGNLFDAYLKPYFMEAYRPVRKGDLFLVRGGMRSVEFKVIETDPGEYCVVSPDTEIFCEGDPVKREDEDRLDEVGYDDVGGVRRQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSEDVDLERIAKDTHGYVGADLAALCTEAALQCIREKMDVIDLEDETIDAEILNSMAVTNEHFQTALGSSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDETSRLQIFKSCLRKSPVSKDVDLAALARYTQGFSGADITEICQRSCKYAIRENIEQDIERERKRKENPEAMDEDDSEEISEIKAAHFEESMKYARRSVSDADIRKYQAFAQTLQQSRGFGSEFRFADRPATTAGAAASDPFTTADNKEDDDLYS

SEQ ID NO: 13577 - protein, 809 aa, Ambrosia trifida
MTEPSSSDPKAPQQPQKKDFSTAILERKKSPNRLVVDEAVNDDNSVVAMHPATMEKLQLFRGDTILIKGKKRKDTVCIALADETCEEPKIRMNKVVRTNLRIRLGDVVSVHQCPDVKYGKRIHVLPLDDTIEGVTGDLFDAFLKPYFLEAYRPVRKGDHFLVRGGMRSIEFKVIETDPGEYCVVAPDTEIFCEGEPIKRDDEDRLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLSDDVDLEKISKETHGYVGADLAALCTEAALQCIREKMDVIDLEDESIDAEILNSMAVTNEHFSTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEDSRHQIFKAAMRKSPVSKDVDLRALARYTQGFSGADITEICQRACKYAIRENIEKDIERERKRSENPDSMDEDEDDVAEIKAAHFEESMKYARRSVSDADIRKYQAFAQTLQQSRGFGSEFRFSETSGGAAAAASDPFAASGGGADDDDLYS

SEQ ID NO: 13578 - protein, 791 aa, Pseudotsuga menziesii
DFSTAILERKKAANRLVVDEAINDDNSVVSLHPDTMEKLQLFRGDTILIKGKKRKDTICIALADETCEEPRIRMNKVVRSNLRVRLGDVVSVHQCPDVKYGKRVHILPIDDSIEGVTGNLFDAYLKPYFMEAYRPVRKGDLFLVRGGMRSVEFKVIETDPGEYCVVSPDTEIFCEGEPVKREDEDRLDEIGYDDVGGVRRQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLSEDVDLERIAKDTHGYVGADLAALCTEAALQCIREKMDVIDLEDETIDAEILNSMAVTNEHFQTALGSSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDESSRLQIFKACLRKSPISKDVDLTALARYTQGFSGADITEICQRACKYAIRENIEKDIERERKIKENPEAMEEDDTEEVAEIKAAHFEESMKYARRSVSDADIRKYQAFAQTLQQSRGFGSEFRFADRPAGTTAAASDPFTTSDNKEDDDLYS

SEQ ID NO: 13579 - protein, 810 aa, Panicum virgatum
MASQGEPSASASDAKGKKDYSTAILERKKSPNRLVVDEATNDDNSVVALHPDTMERLQLFRGDTVLLKGKKRKDTICIVLADDTCEEPKVRMNKVVRQNLRVRLGDVVSVHQCQDVKYGKRVHILPIDDTVEGITGNLFDVFLKPYFLEAYRPVRKGDLFLVRGGMRSVEFKVIETDPAEYCIVAPDTEIFCDGEPIKREDEERLDEVGYDDVGGVRKQMAQIRELVELPLRHPQLFKSIGVKPPKGILLYGPPGSGKTLIARAVANETGAFFFLINGPEIMSKLACESESNLRKAFEEAEKNAPSIIFIDEIDSIAPKREKTNGEVERRIVSQLLTLMDGLKARSHVIVMGATNRPNSIDPALRRFGRFDREIDIGVPDEVGRLEVLRIHTKNMKLAEDVNLELIAKDTHGYVGADLAALCTEAALQCIREKMDIIDLEDETIDAEILNSMAVTNDHFKTALGTSNPSALRETVVEVPNVSWEDIGGLDNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKEVDLNALAKYTQGFSGADITEICQRAVKYAIRENIEKDIERERRRKDNPEAMEEDEVDDIAEIKAAHFEESMKYARRSVSDADIRKYQAFAQTLQQSRGFGSEFRFSEQSTTAATTAAADPFASAGAADDDDLYS

SEQ ID NO: 13580 - protein, 812 aa, Avena sativa
MATPTPQGEASSSDPKSKKDFSTAILERKKSPNRLVVDEATNDDNSVVALHPDTMEKLQLFRGDTVLLKGKKRKDTICIVLADDTCEEAKVRMNKTVRKNLRVRLSDVVSVHQCPDVKYGKRVHILPVDDTVEGITGNLFDAFLKPYFLEAYRPLRKGDLFLVRGGMRSVEFKVIETDPAEYCIVAPDTEIFCDGEPIKREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVELEHISRDTHGYVGADLAALCTEAALQCIREKMDIIDLEDETIDAEILNSMAVTNDHFKTALTTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMNAKKTVFIIGATNRPDIIDPALLRPGRLDQLIYIPLPDVESRLQIFKACLRKSPVAKDVDLDALAKYTQGFSGADITEICQRACKYAIRENIEKDIERERRKKDNPEAMEEDETDEIAEIRAAHFEESMKYARRSVSDADIRKYQAFAQTLQQSRGFGSEFRFPDAPASGTAAAAADPFASSAAAAEDDDLYS

SEQ ID NO: 13581 - protein, 472 aa, Pinus pinaster
MDGLKSRAHVIVIGATNRPNSIDPALRRFGRFDREIDIGVPDEVGRLEVLRIHTKNMKLSDDVDLERIAKDTHGYVGADLAALCTEAALQCIREKMDVIDLEDETIDAEILNSMAVTNEHFQTALGTSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDESSRLQIFKACLRKSPVAKDVDLTALARYTQGFSGADITEICQRACKYAIRENIEQDIERERKRKENPEAMDEDDSEGVSEIKAAHFEESMKYARRSVSDADIRKYQAFAQTLQQSRGFGTEFRFAEKPGGTAAAGSSEPFTGVENKEDDDLYS

SEQ ID NO: 13582 - protein, 525 aa, Flaveria ramosissima
MSKLAGESESNLRKAFEEAEKNAPSIIFIDEIDSIAPKREKTNGEVERRIVSQLLTLMDGLKSRAHVIVIGATNRPNSIDPALRRFGRFDREIDIGVPDEVGRLEVLRIHTKNMKLSEDVDLEKISKETHGYVGADLAALCTEAALQCIREKMDVIDLEDESIDAEILNSMAVTNEHFATALGTSNPSALRETVVEVPNVSWDDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEESRYSIFKAAMRKSPVSKDVDLRALAKYTQGFSGADITEICQRACKYAIRENIEKDIERERKRSENPDSMDEDEDDVAEIKAAHFEESMKYARRSVSDADIRKYQAFAQTLQQSRGFGSEFRFPEATSGGAADPFAASAGGANDDDLYS

SEQ ID NO: 13583 - protein, 468 aa, Pinus pinaster
MDGLKARAHVIVIGATNRPNSIDPALRRFGRFDREIDIGVPDEVGRLEVLRIHTKNMKLSDDVDLERIAKDTHGYVGADLAALCTEAALQCIREKMDVIDLEDETIDAEILNSMAVTNEHFQTALGTSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDESSRLQIFKACLRKSPVAKDVDLTALARYTQGFSGADITEICQRACKYAIRENIEQDIERERKRKENPEAMDEDDSEEVSEIKAAHFEESMKYARRSVSDADIRKYQAFAQTLQQSRGFGTEFRFADRPGTAAAGSSEPAENKEDDDLYS

SEQ ID NO: 13584 - protein, 471 aa, Pinus pinaster
MDGLKSRAHVIVIGATNRPNSIDPALRRFGRFDREIDIGVPDEVGRLEVLRIHTKNMKLSDDVDLERIAKDTHGYVGADLAALCTEAALQCIREKMDVIDLEDETIDAEILNSMAVTNEHFQTALGTSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDESSRLQIFKACLRKSPVAKDVDLTALARYTQGFSGADITEICQRACKYAIRENIEQDIERERKRKENPEAMDEDHSEEVSEIKAAHFEESMKYARRSVSDADIRKYQAFAQTLQQSRGFGTEFRFAERPDTVAAGSSEPFNGTENKEDDDLYS

SEQ ID NO: 13585 - protein, 810 aa, Arnica chamissonis
MSNQPESSSSEPKGPKKDFSTAILERKKSPNRLVVDEAVNDDNSVVAMHPTTMEKLQLFRGDTILIKGKKRRDTVCIALADESCDEPKIRMNKVIRTNLRIRLGDVVSVHQCPDVKYGKRIHVLPLDDTIEGVTGDLFDAYLKPYFLEAYRPVRKGDHFLVRGGMRSVEFKVIETDPGEYCVVAPDTEIFCEGEPIKRDDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVIRIHTKNMKLSDDVDLEKIAKETHGYVGADLAALCTEAALQCIREKMDVIDLEDESIDAEILNSMAVSNDHFQTALGTSNPSALRETVVEVPNCSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEDSRHQIFKAAMRKSPVSKDVDLRALAKYTQGFSGADITEICQRACKYAIRENIEKDIEKERKRSENPDSMDEDEEEVAEIKAAHFEESMKYARRSVSDADIRKYQAFAQTLQQSRGFGSEFRFPEAASGAAAGGGSSDPFSATAGGADDDDLYN

SEQ ID NO: 13586 - protein, 810 aa, Setaria italica
MASQGEPSASASDPKGKKDYSTAILERKKSPNRLVVDEATNDDNSVVALHPDTMERLQLFRGDTVLLKGKKRKDTICIVLADETCEEPKVRMNKVVRQNLRVRLGDVVSVHQCQDVKYGKRVHILPIDDTVEGITGNLFDAFLKPYFLEAYRPVRKGDLFLVRGGMRSVEFKVIETDPAEYCIVAPDTEIFCDGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKARSHVIVMGATNRPNSIDPALRRFGRFDREIDIGVPDEVGRLEVLRIHTKNMKLAEDVNLELIAKDTHGYVGADLAALCTEAALQCIREKMDIIDLEDETIDAEILNSMAVTNDHFKTALGTSNPSALRETVVEVPNVSWEDIGGLDNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKEVDLNALAKYTQGFSGADITEICQRAVKYAIRENIEKDIERERRRKDNPEAMEEDEVDDIAEIKAAHFEESMKYARRSVSDADIRKYQAFAQTLQQSRGFGSEFRFSEQSTTAGPAAAADPFASTGGADDDDLYS

SEQ ID NO: 13587 - protein, 812 aa, Lactuca sativa
MSNQPESSSSEPKGPPAAKKDFSTAILERKKSPNRLVVDEAVNDDNSVVAMHPNTMEKLQLFRGDTILIKGKKRRDTVCIALADETCDEPKIRMNKVIRTNLRVRLGDVVSVHQCPDVKYGKRIHVLPLDDTIEGVTGDLFDAYLKPYFLEAYRPVRKGDHFLVRGGMRSVEFKVIETDPGEYCVVAPDTEIFCEGEPIKRDDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVIRIHTKNMKLSDDVDLEKIAKETHGYVGADLAALCTEAALQCIRKKMDVIDLEDDSIDAEILNSMAVSNEHFQTALGTSNPSALRETVVEVPNCSWDDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEDSRHQIFKAAMRKSPVSKDVDLRALAKYTQGFSGADITEICQRACKYAIRENIEKDIERERKRSENPDSMDEDEDEVAEIKAAHFEESMKYARRSVSDADIRKYQAFAQTLQQSRGFGSEFRFPEAAGAAAAGGSDPFAAAAGGGGDDDDLYS

SEQ ID NO: 13588 - protein, 807 aa, Picea glauca
MAHKGESSEPKGTKRDYSTAILERKKAANRLVVDEAINDDNSVVCLHPDTMEKLQLFRGDTILIKGKKRKDTICIALADETCEEPRIRMNKVVRSNLRVRLGDVVSVHQCPDVKYGKRVHILPMDDTIEGVTGNLFDAYLKPYFMEAYRPVRKGDLFLVRGGMRSIEFKVIETDPGEYCVVSPDTEIFCEGEPIKRDDEDRLDEVGYDDVGGVRRQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSEDVDLERIAKDTHGYVGADLAALCTEAALQCIREKMDVIDLEDETIDAEILNSMSVTNEHFQTALGSSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDESSRLQIFKACLRKSPVSKDVDLTALARYTQGFSGADITEICQRACKYAIRENIEQDIERERKRKDNPEAMDEDDSEEVSEIKAAHFEESMKYARRSVSDADIRKYQAFAQTLQQSRGFGSEFRFADRPATTPGAGASDPFTTEDTKEDDDLYS

SEQ ID NO: 13589 - protein, 806 aa, Taxus baccata
MAHKGESSEPKGTKRDFSTAILDRKKAANRLVVDEAINDDNSVVCLHPDTMEKLQLFRGDTILIKGKKRKDTICIALADETCEEPKIRMNKVVRSNLRIRLGDVVSVHQCPDVKYGKRVHILPIDDTIEGVTGNLFDAYLKPYFLEAYRPVRKGDLFLVRGGMRSIEFKVIETDPGEYCVVSPDTEIFCEGEPVKREDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIEATNRPNSIDPTLRRFGRFDREIDIGVPDEVGRLEVLRIHTKNMKLSDDVDLERIAKDTHGYVGADLAALCTEAALQCIREKMDVIDLEDETIDAEILNSMAVTNEHCQTALGSSNPSALRETVVEVPNVTWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQHGSSVGDAGGAADRVLNQLVTEMDGMTAKKTVFIIGATNRPDIIDPALLRPGRLDQLIYIPLPDESSRYQIFKSCLRKSPVSKDVDLMALARYTQGFSGADITEICQRACKYAIRENIEKDIERERKRSENPEAMDEDDSDEVSEIKAAHFEESMKYARRSVSDADIRKYQAFAQTLQQSRGFGSEFRFPDRPVGTAVGATDAFATEDNKDDDDLYS

SEQ ID NO: 13590 - protein, 810 aa, Populus trichocarpa
MADPSSSQPSPSTDPKKDYSTAILERKKSPNRLVIDEAINDDNSVVAMHPATMEKLQFFRGDTVLIKGKKRKDTVCIVLADEQCEEPKIRLNKVVRANLRVRLGDVVSVHQCPDVKYGKRVHILPIDDTIEGVTGSLFDAYLKPYFLESYRPVRKGDLFLVRGGMRSVEFKVIETDPGEYCVVAPDTEIFCEGEPIKREDEERLNEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDELDSIAPKREKTHGEVERRIVSQLLTLMDGLKSRAHVIVMGATNRPNSIDPALRRFGRFDREIDIGVPDEVGRLEVLRIHTKNMKLAEDVDLERVAKDTHGYVGADLAALCTEAALQCIREKMDVIDLEDETVDAEVLNSMAVTNDHFQTALGTSNPSALRETVVEVPNVSWEDIGGLENIKRELQETVQYPVEHPEKFEKFGMSPSKGVLFYGPPGCGKTLLAKAIANECQANFISVKGPELLTMWFGESEANVREIFDKARQSAPCVLFFDELDSIATQRGNSSGDAGGAADRVLNQLLTEMDGMTAKKTVFIIGATNRPDIIDPALLRPGRLDQLIYIPLPDEASRLQIFKACLRKSPVSRDVDLAALARYTHGFSGADITEICQRACKYAIRENIEKDIEKEKRKQDNPEAMEEDDVDEVPEITAAHFEESMKFARRSVSDADIRKYQLFAQTLQQSRGFGTEFRFPDRAENVAGEGATDPFAPATIAAEEDDLYS

SEQ ID NO: 13591 - protein, 604 aa, Ambrosia trifida
MNNQPESSDSKGGKKDFSTAILERKKAPNRLVVDEALNDDNSVVCMHPETMEKLQLFRGDTILLKGKKRRDTICIALADDTCEEPKIRINKVVRSNLRVRLGDVVSVHQCADVKYGKRVHILPIDDTIEGVTGNLFDAYLKPYFLEAYRPVRKGDYFLVRGGMRSVEFKVIETDPAEYCVVAPDTEIFCEGEPVRREDEDRLDEIGYDDVGGVRKQMAQIRELVELPLRHPQLFKSIGVKPPKGILLYGPPGSGKTLIARAVANETGAFFFCINGPEIMSKMAGESESNLRKAFEEAEKNAPSIIFIDELDSIAPKREKTHGEVERRIVSQLLTLMDGLKSRAHVIVMGATNRPNSIDPALRRFGRFDREIDIGVPDEVGRLEVLRIHTKNMKLSDDVDLEKVAKDTHGYVGADLAALCTEAALQCIREKMDVIDLEDESIDAEILNSMAVTNEHFQTALGTSNPSALRETVVEVPNVSWEDIGGLENVKRELQETVQYPVEHPEKFEKFGMAPSKGVLFYGPPGCGKTLLAKAIANECQANFISIKGPELLTMWFGESEANVREISTRLVDLLLVSSFLMNLIPSQPREGVVKEMLAVQLTEF

SEQ ID NO: 13592 - protein, 465 aa, Distylium racemosum
MDGLKSRAHVIVMGATNRPNSIDPALRRFGRFDREIDIGVPDEIGRLEVLRIHTKNMKLAEDVDLEHIAKDTHGYVGADLAALCTEAALQCIREKMDVIDLEDETIDAEVLNSMAVTNEHFQTALGTSNPSALRETVVEVPNVSWEDIGGLENIKRELQETVQYPVEHPEKFEKFGMSPSKGVLFYGPPGCGKTLLAKAIASECQANFISIKGPELLTMWFGESEANVRDVFDKARQSAPCVLFFDELDSIATQRGSSSGDAGGAADRVLNQLLTEMDGMTAKKTVFIIGATNRPDIIDPALLRPGRLDQLIYIPLPDEASRLQIFKACLRKSPVSKDVDIATLARYTHGFSGADITEICQRACKYAIREHIEKDIEREKKRRENPEAMDEDESDVAEIKAAHFEEAMKYARRSVSDADIRKYQAFAQTLQQSRGFGSEFRFADRPATTTGGTGNTDAFVCGRSW

SEQ ID NO: 13593 - protein, 789 aa, Flaveria ramosissima
MSDQPESSDSKGTKRDFSTAILERKKAANRLVVDEAINDDNSVVSLHPETMEKLQLFRGDTILIKGKKRRDTICIALADDTCEEPKIRMNKVVRSNLRVRLGDVVSVHQCPDVKYGKRVHILPIDDTIEGVTGNLFDAYLKPYFLEAYRPVRKGDYFLVRGGMRSVEFKVIETDPAEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKMAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLSDDVDLEKVAKDTHGYVGADLAALCTEAALQCIREKMDVIDLEDESIDAEILNSMAVTNEHFQTALGTSNPSALRETVVEVPNVSWEDIGGLENVKRELQETVQYPVEHPEKFEKFGMAPSKGVLFYGPPGCGKTLLAKAIANECQANFISIKGPELLTMWFGESEANVREIFDKARGSAPCVLFFDELDSIATQRGSSQGDAGGAADRVLNQLLTEMDGMSAKKTVFIIGATNRPDIIDPALLRPGRLDQLIYIPLPDEESRYQIFKSALRKSPISKDVDLRALAKYTQGFSGADITEICQRACKYAIRENIEKDIEREKRRSENPEAMEEDVEDEVAEIKAAHFEESMKFARRSVSDADIRKYQAFAQTLQQSRGIGSEFRFSETSGRAAASD

SEQ ID NO: 13594 - protein, 810 aa, Arnica chamissonis
MTNQTESSSSDAKGPAPQKKDFSTAILERKKSPNRLVVDEAVNDDNSVVAMHPATMEKLQLFRGDTILIKGKKRRDTVCIALADETCDEPKIRMNKVIRTNLRIRLGDVVSVHQCPDVKYGKRIHVLPLDDTIEGVTGDLFDTFLKPYFLEAYRPVRKGDHFLVRGGMRSIEFKVIETDPGEYCVVAPDTEIFCEGEPIKRDDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLSDDVDMEKISKETHGYVGADLAALCTEAALQCIREKMDVIDLEDESIDAEILNSMAVTNEHFSTALGTSNPSALRETVVEVPNVSWQDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEDSRYQIFKAAMRKSPVSKDVDLSALAKYTQGFSGADITEICQRACKYAIRENIEKDIERERKRSENPDSMDEDADDDVAEIKAAHFEESMKYARRSVSDADIRKYQAFAQTLQQSRGFGSEFRFSETSGGAAASDPFAASAGGADDDDLYS

SEQ ID NO: 13595 - protein, 795 aa, Podocarpus macrophillus
TKRDYSTAILERKKAPNRLVVDEAVNDDNSVVSLHPDTMEKLQLFRGDTILIKGKKRKDTICIALADETCDEPKIRMNKVVRSNLRVRLGDVVSVHQCPDVKYGRRVHILPIDDTIEGLTGNLFDAFLKPYFLEAYRPVRKGDLFLVRGGMRSVEFKVIETDPGEYCVVSPDTEIFCEGEPVKREDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSDDVDLERIAKDTHGYVGADLAALCTEAALQCIREKMDVIDLEDETIDAEILNSMAVTNEHFQTALGASNPSALRETVVEVPNVSWEDIGGLDNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDEASRYQIFKSCLRKSPVSKDVDLMALARYTHGFSGADITEICQRACKYAIRENIEKDIEHERKRRDNPEAMEEDDSDEVSEIKPAHFEEAMKYARRSVSDADIRKYQAFAQTLQQSRGFGSEFRFPDRPAGTAGAGASDAFVTADNKDEDDLYS

SEQ ID NO: 13596 - protein, 805 aa, Artemisia annua
MADHAESSDPKGAKRDFSTAILERKKAPNRLVVDEAINDDNSVVAMHTTTMEKLQLFRGDTILIKGKKRRDTICIALADDTCDEPKIRMNKVVRSNLRVRLGDVVSIHQCPDVKYGKRVHILPIDDTIEGVTGNLFDAYLKPYFLEAYRPVRKGDFFLVRGGMRSVEFKVIETEPAEYCVVAPDTEIFCEGDPVIREDEDRLDEVGYDDVGGVRKQMAQIRELVELPLRHPQLFKSIGVKPPKGILLYGPPGSGKTLIARAVANETGAFFFCINGPEIMSKMAGESESNLRKAFEEAEKNAPSIIFIDELDSIAPKREKTHGEVERRIVSQLLTLMDGLKARAHVIVIGATNRPNSIDAALRRFGRFDREIDIGVPDEVGRLEVLRIHTKNMKLAEDVDLEKAAKETHGYVGADLAALCTEAALQCIREKMDVIDLEDESIDAEILNSMAVSNEHFQTALTTSNPSALRETVVEVPNVSWEDIGGLENVKRELQETVQYPVEHPEKFEKFGMAPSRGVLFYGPPGCGKTLLAKAIASECQANFISIKGPELLTMWFGESEANVREIFDKARGSAPCVLFFDELDSIATQRGGSQGDAGGAADRVLNQLLTEMDGMTAKKTVFIIGATNRPDIIDPALLRPGRLDQLIYIPLPDEESRYQIFKSALRKSPLAKGVDLRALAKYTQGFSGADITEICQRACKYAIRENIEKDIEKERRKSENPEAMEEDTEDEVPEIKAAHFEESMKFARRSVSDADIRKYQVFAQTLQQSRGIGSEFRFSEASGRAAASDPFAAPAGAADDDDLYN

SEQ ID NO: 13597 - protein, 814 aa, Fragaria vesca
MADPSSSGANSAQPSSTDPKAKKDFSTAILERKKSPNRLVVDEAINDDNSVVSLHPATMEKLQFFRGDTVLIKGKKRKDTVCIVLADEQCDEPRIRMNKVVRANLRVRLGDVVSVHTCPDVKYGKRVHILPIDDTIEGVSGNLFDAYLKPYFLESYRPVRKGDLFLVRGGMRSVEFKVIDTDPGEYCVVAPDTEIFCEGEPVKREDEEKLNEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDELDSIAPKREKTQGEVERRIVSQLLTLMDGLKSRAHVIVMAATNRPNSIDPALRRFGRFDREIDIGVPDEIGRLEVLRIHTKNMKLAEDVDLERVSKDTHGYVGADLAALCTEAALQCIREKMDVIDLEDEEIDAEVLNSMAVTNEHFQTALGASNPSALRETVVEVPNVSWDAIGGLDNVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGGSVGDAGGAADRVLNQLLTEMDGMSAKKTVFIIGATNRPDIIDPALLRPGRLDQLIYIPLPDEASRLQIFKACLRKSPVNRDVDLAVLARHTHGFSGADITEICQRACKYAIRENIEKDIEKERRKAENPEAMEEDDIDEVPEIKPAHFEESMKFARRSVSDADIRKYQAFAQTLQQSRGIGSDFRFPQTGNTAGAAADPFASASAAADDDDLYS

SEQ ID NO: 13598 - protein, 814 aa, Vitis vinifera
MADPSSSGPSSSPEVKSVKKDFSTAILERKKSPNRLVVDEAVNDDNSVVSMNPATMEKLQFFRGDTVLIKGKKRKDTVCIVLVDEQCEEPKIRMNKVVRANLRVRLGDVVSVHQCPDVKYGKRVHILPIDDTIEGVTGNLFDAYLKPYFLESYRPVRKGDLFLVRGGMRSVEFKVIETDPGEYCVVAPDTEIFCEGEPIKREDEERLNEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDELDSIAPKREKTHGEVERRIVSQLLTLMDGLKTRAHVIVIGATNRPNSIDPALRRFGRFDREIDIGVPDEVGRLEVLRIHTKNMKLSDDVDLERVAKDTHGYVGADLAALCTEAALQCIREKMDVIDLEDETIDAEVLNSMAVTNEHFQTALGSSNPSALRETVVEVPNVSWEDIGGLDNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDEASRLQIFKACLRKSPVSRDVDLVALARYTHGFSGADITEICQRSCKYAIRENIEKDIERERKKTENPEAMEEDDVDDVPEIKAAHFEESMKFARRSVSDADIRKYQLFAQTLQQSRGFGSEFRFPDQPNNATAASTAADPFSSAAAAGDDDDLYS

SEQ ID NO: 13599 - protein, 812 aa, Festuca arundinacea
MATPTPQGEASSSDPKAAKKDYSTAILERKKSPNRLVVDEATNDDNSVVALHPDTMERLQLFRGDTVLLKGKKRKDTICIVLADDTCEEPKVRMNKTVRKNLRVRLGDVVSVHQCPDVKYGKRVHILPIDDTVEGITGNLFDAFLKPYFLEAYRPLRKGDLFLVRGGMRSVEFKVIETDPAEYCIVAPDTEIFCDGEPIKREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVELEHISRDTHGYVGSDLAALCTEAALQCIREKMDIIDLDDETIDAEILNSMAVTNDHFKTALTTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMNAKKTVFIIGATNRPDIIDPALLRPGRLDQLIYIPLPDVESRLQIFKACLRKSPVAKDVDLDALAKYTQGFSGADITEICQRSCKYAIRENIEKDIERERRKKDNPEAMEEDETDEIAEIRAAHFEESMKYARRSVSDADIRKYQAFAQTLQQSRGFGSEFRFPDAPASGAAAAADPFASTAAAAEDDDLYS

SEQ ID NO: 13600 - protein, 816 aa, Sequoia sempervirens
TPNNQYLLRSDGSQGRIVRSERNERDFSTAILERKKAANRLVVDEAINDDNSVVCLHPETMEKLQLFRGDTILIKGKKRKDTICIALADETCEEPKIRMNKVVRSNLRVRLGDVVSVHQCPDVKYGKRVHILPIDDTIEGVTGNLFDAYLKPYFLEAYRPVRKGDLFLVRGGMRSVEFKVIETDPGEYCVVSPDTEIFCEGEPVKREDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSDDVDLERIAKDTHGYVGADLAALCTEAALQCIREKMDVIDLEDETIDAEILNSMAVTNEHFQTALGSSNPSALRETVVEVPNVTWQDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSAGDAGGAADRVLNQLLTEMDGMTAKKTVFIIGATNRPDIIDPALLRPGRLDQLIYIPLPDESSRYQIFKSCLRKSPVSKDVDLMALARYTQGFSGADITEICQRACKYAIRENIEKDIERERKRAENPEAMDEDDSDEVAEIKAAHFEESMKYARRSVSDADIRKYQAFAQTLQQSRGFGSEFRFPDRPAGTAAGASDVFATADNKDDDDLYS

SEQ ID NO: 13601 - protein, 806 aa, Cucumis sativus
FPNLLFGNRNNTKRDFSTAILERKKSPNRLVVDEAINDDNSVVSLHPATMEKLQFFRGDTILLKGKKRRDTVCIVLADEQCEESKIRMNKIVRGNLRVRLGDIVSVHQCPDVKYGNRVHILPIDDTIEGVTGNLFDAYLKPYFLEAYRPVRKGDLFLVRGGMRSVEFKVIETDPGEYCVVAPDTEIFCEGEPVKREDEERLNEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDELDSIAPKREKTHGEVERRIVSQLLTLMDGLKTRAHVIIIGATNRPNSIDPALRRFGRFDREIDIGVPDEVGRLEVLSIHTKNMKLAEDVDLERVARDTHGYVGADLAALCTEAALQCIREKMDVIDLEDETIDAEVLNSMAVSNEHFQTALGSSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDESSRLQIFKACLRKSPVAKDVNLSALAGYTHGFSGADITEICQRACKYAIRENIEKDLERERKQGENSEAMEEDEIDDVSEIKAAHFEESMKYARRSVSDADIRKYQLFAQTLQQSRGIGSEFRFPDRNDNVAAGAADPYASTMGAGDDDDLYS

SEQ ID NO: 13602 - protein, 817 aa, Hordeum vulgare
MATPNPPPQQGEPSSSADPKAKKDYSTAILERKKSPNRLVVDEATNDDNSVVALHPDTMERLQLFRGDTVLLKGKKRKDTICIVLADDTCDEPKVRMNKTVRKNLRVRLGDVVSVHQCPDVKYGKRVHILPIDDTVEGITGNLFDAFLKPYFLEAYRPLRKGDLFLVRGGMRSVEFKVIETDPAEYCIVAPDTEIFCDGEPVKREDEERLDDVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVELEHISRDTHGYVGADLAALCTEAALQCIREKMDIIDLEDETIDAEILNSMAVTNDHFKTALTTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMNAKKTVFIIGATNRPDIIDPALLRPGRLDQLIYIPLPDVDSRHQIFKACLRKSPLAKDIDLSALAKYTQGFSGADITEICQRACKYAIRENIEKDIERERRRKDNPEAMEEDEVDEVAEIRAAHFEESMKYARRSVSDADIRKYQAFAQTLQQSRGFGSEFRFPDQPAAGTASAAAADPFASAAAAAEDDDLYS

SEQ ID NO: 13603 - protein, 359 aa, Podocarpus macrophillus
MAVTNEHFQTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVRDVFDKARQSAPCVLFFDELDSIATQRGSSVGDAGGAADRVLNQLLTEMDGMTAKKTVFIIGATNRPDIIDPALLRPGRLDQLIYIPLPDEASRFQIFKACLRKSPISKDVDIAVLARYTHGFSGADITEICQRACKYAIREHIEKDIERERKQRENPEAMDEDESDVAEIKASHFEEAMKYARRSVSDADIRKYQAFAQTLQQSRGFGSEFRFADRPAATTGGTVTAEAFAATGAGDDDDLYS

SEQ ID NO: 13604 - protein, 606 aa, Pinus taeda
MASLIPGESSEGKGTKKDFSTAILERKKSPNRLVVDEAINDDNSVVALNSKTMETLQLFRGDTILVKGKKRKDTVCIVLADDTCEEHKIRMNKVARSNLRVRLGDVVSVHQCPDVKYGKRVHILPIDDTIEGVTGNLFDVYLKPYFLEAYRPVRKGDLFLVRGGMRSVEFKIIETDPGEYCVVSPDTEIFCEGEPIKREDEDRLDDVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKSRSHVIVMGATNRPNSIDPALRRFGRFDREIDIGVPDEVGRLEVLRIHTKNMKLAEDVDLERISKNTHGYVGADLAALCTEAALHCIREKMDVIDLEDETIDAEVLNSMAVTNEHFQAALGSSNPSALRETVVEVPNVSWEDIGGLENVKRELQETVQYPVEHPEKFEKFGMSPSKGVLFYGPPGCGKTLLAKAIANECQANFISVKGPELLTMWFGESEANVRDIFDKARQSAPCVLFLMSLIRLLPSVVVVREMLGVQQTEF

SEQ ID NO: 13605 - protein, 813 aa, Citrus clementina
MADPSSSAPRPASSSDPKSSKKDYSTAILDRKKSPNRLVVDEAINDDNSVITMHPNTMEKLQFFRGDTVLVKGKKRKDTVCVVLSDELCEESKVRVNKVVRSNLRVRLGDVVSVHPCPDVKYGRRVHILPIDDTIEGVTGNLFDAYLKPYFMESYRPVRKGDLFLVRGGMRSVEFKVIETDPGEYCVVAPDTEIFCEGEPVKREDEERLNEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDELDSIAPKREKTHGEVERRIVSQLLTLMDGLKSRAHVIVMGATNRPNSIDPALRRFGRFDREIDIGVPDEVGRLEILRIHTKNMKLAEDVDLERVAKDTHGYVGSDLAALCTEAALQCIREKMDVIDLEDETIDAEVLNSMAVTNEHFQTALGTSNPSALRETVVEVPNVSWEDIGGLDNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSTGDAGGAADRVLNQLLTEMDGMNAKKTVFIIGATNRPDIIDPALLRPGRLDQLIYIPLPDEASRLQIFKACLRKSPISPDVDLSALARYTHGFSGADITEVCQRACKYAIRENIEKDIERERRKMENPEAMEEDEVDDVDEIKAVHFEESMKYARRSVSDADIRKYQLFAQTLQQSRGFGSEFRFADRTESAAAGAADPFSSAAAADDDDLYN

SEQ ID NO: 13606 - protein, 776 aa, Ambrosia trifida
MSNQPESSTSDPKASKKDFSTAILERKKSPNRLVVDEAVNDDNSVVAMHPATMEKLQLFRGDTILIKGKKRKDTVCIALADETCDEPKIRMNKVVRTNLRIRLGDVVSVHQCPDVKYGKRIHVLPLDDTIEGVTGDLFDAYLKPYFLEAYRPVRKGDHFLVRGGMRSVEFKVIETDPGEYCVVAPDTEIFCEGEPIKRDDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLSEDVDLEKISKETHGYVGADLAALCTEAALQCIREKMDVIDLEDDSIDAEILNSMAVTNEHFSTALGTSNPSALRETVVEVPNVSWDDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEESRYSIFKAAMRKSPVSKDVDLRALAKYTQGFSGADITEICQRACKYAIRENIEKDIEKERKRSENPDSMDEDDDDDVAEIKAAHFEESMKYARRSVSDADIRKYQAFAQTLQQSRGFGS

SEQ ID NO: 13607 - protein, 813 aa, Citrus sinensis
MADPSSSAPRPASSSDPKSSKKDYSTAILDRKKSPNRLVVDEAINDDNSVITMHPNTMEKLQFFRGDTVLVKGKKRKDTVCVVLSDELCEASKVRVNKVVRSNLRVRLGDVVSVHPCPDVKYGRRVHILPIDDTIEGVTGNLFDAYLKPYFMESYRPVRKGDLFLVRGGMRSVEFKVIETDPGEYCVVAPDTEIFCEGEPVKREDEERLNEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDELDSIAPKREKTHGEVERRIVSQLLTLMDGLKSRAHVIVMGATNRPNSIDPALRRFGRFDREIDIGVPDEVGRLEILRIHTKNMKLAEDVDLERVAKDTHGYVGSDLAALCTEAALQCIREKMDVIDLEDETIDAEVLNSMAVTNEHFQTALGTSNPSALRETVVEVPNVSWEDIGGLDNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSTGDAGGAADRVLNQLLTEMDGMNAKKTVFIIGATNRPDIIDPALLRPGRLDQLIYIPLPDEASRLQIFKACLRKSPISPDVDLSALARYTHGFSGADITEVCQRACKYAIRENIEKDIERERRKMENPEAMEEDEVDDVDEIKAVHFEESMKYARRSVSDADIRKYQLFAQTLQQSRGFGSEFRFADRTESAAAGAADPFSSAAAADDDDLYN

SEQ ID NO: 13608 - protein, 819 aa, Citrullus lanatus
MTDPTGSSASDKGHEPSSSSDQKSTKRDFSTAILERKKSPNRLVVDEAINDDNSVVSLHPATMEKLQFFRGDTILLKGKKRRDTVCIVLADEQCEESKIRMNKIVRANLRVRLGDVVSVHQCPDVKYGKRIHVLPVDDTIEGVTGNLFDAYLKPYFLEAYRPVRKGDLFLVRGGMRSVEFKVIETDPGEYCVVAPDTEIFCEGEPIKREDEERLNEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDELDSIAPKREKTHGEVERRIVSQLLTLMDGLKTRAHVIVIGATNRPNSIDPALRRFGRFDREIDIGVPDEVGRLEVLRIHTKNMKLSEDVDLERVARDTHGYVGADLAALCTEAALQCIREKMDVIDLEDETIDAEVLNSMAVTNEHFQTALGSSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDESSRLQIFKACLRKSPVGKDVNLTALARYTHGFSGADITEICQRACKYAIRENIEKDLERERKQNENSEAMEEDDIDEVSEIKAAHFEESMKYARRSVSDADIRKYQLFAQTLQQSRGIGSEFRFPDRTDNVASGAADPFASTMAAGDDDDLYS

SEQ ID NO: 13609 - protein, 1377 aa, Brachypodium distachyon
MATSPTQGEPSSSDPKSKKDYSTAILERKKSPNRLVVDEATNDDNSVLALHPETMERLQLFRGDTVLLKGKKRKDTICIVLADDTCEEPKIRMNKTVRKNLRVRLGDVVSVHQCPDVKYGKRVHILPIDDTVEGITGNLFDAFLKPYFLEAYRPLRKGDLFLVRGGMRSVEFKVIETDPAEYCIVAPDTEIFCDGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPAIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVELEHISKDTHGFVGADLAALCTEAALQCIREKMDIIDLEDETIDAEILNSMAVTNDHFKTALTTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRKKSPNRLVVDEATNDDNSVVALHPDTMERLQLFRGDTVLLKGKKRKDTICIVLADETCEEPKVRMNKTVRKNLRVRLGDVVSVHQCPDVKYGKRVHILPIDDTVEGITGNLFDAFLKPYFLEAYRPLRKGDLFLVRGGMRSVEFKVIETDPAEYCIVAPDTEIFCDGEPIKREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPAIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVELEHISKDTHGYVGADLAALCTEAALQCIREKMDIIDLEDETIDAEILNSMAVTNDHFKTALTTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMNAKKTVFIIGATNRPDIIDPALLRPGRLDQLIYIPLPDVESRLQIFKACLRKSPVAKDVDLNALAKYTQGFSGADITEICQRACKYAIRENIEKDIEMERRRKDNPEAMEEDEADEIAEIRAAHFEESMKYARRSVSDADIRKYQAFAQTLQQSRGFGSEFRFPDQPAAGAAAAADPFASAAAAAEDDDLYS

SEQ ID NO: 13610 - protein, 809 aa, Selaginella moellendorffii
MAVTDSSSSKAESSDPKGSKRDYSTAILERKKAPNRLVVDEATNDDNSVVALHPETMEKLQLFRGDTVLIKGKKRKDTVCIVLADDSCEEPKIRMNKVVRTNLRVRLGDVVSVHQCADVKYGKRVHILPVDDTIEGLTGNLFDAYLKPYFLEAYRPVRKADLFLVRGGMRSVEFKVVETDPGEYCIVAPDTEIFCEGDPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTQGEVERRIVSQLLTLMDGLKSRSHVIVMGATNRPNSIDPALRRFGRFDREIDIGVPDEVGRLEVLRIHTKNMKLAEDVDLEKISHNTHGFVGADLAALCTEAALQCIREKMDVIDLEDETIDAEVLSSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVRDVFDKARQSAPCVLFFDELDSIATQRGSSVGDAGGAADRVLNQLLTEMDGMNAKKTVFIIGATNRPDIIDPALLRPGRLDQLIYIPLPDEASRLKIFQAALRKSPLSKDVDLEALGRYTQGFSGADITEICQRACKYAIRENIEQDIEKERRRADNPEAMDEDEVDEIAEIRPAHFEEAMKFARRSVSDADIRKYQAFAQTLQQSRGFGSEFRFPDRPAAAGGDSAFATAAAEDDDLYN

SEQ ID NO: 13611 - protein, 813 aa, Physcomitrella patens
MATPAAGPAGKSSDPKPKKDFSTAILERKKAPNRLVVDEAVNDDNSVVALSMETMEKLQLFRGDTVLIKGKKRKDTVCIVLSDDTCDEHKIRMNKVVRANLRVRLGDVVSVHQCPDVKYGKRIHVLPFDDSIEGVTGNLFDAYLKPYFLEAYRPVRKGDLFLVRGGMRSVEFKVVETDPAEYCIVAPDTEIFCEGEPLRREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTQGEVERRIVSQLLTLMDGLKSRAHVIVMGATNRPNSIDPALRRFGRFDREIDIGVPDEVGRLEVIRIHTKNMKLAEDVDLERIAHDTHGFVGADLAALCTEAALQCIREKMDVIDLEDDTIDAEVLNSMAVTNEHFQTALGISNPSALRETVVEVPNTTWEDIGGLENVKRELQETVQYPVEHPEKFEKFGMSPSKGVLFYGPPGCGKTLLAKAIANECQANFISVKGPELLTMWFGESEANVRDVFDKARQSAPCVLFFDELDSIANQRGSSQGDAGGAADRVLNQLLTEMDGMNAKKTVFIIGATNRPDIIDSALLRPGRLDQLIYIPLPDEASRLRIFQAALRKSPLAKEVDLEALARYTQGFSGADITEICQRACKYAIRENIEKDIEREKRRAENPEAMEEDEVEEVAQIKASHFEEAMKYARRSVSDADIRKYQAFAQTLQQSRGFGSEFRFPDRPAAAGAPSAAEAPSAFGTDAADEDDLYS

SEQ ID NO: 13612 - protein, 591 aa, Flaveria ramosissima
KKDFSTAILERKKSPNRLVVDEAVNDDNSVVAMHPATMEKLQLFRGDTILIKGKKRKDTVCIALADETCDEPKIRMNKVIRTNLRIRLGDVVSVHQCPDVKYGKRIHVLPLDDTVEGVTGDLFDTYLKPYFLEAYRPVRKGDHFLCRGGMRSIEFKVIETDPGEYCVVAPDTEIFCEGEPIKRDDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVIGATNRPNSIDPALRRFGRFDREIDIGVPDEVGRLEVLRIHTKNMKLSDDVDLEKISKETHGYVGADLAALCTEAALQCIREKMDVIDLEDESIDAEILNSMAVTNEHFSTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLSLMNLTLLQLREEAVLEMQVVLLIVF

SEQ ID NO: 13613 - protein, 818 aa, Momordica charantia
MTDPTGSSASDKVQASSSSSPDQKSTKRDFSTAILERKKSPNRLVVDEAINDDNSVVSLHPATMEKLQFFRGDTILLKGKKRRDTVCVVLADEQCEEPKIRMNKIVRANLRVRLGDVVSVHQCPDVKYGKRVHVLPIDDTIEGVTGNLFDAYLKPYFLEAYRPVRKGDLFLVRGGMRTVEFKVIETDPGEYCVVAPDTEIFCEGEPIKREDEERLNEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDELDSIAPKREKTHGEVERRIVSQLLTLMDGLKTRAHVIVIGATNRPNSIDPALRRFGRFDREIDIGVPDEIGRLEVLRIHTKNMKLAEDVDLERVARDTHGYVGADLAALCTEAALQCIREKMDVIDLEDETIDAEVLNSMAVTNEHFQTALGSSNPSALRETVVEVPNVSWDDIGGLDNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDEASRLQIFKACLRKSPVSKDVDLSALSRYTHGFSGADITEICQRACKYAIRENIEKDLEKERKKRENPEAMEEDDDIDEVSEIKAAHFEESMKFARRSVSDADIRKYQLFAQTLQQSRGIGSEFRFPDRTDNIAADPFSSAIAGDDDDDLYN

SEQ ID NO: 13614 - protein, 811 aa, Manihot esculenta
MAYSSFSQPSSSSGPGKRDYSTAMSERKMSPNRLVVDEAINDDNSMVSMHPATMKKLQFFRGDTVLIKGKKRRDTVCIVLADEQCEESKIRINKVVRANLRLHIGDVVSVHQCPDVKYGKRVHILPIDDTIEGVAGNLFDAYLKAYFLESYRPVRKGDLFLVRGGMRSVEFKVIETDPGEYCVVAPDTEIFCEGEPIKREDEERLNEVGYDDVGGVRKQMAQIRELVELPLRHPQLFKSIGVKPPKGILLYGPPGSGKTLIARAVANETGAFFFLINGPEIMSKLAGESEGNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVNLERVAKDTHGYVGADLAALCTEAALQCIREKMDGIDLEDDTIDVEVLNSMAVTNEHFQTALGSSNPSALRETVVEVPNVSWDDIGGLENVKKELQETVQYPVEHPDKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDEASRFQIFKACLRKSPVSRNVDLAALARYTHGFSGADITEICQRACKYAIRENIEKDIERDKRNQENPEAMEEDGVDVVSEIKAAHFEESMKYARRSVSDADIRKYQLFAQTLQQSRGFGTEFRFSDRTETAEAGGASDPFASATTAGDDDDLYS

SEQ ID NO: 13615 - protein, 811 aa, Eucalyptus grandis
MADPGASLPSSSLDGGKKDYSTAILEHKKSPNRLIVDEAINDDNSVVSMHPSTMEKLQLFRGDTVLLKGKKRRDTVCVVLADEQCEEPKIRMNKVVRANLKVRLGDIISVHQCPDVKYGRKIHILPIDDTIEGVTGNLFDAFLKPYFLESYRPVRKGDLFLVRGGMRSVEFKVIETDPGEYCIVAPDTEIFCEGEPIKREEEERLTEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPAIIFIDELDSIAPKREKTHGEVERRIVSQLLTLMDGLKSRAHVIVIGATNRPNSIDPALRRFGRFDREIDIGVPDEVGRLEILRIHTKNMKLADDVDLERVAKDTHGYVGADLAALCTEAALQCIREKMDVIDLEDETIDAEVLNSMAVTNEHFKTALVASNPSALRETVVEVPNVSWDDIGGLDNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSTGDAGGAADRVLNQLLTEMDGMTAKKTVFIIGATNRPDIIDPALLRPGRLDQLIYIPLPDEASRLQIFKACLRKSPVSRDVDLAALARYTHGFSGADIIEICQRACKYAIRENIEKDIERERRERENPEAMEEDIADDVSEIKAAHFEELMKYARRSVSDADIRKYQLFAQTLQQSRGFGSEFRFPDRPENAAAGRAFDPFASANAAGDDDDLYS

SEQ ID NO: 13616 - protein, 816 aa, Physcomitrella patens
MATPAAEHAGESSDPKPASKKDFSTAILERKKAPNRLIVDEAVNDDNSVVALNMEIMEKLQLFRGDTVLIKGKKRKDTVCIVLADDTCDEPKIRMNKVVRANLRVRLGDVVSVHQCADVKYGKRIHVLPFDDSIEGVTGNLFDAYLKPYFLEAYRPVRKGDLFLVRGGMRSVEFKVVETDPAEYCIVAPDTEIFCEGEPLRREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTQGEVERRIVSQLLTLMDGLKSRAHVIVMGATNRPNSIDPALRRFGRFDREIDIGVPDEVGRLEVVRIHTKNMKLAEDVDLEKIAHDTHGFVGADLAALCTEAALQCIREKMDVIDLEDETIDAEVLNSMAVTNEHFQTALGISNPSALRETVVEVPNTTWEDIGGLENVKRELQETVQYPVEHPEKFEKFGMSPSKGVLFYGPPGCGKTLLAKAIANECQANFISVKGPELLTMWFGESEANVRDVFDKARQSAPCVLFFDELDSIANQRGSSQGDGGGAADRVLNQLLTEMDGMNAKKTVFIIGATNRPDIIDSALLRPGRLDQLIYIPLPDEASRLRIFQAALRKSPLAKEVDLEALARYTQGFSGADITEICQRACKYAIRENIEKDIEREKRMAENPEAMEEDEVEEVAQIKASHFEEAMKYARRSVSDADIRKYQAFAQTLQQSRGFGSEFRFPDRAVGAGAPSAADTTPGFGVAAAADDDDLYS

SEQ ID NO: 13617 - protein, 793 aa, Ambrosia trifida
GKRTSVQRFLKRKKAPNRLVVDEAVNDDNSVVCMHPETMEKLQLFRGDTILLKGKKRRDTICIALADDTCEEPKIRINKVVRSNLRVRLGDVVSVHQCADVKYGKRVHILPIDDTIEGVTGNLFDAYLKPYFLEAYRPVRKGDFFLVRGGMRSVEFKVIETDPAEYCVVAPDTEIFCEGEPVRREDEDRLDEIGYDDVGGVRKQMAQIRELVELPLRHPQLFKSIGVKPPKGILLYGPPGSGKTLIARAVANETGAFFFCINGPEIMSKMAGESESNLRKAFEEAEKNAPSIIFIDELDSIAPKREKTHGEVERRIVSQLLTLMDGLKSRAHVIVMGATNRPNSIDPALRRFGRFDREIDIGVPDEIGRLEVLRIHTKNMKLSDDVDLEKVGKDTHGYVGADLAALCTEAALQCIREKMDVIDLEDESIDAEILNSMAVTNEHFQTALGTSNPSALRETVVEVPNVSWEDIGGLENVKRELQETVQYPVEHPEKFEKFGMAPSKGVLFYGPPGCGKTLLAKAIANECQANFISIKGPELLTMWFGESEANVREIFDKARGSAPCVLFFDELDSIATQRGSSQGDAGGAADRVLNQLLTEMDGMSAKKTVFIIGATNRPDIIDPALLRPGRLDQLIYIPLPDEESRYQIFKSALRKSPISKDVDLRALARFTQGFSGADITEICQRACKYAIRENIEKDIEREKRISENPEAMEEDMDDEVAEIKAAHFEESMKFARRSVSDADIRKYQAFAQTLQQSRGIGSEFRFSETSGRAAASDPFAAPAGTVDDDDLYN

SEQ ID NO: 13618 - protein, 715 aa, Brassica napus
LRVRLGDVISVHQCPDVKYGQRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGGGGDAGGAADRVLNQLLTEMDGMNAKKTVFIIGATNRPDIIDSALLRPGRLDQLIYIPLPDEDSRLNIFKACLRKSPVAKDVDINALAKYTQGFSGADITEICQRACKYAIRENIEKDIEKEKRRSENPEAMEEDGVDEVSEIKAAHFEESMKYARRSVSDADIRKYQAFAQTLQQSRGFGSEFRFETNAAGSGATTGVADPFATSAAAAADDDDLYN

SEQ ID NO: 13619 - protein, 526 aa, Flaveria ramosissima
MSKLAGESESNLRKAFEEAEKNAPSIIFIDEIDSIAPKREKTNGEVERRIVSQLLTLMDGLKSRAHVIVIGATNRPNSIDPALRRFGRFDREIDIGVPDEVGRLEVLRIHTKNMKLSEDVDLEKISKETHGYVGADLAALCTEAALQCIREKMDVIDLEDESIDAEILNSMAVTNEHFATALGTSNPSALRETVVEVPNVSWDDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEESRYSIFKAAMRKSPVSKDVDLRALAKYTQGFSGADITEICQRACKYAIRENIEKDIERERKRSENPDSMDEDEDDVAEIKAAHFEESMKYARRSVSDADIRKYQAFAQTLQQSRGFGSEFRFPEATSGGGAADPFAASAGGANDDDLYS

SEQ ID NO: 13620 - protein, 602 aa, Tropaeolum majus
MYDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEIGRLEVLRIHTKNMKLAEDVDLKRISKDTHGYVGADLAALCTEAALQCIREKMDVIDLEDESIDAEILNSMAVSNEHFHTALGTSNPSALRETVVEVPNVSWQDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEESRFQIFKSCLRKSPVAKDVDLRALAKYTQGFSGADITEICQRACKYAIRENIEKDIERERRRSENPEAMEEDVDDEVAEIKAAHFEESMKFARRSVSDADIRKYQAFAQTLQQSRGFGSEFRFSETGSGTTTTAAADPFAASAGGADEDDLYN

SEQ ID NO: 13621 - protein, 804 aa, Ricinus communis
MADQGSSQPSSSSDPKSGKKDYSTAILERKKSPNRLVVDEAINDDNSVVSMHPDTMETLQLFRGDTVLIKGKKRKDTVCIVLADEQCEQPKIRMNKVVRANLRVRLGDVVSVHQCPDVKYGKRVHILPIDDTIEGVTGNIFDAYLKPYFLESYRPVRKGDLFLVRGGMRSVEFKVIETDPGEYCVVAPDTEIFCEGEPIKREDEERLNEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEEVDLERVAKDTHGYVGADLAALCTEAALQCIREKMDVIDLEDETIDAEVLNSMAVTNEHFQTALGTSNPSALRETVSTMRHVNLIFNAKTVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDEASRLQIFKACLRKSPVSRDVELAALARYTHGFSGADITEICQRACKYAIRENIEKDIEREKRKQENPEAMEEDDVDEVPEIKPAHFEESMKYARRSVSDADIRKYQLFAQTLQQSRGFGTEFRFSDRTENTAAAGGASDPFASATTAGDDDDLYN

SEQ ID NO: 13622 - protein, 815 aa, Ceratodon purpureus
MATPPSAHPGEPSDPKPAAKKDFSTAILERKKAPNRLVVDEAVNDDNSVVALNMETMEKLQLFRGDTVLIKGKKRKDTVCIVLADDTCDEPKIRMNKVVRANLRVRLGDVVSVHQCADVKYGKRIHVLPFDDSIEGVTGNLFDAYLKPYFMEAYRPVRKGDLFLVRGGMRSVEFKVVETDPAEYCIVAPDTEIFCEGEPLRREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTQGEVERRIVSQLLTLMDGLKSRAHVIVMGATNRPNSIDPALRRFGRFDREIDIGVPDEVGRLEVVRIHTKNMKLSEDVDLERIAHDTHGFVGADLAALCTEAALQCIREKMDVIDLEDDSIDAEVLNSMAVTNEHFQTALGISNPSALRETVVEVPNTTWEDIGGLENVKRELQETVQYPVEHPEKFEKFGMSPSKGVLFYGPPGCGKTLLAKAIANECQANFISVKGPELLTMWFGESEANVRDVFDKARQSAPCVLFFDELDSIANQRGSSQGDAGGAADRVLNQLLTEMDGMNAKKTVFIIGATNRPDIIDSALLRPGRLDQLIYIPLPDEASRLRIFQAALRKSPLAKEVDLEALARYTQGFSGADITEICQRASKYAIREDIEKDIEREKRRSENPEAMEEDEAEEVAEIKARHFEEAMKFARRSVSDADIRKYQAFAQTLQQSRGFGSEFRFPDRPVAPGGVPHAAEAAPAFGAAADDDDLYN

SEQ ID NO: 13623 - protein, 810 aa, Solanum lycopersicum
MADPKSSTSDSKNNKKDFATAILERKRSPNRLIVDEAINDDNSVVSMHPAKMEELQLFRGDTVLLKGKKRKDTVCVVLADEQCEEHKVRLNKVVRANLRIRLGDVVSVHQCPDVKYAKRVHILPIDDTIEGMTGNLFDAYLKPYFLESYRPVRKGDLFVVRGGMRSVEFKVVETEPGEYCVVAPDTEIFCEGEPIKREEEERLNEVGYDDVGGMRKQMAQIRELVELPLRHPQLFKSIGVKPPKGILLYGPPGSGKTLIGRAVANETGAFFFLINGPEIMSKLAGESEGNLRKAFEEAEKNAPSIIFIDELDSIAPKREKTHGEVERRIVSQLLTLMDGLKSRSHVIVMGATNRPNSIDPALRRFGRFDREIDIGVPDEIGRLEILRIHTKNMKLDDNVDLERVARDTHGYVGADLAALCTEAALQCIREKMDVIDLEDETIDAEVLNSMAVTNEHFQTALGASNPSALRETVVEVPNTSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGNSVGDAGGAADRVLNQLLTEMDGMTAKKTVFIIGATNRPDIIDPALLRPGRLDQLIYIPLPDEASRLQIFKACLRKSPVAKDVDLSALARYTHGFSGADITEICQRACKYAIRENIEMDIERERKRSLNPEAMDEDDTDEVAEIKAAHFEESMKYARRSVSDADIRKYQLFAQTLQQSRGLGTEFKFAEHAANATPTGATADPFASVNAAGDEDDLYS

SEQ ID NO: 13624 - protein, 815 aa, Physcomitrella patens
MATPAAAHPGEPSDPKPSSKKDFSTAILERKKAPNRLIVDEAVNDDNSVVALNMETMEKLQLFRGDTVLIKGKKRKDTVCIVLADDTCDEPKIRMNKVVRANLRVRLGDVVSVHQCADVKYGKRIHVLPFDDSIEGVTGNLFDAYLKPYFLEAYRPVRKGDLFLVRGGMRSVEFKVVETDPAEYCIVAPDTEIFCEGEPLRREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTQGEVERRIVSQLLTLMDGLKSRAHVIVMGATNRPNSIDPALRRFGRFDREIDIGVPDEVGRLEVVRIHTKNMKLAEDVNLERIAHDTHGFVGADLAALCTEAALQCIREKMDVIDLEDETIDAEVLNSMAVTNEHFQTALGISNPSALRETVVEVPNTTWEDIGGLENVKRELQETVQYPVEHPEKFEKFGMSPSKGVLFYGPPGCGKTLLAKAIANECQANFISVKGPELLTMWFGESEANVRDVFDKARQSAPCVLFFDELDSIANQRGSSQGDAGGAADRVLNQLLTEMDGMNAKKTVFIIGATNRPDIIDSALLRPGRLDQLIYIPLPDEASRLRIFQAALRKSPIAKEVDLQALAKFTQGFSGADITEICQRASKYAIREDIEKDIEREKRRAENPEAMEEDEVEEVAQIKARHFEEAMKFARRSVSDADIRKYQAFAQTLQQSRGFGSEFRFADRPAAATGAPYAAETTPAFGGAADDDDLYN

SEQ ID NO: 13625 - protein, 759 aa, Lotus japonicus
MEKLQLFRGDTILIKGKKRKDTICIALADETCEEPKIRMNKVVRSNLRVRLGDVVSVHQCADVKYGKRVHILPVDDTIEGVTGNLFDAYLKPYFLEAYRPVRKGDLFLVRGGMRSVEFKVIETEPSEYCVVAPDTEIFCEGEPVKREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLEKISKNTHGYVGADLAALCTEAALQCIREKMDVIDLEDEEIDAEILNSMAVTNEHFQTALGSSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDIRALAKYTQGFSGADITEICQRACKYAIRENIEKDIERERRRSENPEAMEEDVDDEVAEIKAAHFEESMKYARRSVSDADIRKYQSFAQTLQQSRGFGSEFRFADSTSGGGAGAGAASDPFAAAGGADEDDLYS

SEQ ID NO: 13626 - protein, 811 aa, Mimulus guttatus
MADPSSAHTTDSKSSKRDYSTVILERKKSPNRLIVDESINDDNSVVSMHPTKMEELQLFRGDTILIRGKRRKDTVCIVLADEQCEEQKIRMNKVVRANLRVRLTDMVSVHQCPDVKYGKRVHILPIDDSIEGLTGNLFDAYLKPYFMDAYRPVRKGDLFQVRGGMRSVEFKIVETDPGEYCVVAPDTEIFCEGEPINREDEERLNEVGYDDVGGVRKQMAQIRELVELPLRHPQLFKSIGVKPPKGILLYGPPGSGKTLIAKAVANETGAFFFLINGPEIMSKLAGESESNLRKAFEEAEKNAPSIIFIDELDSIAPKREKTHGEVERRIVSQLLTLMDGLKSRAHVIVMGATNRPNSIDPALRRFGRFDREIDIGVPDEVGRLEVLRIHTKNMKLADDVDLERVGKDTHGYVGADLAALCTEAALQCIREKMDVIDLEDETIDAEVLNSMAVTNEHFITALGASNPSALRETVVEVPNVSWQDIGGLDNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDETSRLQIFKACLRKSPLAKEVDLTALARHTHGFSGADITEICQRACKFAIREDIEKDIEKEKKKRESPEAMEEDDVDHVPEIKAAHFEESMKFARRSVSDADIRKYQLFAQTLQQSRGIGSEFRFADRADTSAAGRVDPFSSAGGGSVDDDDDLYG

SEQ ID NO: 13627 - protein, 821 aa, Physcomitrella patens
MAASGSGTKSEDVPPAPEGKGTKRDFTTAILERKKATNRLVVDEAVNDDNSVVALNTETMDKLQLFRGDTVLIKGKKRKDTVCIVLADETCEEPKIRMNKVVRANLRVRLGDVVSVHQCADVKYGKRIHVLPLDDSVEGVTGNIFDAYLKPYFMEAYRPVRKGDLFLVRGGMRSIEFKVIETDPAEYCIVAPDTEIFCEGEPVKREDEERLNEVGYDDVGGVRRQMAQIRELVELPLRHPQLFKSIGVKPPKGILLFGPPGSGKTLIARAVANETGAFFFLINGPEIMSKLAGESESNLRKAFEEAEKNAPAIIFIDEIDSIAPKREKTQGEVERRIVSQLLTLMDGLKSRAHVIVMGATNRPNSIDPALRRFGRFDREIDIGVPDEVGRLEVLRIHSKNMKLAEDVDLEKVAKETHGFVGADLAALATEAALQCIREKMDVIDLEEDSIDAEILNSMAVTNEHFQTALGTSNPSALRETVVEVPNVTWEDVGGLDNVKRELQETVQYPVEHPEKFEKFGMSPSKGVLFYGPPGCGKTMLAKAIANECQANFISVKGPELLTMWFGESEANVREIFDKARGSAPCVLFFDELDSIATQRGGSGGDAGGAADRVLNQLLTEMDGMNAKKTVFIIGATNRPDIIDSALLRPGRLDQLIYIPLPDEASRLRIFQACLRKSPIAKEVDLEALARHTQGFSGADITEICQRACKYAIRENIEKDIEKEKKRAENPEAMEEDETDEVSEIKAAHFEESMKFARRSVSDADIRKYQAFAQTLQQSRGFGSEFRFPDRPATAPGTTASAAVGGESAFAAAAADEDDLYN

SEQ ID NO: 13628 - protein, 822 aa, Ceratodon purpureus
MAASGSGSKPETEPAPVPEGKGTKRDFTTAILERKKAPNRLVVDEAVNDDNSVVALNTETMDKLQLFRGDTVLIKGKKRKDTVCIVLADETCDEPKIRMNKVVRSNLRVRLGDVVSVHQCADVKYGKRIHVLPLDDSIEGVTGNIFDAYLKPYFMEAYRPVRKGDLFLVRGGMRSIEFKVIETDPAEYCIVAPDTEIFCEGEPVRRDDEDRLNEVGYDDVGGVRRQMAQIRELVELPLRHPQLFKSIGVKPPKGILLFGPPGSGKTLIARAVANETGAFFFLINGPEIMSKLAGESESNLRKAFEEAEKNAPAIIFIDEIDSIAPKREKTQGEVERRIVSQLLTLMDGLKSRAHVIVMGATNRPNSIDPALRRFGRFDREIDIGVPDEVGRLEVMRIHTKNMKLAEDVDLEKVAKETHGFVGADLAALATEAALQCIREKMDVIDLEEDSIDAEILNSMAVTNEHFQTALGTSNPSALRETVVEVPNVTWEDVGGLENVKRELQETVQYPVEHPEKFEKFGMSPSKGVLFYGPPGCGKTMLAKAIANECQANFISVKGPELLTMWFGESEANVREIFDKARGSAPCVLFFDELDSIATQRGSSGGDAGGAADRVLNQLLTEMDGMNAKKTVFIIGATNRPDIIDSALLRPGRLDQLIYIPLPDEASRLRIFQACLRKSPIAKEVDLEALARHTQGFSGADITEICQRACKYAIRENIEKDIEKEKKRAENPEAMEEDDTDEVSEIKAAHFEESMKFARRSVSDADIRKYQAFAQTLQQSRGFGSEFRFPDRPATATGAASTAAAGGESAFAAAAADEDDLYN

SEQ ID NO: 13629 - protein, 758 aa, Cirsium arvense
MEKLQLFRGDTILIKGKKRKDTICIALADDTCDEPKIRMNKVVRSNLRVRLGDVVSVHQCADVKYGKRVHILPVDDTIEGVTGNLFDAYLKPYFMEAYRPVRKGDFFLVRGGMRSVEFKVIETDPPEYCVVAPDTEIFCEGEPVRREDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEIGRLEVLRIHTKNMKLSEDVDLEKISKETHGYVGADLAALCTEAALQCIREKMDVIDLEDESIDAEILNSMAVTNEHFATALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSQGDAGGAADRVLNQLLTEMDGMSAKKTVFIIGATNRPDIIDPALLRPGRLDQLIYIPLPDEESRYQIFKSALRKSPVAKDVDLNALAKYTQGFSGADITEICQRACKYAIRENIEKDIEREKRRSENPEAMEEDVEDEVAEIKAAHFEESMKFARRSVSDADIRKYQAFAQTLQQSRGFGSEFRFAETSGARAATGGSDPFAVAPGAADEDDLYN

SEQ ID NO: 13630 - protein, 804 aa, Prunus persica
MTNKADQSSDTGGSKKDFTTAILDRKKAVNRLVVDEDIHGDNSVVTLHPESMERLQLFRGDTILIKGKKRKDTVCIVVADDKCEEPKIRMNKVVRSNLRVRLGDVVSVYQCADVKYGNRVHVLPVDDSIQGVTGNLFDTYLRPYFFEAYRPVRTGDLFLVRGGMRSVEFKVVETDPPEYCVVAPDTEIFCDGEPVRREDEERSLDEVGYDDVGGVRKQMAQIRESVELPLRHPQLFKIIGVKPPKGILLYGPPGTGKTLIARAVANETGAFFFCINGPEIMSKLAGESESNLRKAFQEAEKNAPSIIFIDEIDSIAPKRDKTNGEVERRIVSQLLTLMDGLKSRAHVIVIGATNRPNSIDPALRRFGRFDREIDIGVPDEVGRLEVLRIHTRNMKLAEEVNLEKIAKDTHGYVGADLAALCTEAALQCIREKMDVIDLEDEEIDAEILNSMAVTNEHLQTALGTSNPSALRETVVEVPNVSWKDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMSAKKTVFVIGATNRPDIIDPALLRPGRLDQLIYIPLPDEESRHQIFRSCLRKSPVSKDVDIRALAKYTLGFSGADITEICQRACKYAIRENIEKDIVRDRRKNENPEAMEEDVDDEVAEIMAAHFEESMKYARRSVSDADIRKYQTFSQTLQQSRGLGTEFRFADRAAGYDPSATASAGADGDDLYS

SEQ ID NO: 13631 - protein, 796 aa, Glycine max
KCEKKDYSTSILERKKSPNRLVVDEAINDDNSVVTLHPETMEKLHFFRGDTVLIKGKKRRDTICVVLADEQCDEPKIRMNKVVRANLRVRLGDVVSVHQCPDVKYGKRVHILPIDDTIEGVTGNLFDAYLKPYFMESYRPVRKGDLFLVRGGMRSVEFKVIETDPGEYCVVAPDAEIFCEGEPIKREDEERLNEIGYDDVGGVRKQMAQIRELVELPLRHPQLFKSIGVKPPKGILLYGPPGSGKTLIARAVANETGAFFFLINGPEIMSKLAGESESNLRKAFEEAEKNSPSIIFIDELDSIAPKREKTHGEVERRIVSQLLTLMDGLKSRSHVVVIGATNRPNSIDPALRRFGRFDREIDIGVPDEVGRLEVLRIHTKNMKLSDNVDLEKVGRDTHGYVGSDLAALCTEAALQCIREKMDVIDLEDETIDAEVLNSMAVTNEHFQTALSSSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDESSRLQIFKACLRKSPISKDVDLAALARFTHGFSGADITEICQRACKYAIREDIEKDIEKERRKRENPEAMEEDDTDEVPEIKPAHFEESMKFARRSVSDADIRKYQLFAQTLQQSRGFGSEFRFPDRNENTAADASDPFSSVTAEGDDDLYS

SEQ ID NO: 13632 - protein, 780 aa, Triphysaria pusilla
NRLVVDESVEDDNSAVALHPTTMEKLQLFRGDTVLLKGKKRKDTVCIALSNEACEESKIRMNKVVRTNLRLRLGDVVSVHQCPDVKYGKRVHILPLDDTIEGLTGDLFDVYLKPYFSEAYRPVRKGDHFLVRGGMRSVEFKVVETDPGEYCVVAPDTEIFCEGEPVRREDEDRLDEIGYDDVGGVRKQMAQIRELVELPLRHPQLFKSIGVKPPKGILLYGPPGSGKTLIARAVANETGAFFFLINGPEIMSKMAGESESNLRKAFEEAEKNAPAIIFIDEIDSIAPKRDKTNGEVERRIVSQLLTLMDGLKSRAHVIVMGATNRPNSIDPALRRFGRFDREIDIGVPDEVGRLEVLRIHTKNMKLSEDVDLERISKDTHGYVGADLAALCTEAALQCIREKMDVIDLEDDTIDAEILNSMSVSNEHFHTALGTSNPSALRETVVEVPNVSWEDIGGLETVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSSGGDAGGAADRVLNQLLTEMDGMNAKKTVFIIGATNRPDIIDPALLRPGRLDQLIYIPLPDEDSRHQIFKACLRKSPLSKDIDLRALAKYTQGFSGADITEICQRSCKYAIRENIEKDIEKERKRNANPDSMDEDADDEVSEIKAAHFEESMKYARRSVSDADIRKYQAFAQTLQQSRGFGTEFRFAESAGGGGASGSDPFAAPATGAADEDDLYS

SEQ ID NO: 13633 - protein, 814 aa, Glycine max
MADPTSSNPDKDQSSTEPKSEKKDYSTAILERKKSPNRLVVDEAINDENSVVTLHPETMEKLQFFRGDTVLIKGKKRRDTICVVLADEQCDEPKIRMNKVVRANLRVRLGDVVSVHQCPDVKYGKRVHILPIDDTIEGVTGNLFDAYLKPYFMESYRPVRKGDLFLVRGGMRSIEFKLIETDPGEYCVVAPDTEIFCEGEPIKREDEERLNDVGYDDVGGVRKQMAQIRELVELPLRHPQLFKSIGVKPPKGILLYGPPGSGKTLIARAVANETGAFFFLINGPEIMSKLAGESESNLRKAFEEAEKNSPSIIFIDELDSIAPKREKTHGEVERRIVSQLLTLMDGLKTRSHVIVIGATNRPNSIDPALRRFGRFDREIDIGVPDEVGRLEVLRIHTKNMKLSDNVDLEKVARDTHGYVGADLAALCTEAALQCIREKMDVIDLEDETIDAEVLNSMAVTNEHFQTALSSSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDESSRLQIFKACLRKSPISKDVDLSALARFTHGFSGADITEICQRACKYAIREDIEKGIEKERRKRENPEAMEEDDTDEVPEIKPAHFEESMKFARRSVSDADIRKYQLFAQTLQQSRGFGSEFRFPDQNENTAAGASDPFSSVTAEGDDDLYS

SEQ ID NO: 13634 - protein, 645 aa, Vinca minor
MRSVEFKVVETDPGEYCVVSPDTEIFCEGEPIKRDDEEKLNEVGYDDVGGVRKQMAQIRELVELPLRHPQLFKAIGVKPPKGILLYGPPGSGKTLIARAVANETGAFFFLINGPEIMSKMAGESESNLRKAFEEAEKNAPAIIFIDELDSIAPKREKTHGEVERRIVSQLLTLMDGLKARSHVIVMGATNRPNSIDPALRRFGRFDREIDIGVPDEVGRLEVLRIHTKNMKLAEDVDLERVAKDTHGYVGADLAALCTEAALQCIREKMDLIDLEDETIDAEILNSMAVTNEHFQTALVTSNPSALRETVVEVPNVSWEDIGGLDNIKRELQETVQYPVEHPEKFEKFGMSPSKGVLFYGPPGCGKTLLAKAIANECQANFISVKGPELLTMWFGESEANVREIFDKARQSAPCVLFFDELDSIATQRGNSAGDAGGAADRVLNQLLTEMDGMNAKKTVFIIGATNRPDIIDPALLRPGRLDQLIYIPLPDEASRLQIFRACLRKSPVAQNVDLAALARHTHGFSGADITEICQRACKYAIRENIEQDIEKERKKAENPEAMEEDNANDEVAEIKAAHFEESMKFARRSVSDADIRKYQMFAQTLQQSRGFGTEFKFAERAENPTAAADPFASAPTANDDDDLYA

SEQ ID NO: 13635 - protein, 820 aa, Physcomitrella patens
MATPAASHPGESSDPLRSRTFKPVAKKDFSTAILERKKAPNRLVVDEAVNDDNSVVALNMETMEKLQLFRGDTVLIKGKKRKDTVCIVLADDTCDEPKIRMNKVVRANLRVRLGDVVSVHQCADVKYGKQIHVLPFDDSIEGVTGNLFDAYLKPYFLEAYRPVRKGDLFLVRGGMRSVEFKVVETDPVEYCIVAPDTEIFCEGEPLRREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTQGEVERRIVSQLLTLMDGLKSRAHVIVMGATNRPNSIDPALRRFGRFDREIDIGVPDEVGRLEVVRIHTKNMKLADNANLESIAHDTHGFVGADLAALCTEAALQCIREKMDVIDLEDDTIDAEVLNSMAVTNEHFQTALGISNPSALRETVVEVPNTTWADIGGLENVKRELQETVQYPVEHPEKFEKFGMSPSKGVLFYGPPGCGKTLLAKAIANECQANFISVKGPELLTMWFGESEANVRDVFDKARQSAPCVLFFDELDSIANQRGSSQGDAGGAADRVLNQLLTEMDGMNAKKTVFIIGATNRPDIIDSALLRPGRLDQLIYIPLPDEASRLRIFQATLRKSPVAKEVDLQALAKFTQGFSGADITEICQRASKYAIREDIEKDIEREKRRAENPEAMEEDVVEEPAQIKARHFEESMKFARRSVSDADIRKYQSFAQTLQQSRGFGSEFRFADRPAAAAGAPHAAETTTFGASADDDDLYN

SEQ ID NO: 13636 - protein, 563 aa, Ceratodon purpureus
MATPPSAHPGEPSDPKPAGKKDFSTAILERKKAPNRLVVDEAVNDDNSVVALNMETMEKLQLFRGDTVLIKGKKRKDTVCIVLADDTCDEPKIRMNKVVRANLRVRLGDVVSVHQCADVKYGKRIHVLPFDDSIEGVTGSLFDAYLKPYFMEAYRPVRKGDLFLVRGGMRSVEFKVVETDPAEYCIVAPDTEIFCEGEPLRREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTQGEVERRIVSQLLTLMDGLKSRAHVIVMGATNRPNSIDPALRRFGRFDREIDIGVPDEVGRLEVVRIHTKNMKLSEDVDLERIAHDTHGFVGADLAALCTEAALQCIREKMDVIDLEDDSIDAEVLNSMAVTNEHFQTALGISNPSALRETVVEVPNTTWEDIGGLENVKRELQETVQYPVEHPEKFEKFGMSPSKGVLFYGPPGCGKTLFGEGYRERMSGEFHQCEGTRAADDVVW

SEQ ID NO: 13637 - protein, 799 aa, Citrus clementina
MAADSKKDYSTAILESKKKSPNRLVIDEAINDDNSVITMHPNTMDKLQFFQGDTVLVKGKKRKDTVCIVLGDEQCEESKVGMNRVVRSNLRVRLGDLVSVHACPDVKYGRRVHILPIDDTIEGVTGSLFDAYLKSYFTGSYRPVRKGDLFLVRGGMRSVEFKVIETDPGEYCIVAPDTEIFCEGEPVKREDEEERLNEVGYDDVGGVRKQMAQIRELVELPLRHPQLFKSIGVKPPKGILLYGPPGTGKTLIARAVANETGAFFFLINGPEIMSKLAGESESNLRKAFEEAEKNAPSIIFIDEIDSIAPKREKTNGEVERRIVSQLLTLMDGLKSRAHVVVMGATNRPNSIDPALRRFGRFDREIDIGVPDEVGRLEVFRIHTKNMKLAEDVDLERVARDTHGYVGADLAALCTEAALQCIREKMDVIDLEDETIDAEVLNSMAVTNEHFRTALEMSNPSALRETVVEVPNVSWEDIGGLETVKRELQETVQYPVEHPEKFEKFGLSPSKGVLFYGPPGCGKTLLAKAIANECQANFVSVKGPELLTMWFGESEANVREIFDKARQSAPCVLFFDELDSIATQRGASVGDAGGAADRVLNQLLTEMDGMNAKKTVFIIGATNRPDVIDPALLRPGRLDQLIYIPLPDEASRLQIFKACLRKSPISPDVDLSALARYTHGFSGADITEICQRACKYAIRENIEKDIERERSGKRKRENPEAMEVDDVDEITAAHFEESMKYARRSVSDADIRKYQLFAQTLQQSRGFGSDFRFPDRTESATAGAADFFSSAIADDDDLYN

SEQ ID NO: 13638 - protein, 821 aa, Physcomitrella patens
MASSGSGTKPEDVPPAPEGRGTKRDFTSAILERKKAANRLIVDEAVNDDNSVVALNTETMDKLQLFRGDTVLVKGKKRKDTVCIVLADETCEEPKIRMNKVVRANLRVRLGDVVSVHQCADVKYGKRIHVLPLDDSVEGVTGNIFDAYLKPYFMEAYRPVRKGDLFLVRGGMRSIEFKIIETDPAEYCIVAPDTEIFCEGEPVRREDEERLNEVGYDDVGGVRRQMAQIRELVELPLRHPQLFKSIGVKPPKGILLFGPPGSGKTLIARAVANETGAFFFLINGPEIMSKLAGESESNLRKAFEEAEKNAPAIIFIDEIDSIAPKREKTQGEVERRIVSQLLTLMDGLKSRAHVIVMGATNRPNSIDPALRRFGRFDREIDIGVPDEVGRLEVLRIHSKNMKLAEDVDLEKVAKETHGFVGADLAALATEAALQCIREKMDVIDLEEDSIDAEILNSMAVTNEHFQTALGTSNPSALRETVVEVPNVTWEDVGGLDNVKRELQETVQYPVEHPEKFEKFGMSPSKGVLFYGPPGCGKTMLAKAIANECQANFISVKGPELLTMWFGESEANVREIFDKARGSAPCVLFFDELDSIATQRGSSGGDAGGAADRVLNQLLTEMDGMNAKKTVFIIGATNRPDIIDSALLRPGRLDQLIYIPLPDEASRLRIFQACLRKSPIAKEVDLEALARHTTGFSGADITEICQRACKYAIRENIEKDIEKEKKRAENPEAMEEDDTDEVSEIKAAHFEESMKFARRSVSDADIRKYQAFAQTLQQSRGIGSEFRFPERPATASGTAANGAAGTVSAFAGGATDEDDLYN

SEQ ID NO: 13639 - protein, 707 aa, Brassica napus
VISVHQCPDVKYGQRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGSGGDGGGAADRVLNQLLTEMDGMNAKKTVFIIGATNRPDIIDSALLRPGRLDQLIYIPLPDEDSRLNIFKACLRKSPIAKDVDINALAKYTQGFSGADITEICQRACKYAIRENIEKDIEKEKRRSENPEAMEEDMDEVSEIKAAHFEESMKYARRSVSDADIRKYQAFAQTLQQSRGFGSEFRFETNAGSGATTGVADPFATSAAAAAADDDDLYN

SEQ ID NO: 13640 - protein, 755 aa, Gnetum gnemon
EKLQFFRGDTILIKGKKRKDTICIALADETCEEPKIRMNKVVRSNLRVRLGDVVSVHQCPDVKYGKRVHILPIDDTIEGVTGNLFDAYLKPYFLEAYRPVRKGDLFLVRGGMRSVEFKVIETDPGEYCVVSPDTEIFCEGEPIKREDENRLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERIAKDTHGYVGADLAALCTEAALQCIREKMDVIDLEDETIDAEILNSMAVTNEHFQTALGSSNPSALRETVVEVPNVSWEDIGGLDNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEASRYQIFKACLRKSPVAKDVDLTALARYTNGFSGADITEICQRACKYAIRENIEKDIERERKRRENPEAMDEDVTEDVAEIKAVHFEESMKYARRSVSDADIRKYQAFAQTLQQSRGFGSEFRFDRPPSAGATTAADPFASSENKDDDDLYS

SEQ ID NO: 13641 - protein, 794 aa, Amsonia hubrichtii
MAEPSAAAEHGQPSDSKSNKRDYSTAILERKKSPNRLIVDEAINDDNSVVSMHPAKMEALQLFRGDTILIKGKKRKDTVCIVLADEQCEEEKIRMNKVVRSNLRVRLADVVSVHQCPDVKYGKRVHILPIDDTIEGLTGNLFDVYLKPYFFESYRPVRKGDLFQVRGGMRSIEFKVVETDPGEYCVVAPDTEIFCEGEPVKREDEEKLNEVGYDDVGGVRKQMAQIRELVELPLRHPQLFKAIGVKPPKGILLYGPPGSGKTLIARAVANETGVFFFLINGPEIMSKMAGESESNLRKAFEEAEKNAPAIIFIDELDSIAPKREKTHGEVERRIVSQLLTLMDGLKARSHVIVMGATNRPNSIDPALRRFGRFDREIDIGVPDEVGRLEVLRIHTKNMKLAEDVDLERVAKDTHGYVGADLAALCTESALQCIREKMDLIDLEDETIDAEILNSMAVTNEHFQTALGTSNPSALRETVVEVPNVSWEDIGGLDNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDDASRLQIFKACLRKSPVSKDVDLAALARHTHGFSGADITEICQRACKYAIRENIEKDIEKERKKAENPEAMEEDDTDEVAELKPAHFEESMKFARRSVSDADIRKYQLFAQTLQQSRGFGTEFRFAERTENTAAG

SEQ ID NO: 13642 - protein, 792 aa, Citrus sinensis
DYSTAILESKKKSPNRLVIDEAINDDNSVITMHPNTMDKLQFFQGDTVLVKGKKRKDTVCIVLGDEQCEESKVGMNRVVRSNLRVRLGDLVSVHACPDVKYGRRVHILPIDDTIEGVTGSLFDAYLKSYFTGSYRPVRKGDLFLVRGGVRSVEFKVIETDPGEYCIVAPDTEIFCEGEPVKREDEEERLNEVGYDDVGGVRKQMAQIRELVELPLRHPQLFKSIGVKPPKGILLYGPPGTGKTLIARAVANETGAFFFLINGPEIMSKLAGESESNLRKAFEEAEKNAPSIIFIDEIDSIAPKREKTNGEVERRIVSQLLTLMDGLKSRAHVVVMGATNRPNSIDPALRRFGRFDREIDIGVPDEVGRLEVFRIHTKNMKLAEDVDLERVARDTHGYVGADLAALCTEAALQCIREKMDVIDLEDETIDAEVLNSMAVTNEHFRTALEMSNPSALRETVVEVPNVSWEDIGGLETVKRELQETVQYPVEHPEKFEKFGLSPSKGVLFYGPPGCGKTLLAKAIANECQANFVSVKGPELLTMWFGESEANVREIFDKARQSAPCVLFFDELDSIATQRGASVGDAGGAADRVLNQLLTEMDGMNAKKTVFIIGATNRPDVIDPALLRPGRLDQLIYIPLPDEASRLQIFKACLRKSPISPDVDLSALARYTHGFSGADITEICQRACKYAIRENIEKDIERERSGKRKRENPEAMEVDDVDEITAAHFEESMKYARRSVSDADIRKYQLFAQTLQQSRGFGSDFRFPDRTESATAGAADFFSSAIADDDDLYN

SEQ ID NO: 13643 - protein, 284 aa, Fragaria vesca
MVLLEPARAVANETGAFFLCINGPEIMSKMAGESESNLRKAFEEAEKNAPSIIFIDEIDSIAPKREKTNGEIERRIVSQLLTLMDGLKSRAHVIVMAATNRPNSIDPALRRFGRFDREIDIGVPDEVGRLEVLRIHSKNMKLAEDVDLERVAKDTHGYVGADLAALATEAALQCIREKMDVIDLEDETIDAEILNSMAVTNEHFKTALGSSNPSALRETVVEVPNVSWDAIGGLEKVKRELQETVQYPVEHPEKFEKFGMSPSKGVLFYGPPGCGKTLFGQGYC

SEQ ID NO: 13644 - protein, 757 aa, Picea glauca
METLQLFRGDTILIKGKKRKDTVCIALADDTCEEHKIRMNKVVRSNLRVRLGDVVSVHQCPDVKYGKRVHILPIDDTIEGVTGNLFDVYLKSYFLEAYRPVRKGDLFLVRGGMRSVEFKIIETDPGEYCVVSPDTEIFCEGEPIKREDEDRLDEVGYDDVGGVRKQMAQIRELVELPLRHPQLFKSIGVKPPKGILLYGPPGSGKTLIARAVANKTGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVDLERISKNTHGYVGADLAALCTEAALQCIREKMDVIDLEDETIDAEVLNSMAVTNEHFQAALGSSNPSALRETVVEVPNISWEDIGGLENVKRELQETVQYPVEHPEKFEKFGMSPSKGVLFYGPPGCGKTLLAKAIANECQANFISVKGPELLTMWFGESEANVRDIFDKARQSAPCVLFFDELDSIATQRGSSVGDAGGAADRVLNQLLTEMDGMTAKKTVFIIGATNRPDIIDSALLRPGRLDQLIYIPLPDEASRFQIFKACLRKSPVAKDVEIATLAQYTQGFSGADITEICQRACKYAIREHIEMDIEREKKRKENPEAMDEDETGVAEIKAAHFEESMKYARRSVSDADIRKYQAFAQTLQQSRGFGSEFRFTDRAATTTGSAGTTDAFATQTAVDDDDLYS

SEQ ID NO: 13645 - protein, 819 aa, Malus domestica
MAPLSPSAPDRSQPSSSSDPKSNKKDFSTAILERKKSPNRLVVDEAVNDDNSVISLHPAAMEKLQFFRGDTVLIKGKKRRDTICIIIADDECEEPKIRMNKVVRANLRVRLGDVVSVHPCPYVKYGKKVHILPIDDTIEGVTGSLFDAYLKPYFVDSYRPMRKGDLFLVRGMMRSVEFKVMETDPAEYCIVAPDTEIFCEGEPVKREDEERLEDVGYDDVGGVRKQMAQIRELVELPLRHPQLFKSIGVKPPKGILLYGPPGTGKTLIARAVANETGAFFVLINGPEIMSKMAGESESNLRKVFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKRMKLADDVDLERVAKDTHGFVGADLAALCTEAALQCIREKMDVIDLEDETIDAEVLNSMAVTNEHFQTSLSSTNPSALRETVVEVPNVSWDAIGGLDNVKRELQETVSIPVEHPEMFEKFGMSPSKGVLFYGPPGCGKTLLAKAIASECQANFISIKGPELLTMWFGESEANVREIFDKARQSAPCVLFFDELDSIATQRGNSVGDAGGAGDRVLNQLLTEMDGMNAKKTVFIIGATNRPDIIDPALLRPGRLDQLIYIPLPDEASRLQIFKACLRKSPISKDIDLAALARYTHGFSGADITEICQRACKYAIREDIEKDIERERRKNANPEAMEEDEIDEVAEIKPAHFEESMKYARRSVSDADIKKYQLFAQTLQQSRGFGSEFRFPAQQTENNAGEAALSPFSSAAVAGEEADLYD

SEQ ID NO: 13646 - protein, 760 aa, Helianthus annuus
MHPATMEKLQLNRGETIRIKGKKRKDTVCIALADETCDEPKIRMNKVVRTNLRIRLGDVVSVHQCPDVKYGKRIHVLPLDDTIEGVTGDLFVTFLKPYFLEAYRPVRKGDHFLVRGGMRSIEFKVIETDPGEYCVVAPDTEIFCEGEPIKRDDEDRLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLSEDVDLEKISKETHGYVGADLAALCTEAALQCIREKMDVIDLEDESIDAEILNSMAVTNEHFSTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEDSRYAIFKAAMRKSPVSKDVDLRALARYTQGFSGADITEICQRACKYAIRENIEKDIERERKRSENPDSMDEDDDDVAEIKAAHFEESMKYARRSVSDADIRKYQAFAQTLQQSRGFGSEFRFSETSGGAANASDPFAASGGGADDDDLYS

SEQ ID NO: 13647 - protein, 403 aa, Helianthus annuus
MNKVIRTNLRVRLGDVVSVHQCPDVKYGKRIHVLPLDDTIEGVTGDLFDAYLKPYFLEAYRPVRKGDHFLVRGGMRSVEFKVIETDPGEYCVVAPNTEIFCEGEPIKRDDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVVRIHTKNMKLSDDVDLEKIAKETHGYVGADLAALCTEAALQCIREKMDVIDLEDDSIDAEILNSMAVTNEHFQTALGTSNPSALRETVVEVPNVSWEDIGGLENVKR

SEQ ID NO: 13648 - protein, 747 aa, Tripterygium wilfordii
TILIKGKKRKDTICIALADDSCEQPRIRMNKVVRSNLRVRLGDVVSVHQCPDVKYGNRVHILPIDDTIEGVTGNLFDAYLKPYFLESYRPVRKGDLFLVRGGMRSVEFKVIETDPGEYCVVAPDTEIFCEGEPVRREDEDRLDEIGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDELDSIAPKREKTHGEVERRIVSQLLTLMDGLKSRAHVIVIGATNRPNSIDPALRRFGRFDREIDIGVPDEVGRLEVLRIHTKNMKLSDNVDLERIGKDTHGYVGADLAALCTEAALQCIREKMDVIDLEDETIDAEILNSMAVTNDHFQIALGTSNPSALRETVVEVPNVSWEDIGGLTNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEESRLQIFKACLRKSPVSKDVDLGTLAKYTQGFSGADITEICQRACKYAIRENIEKDIEMERRRSENPESMDEDTEEEVAEIKAAHFEESMKFARRSVSDADIRKYQAFAQTLQQSRGFGTEFRFPETGSGAAAAADPFSTSAAAGADEDDLYS

SEQ ID NO: 13649 - protein, 761 aa, Medicago truncatula
MHPQTMEKLGLFRGDTILIKGKKRKDSVCIALGDDTCEEPRIRMNKVVRSNLRVRLGDVVSVHQCTDVKYGKRVHILPIDDTIEGLTGNLFDAFLKPYFVEAYRPVRKGDLFLVRGGMRSVEFKVIETDPGEYCTVAPDTEIFCEGEPVKRDDEERLDEVGYDDVGGVRKQMAQIRELVELPLRHPQLFKSIGAKAPKGILLSGPPGTGKTLIARAIANETGAFFFCINGPEIMSKLAGESESNLRKAFEEAEKNAPSIIFIDEIDSIAPKRDKTNGEVERRIVSQLLTLMDGLKSRAHVIVMGATNRPNSIDPALRRFGRFDREIDIGVPDEIGRLEVLRIHTKNMKLSYDVDLERISKNTHGYVGADLAALCTEAALQCIREKMDVIDLEDETIDAEILNSMAVTNEHLHTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHSIFKSCLRKSPIAKNVDLGALARHTQGFSGADITEICQRACKYAIRENIEKDIEQERKRKENPEGMDEDLVDEIVAEIKAAHFEESMKYARRSVSDADIRKYQAFAQTLQQSRGFGSEFRFSNTATSAIVSDHLTTTTGGADEDDLYS

SEQ ID NO: 13650 - protein, 746 aa, Pteridium aquilinum
VLIKGKKRKDTVCIVLADDTCDEHKIKMNKVVRANLRVRLGDVISIHQCPDVKYGKRVHILPIDDTIEGVTGNLFDAYLKPYFLEAYRPVRKGDLFLVRGGMRSVEFKVIETDPAEYCIVAPDTEIFCEGDPIRREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTNGEVERRIVSQLLTLMDGLKSRSHVIVMGATNRPNSIDPALRRFGRFDREIDIGVPDEVGRLEVLRIHTKNMKLSEDVDLERIAKDTHGFVGADLAALCTEAALQCIREKMDVIDLEDETIDAEVLNSMAVTNEHFQTALGISNPSALRETVVEVPNVSWEDIGGLDNVKRELQETVQYPVEHPEKFEKFGMSPSKGVLFYGPPGCGKTLLAKAIANECQANFISVKGPELLTMWFGESEANVRDVFDKARQSAPCVLFFDELDSIATQRGSSVGDAGGAADRVLNQLLTEMDGMTAKKTVFIIGATNRPDIIDPALLRPGRLDQLIYIPLPDEGSRLKIFQACLRKSPVAKDVDLSALARYTQGFSGADITEICQRACKYAIRENIEKDIELEKKRKENPEAMEEDEVDEISEIKAAHFEESMKYARRSVGDADIRKYQAFAQTLQQSRGFGSEFRFPDRPATAAAAGGTDTFGQAAAADDDDLYN

SEQ ID NO: 13651 - protein, 531 aa, Tropaeolum majus
MSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLEKISKETHGYVGADLAALCTEAALQCIREKMDVIDLEDDSIDAEILNSMAVTNEHFQTALGTSNPSALRETVVEVPNVSWQDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMSAKKTVFIIGATNRPDIIDPALLRPGRLDQLIYIPLPDEESRYQIFKSCLRKSPVSKDVDLRALAKYTQGFSGADITEICQRSCKYAIRENIEKDIEKERKRGENPEAMEEDGEDEVSEIKAAHFEESMKYARRSVSDADIRKYQAFAQTLQQSRGFGSEFRFSEVGSGAAAAGGASDPFAASAGGGDEDDLYS

SEQ ID NO: 13652 - protein, 817 aa, Chlamydomonas reinhardtii
MADASTSADASKKDANKKDFSTAIMDRKKSPNRLIVEEAVNDDNSVVALHPKTMEKLQLFRGDTVLLKGKKRKDTVCIVLSDDTVDENKIRMNKVVRKNLRVRLADIVSVHQCTDVKYGKRIHVLPIDDTIEGISGNLFDAYLKPYFLEAYRPVRKGDTFLARGGMRSVEFKVVETDPAEYCIVAPDTEIFCEGEPIKREDEEKLDEVGYDDIGGVRKQLAQIRELVELPLRHPQLFKTIGVKPPKGILLYGPPGSGKTLIARAVANETGAFFVVVNGPEIMSKLAGESESNLRKVFQEAEKNAPSIIFIDEVDSIAPKREKTQGEVERRIVSQLLTLMDGLKSRAHVIVIAATNRPNSIDPALRRFGRFDREIDIGVPDETGRLEVMRIHTKNMKLDEDVNLEAISRDTHGYVGADLAALCTEAALQCIREKMDVIDLEDEQIDAEVLNSMAVTQDHFKTALGMSNPSALRETVVEVPNVSWDAIGGLENVKRELQELIQYPVEHPEKFEKFGMSPSKGVLFYGPPGCGKTLLAKAIANECQANFISVKGPELLTMWFGESEANVREIFDKARGSAPCVLFFDELDSIAVQRGSSAGDAGGAADRVLNQLLTEMDGMNSKKTVFIIGATNRPDIIDPALLRPGRLDQLIYIPLPDEGSRRQIFKACLRKSPIAPDVDFDTLVKFTHGFSGADMTEICQRACKSAIREDIEKNIERERRRAENPDAMMEDEPDPVPCITKAHFEEAMKYARRSVSDADIRKYQAFAQTLQQSRGFGTDFRFPDGPGGAPAAAGAAPAAAAPAFAQSAAAADDDDLYN

SEQ ID NO: 13653 - protein, 764 aa, Solanum phureja
MHPAKMEELQLFRGDTVLLKGKKRKDTVCVVLADEQCEEHKIRLNKVVRANLRIRLGDVVSVHQCPDVKYAKRVHILPIDDTIEGMTGNLFDAYLKPYFLESYRPVRKGDLFVVRGGMRSVEFKVVETEPGEYCVVAPDTEIFCEGEPIKREDEERLNEVGYDDVGGMRKQMAQIRELVELPLRHPQLFKSIGVKPPKGILLYGPPGSGKTLIGRAVANETGAFFFLINGPEIMSKLAGESEGNLRKAFEEAEKNAPSIIFIDELDSIAPKREKTHGEVERRIVSQLLTLMDGLKSRSHVVVMGATNRPNSIDPALRRFGRFDREIDIGVPDEIGRLEILRIHTKNMKLDDNVDLERVARDTHGYVGADLAALCTEAALQCIREKMDVIDLEDETIDAEVLNSMAVTNEHFQAALGASNPSALRETVVEVPNTSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGNSVGDAGGAADRVLNQLLTEMDGMTAKKTVFIIGATNRPDIIDPALLRPGRLDQLIYIPLPDEASRLQIFKACLRKSPVAKDVDLSALSRYTRGFSGADITEICQRACKYAIRENIEKDIERERKRSVNPEAMDEDDTDEVAEIKAAHFEESMKYARRSVSDADIRKYQAFAQTLQQSRGLGTEFKFAEHAANATPTGATADPFASVNAAGDEDDLYS

SEQ ID NO: 13654 - protein, 796 aa, Aquilegia formosa
MAGSSEKKDYSTAILERKKAPNRLVVDEAVNDDNSIVSLHPATMEKLQFFRGDTILLKGKRRKDTLCIVVEDEECEEHKVRVNKVARANLRVRLGDVVSVHMCPELQYGKRIHVLPMDDTVEGLTGDLFEPYLKPYFCDSFRPLRKGNLFLVRGGMRSVEFKVVETDPPEYCIVAADTEIFCEGEPIKREDEERLDEVGYDDVGGLRKQMAQIRELLELPLRHPELFKCIGIKPPKGILLYGPPGSGKTLIARAVANETGAFFLCINGPEIMSKMSGESESNLRKAFDEAEKNAPSIIFIDEIDSIAPKRDKTNGEVEKRIVAQLLTLMDGLKSRAHVVVMGATNRPNSIDPALRRFGRFDREIDIGVPDEVGRLEVLRIHTKNMKLSEDVDLELAAKETHGYVGADLAALCTEAALQCIREKMDIIDLEDETIDAEVLNMMAITNDHFKTALGTSNPSALRETVVEVPNVSWADIGGLDSVKRELQETVQYPVEHPEKFEKFGMSPSKGVLFYGPPGCGKTLLAKAIANECQANFISIKGPELLTMWFGESEANVREIFDKARQSAPCVLFFDELDSIAMQRGSSVGDAGGAADRVLNQLLTEMDGMNAKKTVFIIGATNRPDIIDPALLRPGRLDQLIYIPLPDEASRHQIFKACLRKSPVSKDLDLSMLAKYTNGFSGADITEICQRACKYAIRENIEKDIEKERKRKENPEAMEEDDEDEVPEISVAHFEESMKFARRSVSDLDIMKYQLFANKLQQSRGFGSEFKFATHSETEAADAFTTAAATGDDTLYS

SEQ ID NO: 13655 - protein, 796 aa, Aquilegia formosa
MACSSEKKDYSTAILERKKAPNRLVVDEAVNDDNSIVSLHPATMEKLQFFRGDTILLKGKRRKDTLCIVVEDEECEEHKVRVNKVARANLRVRLGDVVSVHMCPELQYGKRIHVLPMDDTVEGLTGDLFEPYLKPYFCDSFRPVRKGNLFLVRGGMRSVEFKVVETDPPEYCIVAADTEIFCEGEPIKREDEERLDEVGYDDVGGLRKQMAQIRELLELPLRHPELFKCIGIKPPKGILLYGPPGSGKTLIARAVANETGAFFLCINGPEIMSKMSGESESNLRKAFDEAEKNAPSIIFIDEIDSIAPKRDKTNGEVEKRIVAQLLTLMDGLKSRAHVVVMGATNRPNSIDPALRRFGRFDREIDIGVPDEVGRLEVLRIHTKNMKLSEDVDLELAAKETHGYVGADLAALCTEAALQCIREKMDIIDLEDETIDAEVLNMMAITNDHFKTALGTSNPSALRETVVEVPNVSWADIGGLDSVKRELQETVQYPVEHPEKFEKFGMSPSKGVLFYGPPGCGKTLLAKAIANECQANFISIKGPELLTMWFGESEANVREIFDKARQSAPCVLFFDELDSIAMQRGSSVGDAGGAADRVLNQLLTEMDGMNAKKTVFIIGATNRPDIIDPALLRPGRLDQLIYIPLPDEASRHQIFKACLRKSPVSKDLDLSMLAKYTNGFSGADITEICQRACKYAIRENIEKDIEKERKRNENPEAMEEDDEDEVPEISVAHFEESMKFARRSVSDLDIKKYQLFAHKLQQSRGFGSEFKFATHSETEATDAFTTAAATGDDTLYS

SEQ ID NO: 13656 - protein, 804 aa, Ostreococcus lucimarinus
MTESKDEVKKETKPADPSLAILERKKAPNRLVVDEAINDDNSVVALNLQKMDELQLFRGDTVLLKGKKRKDTVCIVLADESCEEGKIRMNKVVRKNLRVRLGDVVSVHQCTDVKYGKRVHVLPFGDSIEGVTGNLFDVYLKPYFLEAYRPVRKGDTFLARGGMRAVEFKVVETDPAEYCIVAPDTEIFCEGEPINREDEERLDDVGYDDVGGVRKQMAQIRELVELPLRHPALFKTIGVKPPKGILLYGPPGSGKTLIARAVANETGAFFFLINGPEIMSKLAGESESNLRKAFEEAEKNAPAIIFIDEIDSIAPKREKTNGEVERRIVSQLLTLMDGMKSRSHIIVMGATNRPNSIDPALRRFGRFDREIDIGVPDEVGRLEVLRIHTKNMKLDEAVDLEKISKETHGYVGADLAALSTEAALQCIREKMDLIDLEDENIDAAVLDSMAITNEHFATALTTSNPSALRETVVEVPNVSWDDIGGLEGVKQELQETVQYPVEHPEKFEKFGMAPSKGVLFYGPPGCGKTLLAKAIANECQANFISIKGPELLTMWFGESEANVREIFDKARQSAPCVLFFDELDSIANQRGNSAGDAGGAGDRVLNQLLTEMDGMGSKKTVFIIGATNRPDIIDSALMRPGRLDQLVYIPLPDEPSRLSIFKANLRKSPIAADVDLEVLAKFTNGFSGADITEICQRACKYAIRESIQRDIEAERAAAVNPDAMQDENAEDPVPEITKAHFEEAMKHARKSVTDADIRKYQTFSQTLHQARGFGASDFQFPDAQGGGASAGTPAAAAADDDLYD

SEQ ID NO: 13657 - protein, 828 aa, Castanea mollissima
MQFASPDANALPLSLSLSSFASFCLETFPIATTMARRQGESSGSKSGKKDLSTAIRKWKKQPNRLVVDLAVNDDNSVVCLHPYTMEKIQISRGDTILIKGKKQKDTICIAVADDTCEELKIGMNRVVRSNLRVQLGDVVTVHQCADVKYGKRVHILPVDVTIEGVTDNLFDAYLKPYFLEAYRPVRKGDLFLVRGGRRSVEFKVIETDPGEYCVIAPDTEIFCGGEPVRREDEDKLDEVGYDDVGGVRKQMAQIHELVELPLWHPQLFESIGVKAPKGILLYGPPGSGKKLIARAVANETGAFFFYINGQEIMSKLDGESESNLQKTFEEAEKNGPSIIFIDEIDCIAPKQEKRHGEVERRIVSQLLTLMDGLKSRAHVIFIGATNRPNSIDPALRRFGRFDREIDIGVLDEVGRLEVLHIHTRNMKLSDDVDLERIAKDTHGYVGADLAALCTEAALQYIREKMDVIDLEDESIDVVILDSMAVTNEHFQNAFGTSNPSALRETVVELPNVSWEDIGGLENVKRELQETVQYPVEHPEKFEKFGMSPSKGVLFYGPPGCGKTLLAMAIATESQANFISVKGPELLTMWFGESEANVREIFYKARQSAPCVLFFDELDSIATQRGNSVGDAGGAVDRVLNQLLTEMDDIFAKKTVFIIGATNRPDIIDPALLRPGRLDQLIYIPLPEEESRYQIFKSCLRKSPVSKDVDLRALVKCTQGFSGADITEICQRACKYAIREDIEKDIKKERRRSDNPKAIDKDETDEVTEIRAAHFEESMKFARRSVSDADICKYQVFAQTLQQSRGLGGEFRFSETRTGANIGSDPFVT

SEQ ID NO: 13658 - protein, 539 aa, Zostera marina
KDTICIVLAEDDCDKSKIKMNKIVRSNLRVRLGDVVSVHQCQDVKYGLRVHILPVDDTIEGVAGNLFDTYLKPYFQEAYRPVRKGDFFLVRGGMRSIEFKIIETDPAEYCVISPDTEIFCEGEPVKREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVDLETISKNTHGYVGADLAALCTEAALQCIREKMDVIDLEDDSIDAEILNSMAITDIHFKTALGTSNPSALRETVVEVPNVSWEDIGGLENIKRELQETVQYPVEHPEKFEKFGMSPSKGVLFYGPPGCGKTLLAKAIANECQANFISIKGPELLTMWFGESEANVREIFDKARQSAPCVCFLTNLIQLLIREVAAVGMQVVPQIGCSINF

SEQ ID NO: 13659 - protein, 416 aa, Triphysaria pusilla
MKLAEDVDLERIGKDTHGYVGADLAALCTEAALHCIREKMDVIDMEDDTIDAEILNSMAVTNEHFHTALGTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGSGGGGDAGGAADRVLNQLLTEMDGMNAKKTVFIIGATNRPDIIDPALLRPGRLDQLIYIPLPDEDSRHQIFKSCLRKSPLSKDIDLRALAQYTQGFSGADITEICQRACKYAIRENIEKDIEREKRRNENPDSMDEDLDDEVSEMKPAHFEESMKFARRSVSDADIRKYQAFAQTLQQSRGFGTEFRFAESAGGASTGADAFAAPAGGADEDDLYN

SEQ ID NO: 13660 - protein, 713 aa, Cenchrus ciliaris
VVRKNLRVRLGDVVSVHQCPDVKYGKRVHILPIDDTVEGITGNLFDAFLKPYFLEAYRPVRKSDLFLVRGGMRSVEFKVIETDPTEYCIVAPDTELFCEGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGIPDEVGRLEVLRIHTKNMKLSEDVELEHIAKDTHGYVGADLAALCTEAALQCIREKMDVIDLEDETIDAEILNSMAVSNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGSVGDAGGAADRVLNQLLTEMDGMNAKKTVFIIGATNRPDIIDPALLRPGRLDQLIYIPLPDDQSRLQIFKACLRKSPVAKDVDLNALAKYTQGFSGADITEICQRACKYAIRENIEKDIEMERRRKDNPEAMEEDEVDEVAEIRAVHFEESMKYARRSVSDADIRKYQAFAQTLQQSRGFGSEFRFPDQPAAAAADPFAAPAAAADDDDLYS

SEQ ID NO: 13661 - protein, 714 aa, Panicum virgatum
MASQGASSSDPKDKKDYSTAILERKKSPNRLVVDEATSDDNSVVALHPDTMERLQLFRGDTVLLKGKKRKDTICIVLADDTCEEPKIRMNKVVRKNLRVRLGDVVSVHQCPDVKYGKRVHILPIDDTIEGITGNLFDAFLKPYFLEAYRPLRKGDLFLVRGGMRSVEFKVIETDPAEYCIVAPDTEIFCEGEPIKRDDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDELDSIAPKREKTHGEVERRIVSQLLTLMDGLKSRAHVIVMGATNRPNSIDPALRRFGRFDREIDIGVPDEVGRLEVLRIHTKNMKLAEDVDLEHIAKDTHGYVGADLAALCTEAALQCIREKMDIIDLEDETIDAEILNSMAVSNDHFKTALGTSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDDQSRLQIFKACLRKSPVAKDVDLNALAKYTQGFSGADITEICQRACKYAIRENIEKDIERE

SEQ ID NO: 13662 - protein, 819 aa, Volvox carteri
MADAGPSDAGKKEKKDFSTAILERKKSPNRLIVEEAVNDDNSVVALHPKTMEKLQLFRGDTVLLKGKKRKDTVCIVLSDDTVDENKIRMNKVVRKNLRVRLADIVSIHQCTDVKYGKRIHVLPIDDTIEGITGNLFDAYLKPYFLEAYRPVRKGDTFLARGGMRSVEFKVVETDPAEYCIVAPDTEIFCEGEPIKREDEEKLDEVGYDDIGGVRKQLAQIRELVELPLRHPQLFKTIGVKPPKGILLYGPPGSGKTLIARAVANETGAFFVVVNGPEIMSKLAGESESNLRKVFQEAEKNAPSIIFIDEVDSIAPKRDKTQGEVERRIVSQLLTLMDGLKSRAHVIVIAATNRPNSIDAALRRFGRFDREIDIGVPDETGRLEVLRIHTKNMKLDEDVNLEAIARDTHGYVGADLAALCTEAALQCIREKMDVIDLEDEQIDAEVLNSMAVTQDHFKTALGMSNPSALRETVVEVPNVSWDAIGGLENVKRELQELIQYPVEHPEKFEKFGMSPSKGVLFYGPPGCGKTLLAKAIANECQANFISVKGPELLTMWFGESEANVREIFDKARGSAPCVLFFDELDSIAVQRGSSAGDAGGAADRVLNQLLTEMDGMNSKKTVFIIGATNRPDIIDPALLRPGRLDQLIYIPLPDEKSRLQIFKACLRKSPIAPDVDFDTLVKFTHGFSGADITEICQRACKSAIREDIEKNIERERRRAENPDAMMEDEPDPVPCITKAHFEEAMKYARRSVSDADIRKYQAFAQTLQQSPDRTSVSQMVLAGGLARHRLLLPLRLQPLPKALLQQTTTTCTISSKFSVP

SEQ ID NO: 13663 - protein, 805 aa, Brachypodium distachyon
RPDTHTEPFDRSRNAMSGTSSASKKAANRLVVEEAPEDDNSMCSLHPATMERLSLFKGDVVLLKGKRRRSTICIAIPDDDCEEHKLRINKAVRSNLRARIADVVSIHECRDAKYGKRVHILPIDDTVEGITGNLFDAYLKPYFLDAYRPVRKGDLFLVRGGMRSVEFKVVEVDADAAVEYCIVAADTEIFCDGEPLKREDEERLDDVGYDDVGGMRKQMTQIRELVELPLRHPQLFKSIGVEPPKGILLYGPPGSGKTLIARAVANETGAFFFLINGPEIMSKLAGESESNLRKAFEEAEKNAPSIIFIDEIDSIAPNREKTHGEVERRIVSQLLTLMDGMKSRAHVIVMGATNRPNSIDPALRRFGRFDREIDIGVPDEVGRLEVLRIHTKNMKLDADVNLEVVAKDTHGYVGADLAALCTEAALQCIREKMDIIDLEDDTIDAEILNSMAVTNDHLKTALVGTNPSALRETVVEVPNVSWSDIGGLDGVKRELQETVQYPVEHPEMFEKFGMSPSKGVLFYGPPGCGKTLLAKAIANECQANFISIKGPELLTMWFGESEANVREIFDKARQSAPCVLFFDELDSIAMQRGGSVGDAGGAADRVLNQLLTEMDGMNAKKTVFIIGATNRPDIIDSALLRPGRLDQLIYIPLPDEASRHQIFKACLRKSPLAKNVDLGALARFTKGFSGADITEICQRACKYAIREDIEKDIERERLGKEAMEVDDSGEVAEIKAAHFEESMKYARRSVSDRDITKYRAFAQTLQQSRGFGTEFRFPEQSKPAEASAATANAYAAADEEDDLYN

SEQ ID NO: 13664 - protein, 248 aa, Medicago truncatula
MKLSHDVDLERISKDTHGYVGADLAALCTEAALQCIREKMDVIDLEDETIDAEILNSMAVTNEHFHTALGTSNPSALRETVPNVSWEDIGGLENVKRELQETVQYPVEHPEKFEKFGMSPSKGVLFYGPPGCGKTLLAKAIANECQANFISIKGLELLTMWFGESEANVREIFDKARQSAPCVLFFDELDSIATQRGSRVGDAGGAADRVLNQLLTEMDGMSAKKTVFIIGATNRPDIIDPALLGQAV

SEQ ID NO: 13665 - protein, 784 aa, Glycine max
MSHQVESSDSKSWKKDSSTSILERKKSPNRLVVDEAVNDDNSVVAMHPQTLKKLQLFRGDTILVKGKKRKDTVCIALRDENCEESKIRLNKVLRSNLRVRLGDAVSVHSCPDVKYGKRVHILPIDDTIEGVTGNLFDAYLKLVVMRSYYCLLWVWLGKKRDLVLVIIFLVQGGMRSVEFKVIEIDPGEYCVVARDTEIFCEREPVKREDEERLDEVGYDDVGCVRKQMAQIRELVELPLRHPQLFKSIGVKPPKGILLYGPPGSGKTLKARAVSNETGAFFFCINGPEIMSKLAGESKVISGKHLKKLKREKTHGEVERRIVLQLLTLMDGFKSRAHVIVIGATNRPNSSPALRRFGRFDREIDIGVPDEVGRLEVLRIHTKNMKFSDDVDIERIAKDTHGYVGADLAAICTEAALQCIREKMDVIDLEDENIDAEVLNSMTVSNEHFHTALGTSNPSALRETVVEVPNVSWEDIGGLENVKRELQETVQYPVEHPEKFGKFGMSPSKGVLFYGPPGCGKTLLAKAIANECQANFISVKGPELLTMWFGESEANVREIFDKARQSAPCVLFFDELDSIATQEVVLEMLGVAADRVLNQLLTEMDGMNVKKTVFIIGATNRPDIIDSALLWPGRLDQLIYIPLPDQESRYQIFKACMRKSPVSKDVDLRALAEYTKGFSGADITEICQRACKYAIRENIEKDIERERKKRDNLEAMDEDIEEEDVAEIKAAHFEESMKYAPFAQTLQQSRGFGSGFNFPATGGRTVGSEPFATSAGRADDDDLYS

SEQ ID NO: 13666 - protein, 689 aa, Brassica napus
PVDDTVEGVTGNLFDAYLKPYFLEAYRPVRKGDLFLVRGGMRSVEFKVIETDPAEYCVVAPDTEIFCEGEPIKREDEERLDEVGYDDVGGVRKQMAQIRELVELPLRHPQLFKSIGVKPPKGILLYGPPGSGKTLIARAVANETGAFFFCINGPEIMSKMAGESESNLRKAFEEAEKNAPSIIFIDEIDSIAPKRDKTNGEVERRIVSQLLTLMDGLKSRAHVIVMGATNRPNSIDPALRRFGRFDREIDIGVPDEVGRLEVLRIHTKNMKLAEDVDLERISKDTHGYVGSDLAALCTEAALQCIREKMDVIDLEDESIDAEILNSMAVSNEHFHTALGNSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEDSRLSIFKACLRKSPVAKDVDVRALAKYTQGFSGADITEICQRACKYAIRENIEKDIERERRRGENPEAMEEDMVDDEVAEIRAAHFEESMKYARRSVSDADIRKYQAFAQTLQQSRGIGSEFRFDPTAAAGRTTGGAAADPFATSGAAADDDDLYS

SEQ ID NO: 13667 - protein, 927 aa, Vitis vinifera
MHSITIETLKIFRGDTILIKGKKRKDTVCIAITDDTCEPAKIRMNKIVRSNLRVKLGDVVSVHDCMDIMYGERVHILPMDDTIEGVTGNLYDAYLKPYFSDNFRPVRKGDLFLVRGGMRSVEFKVVETHPGEYCVVDPDTEIFFEGKPVRREDEERLDEVGYDDVGGFRKQMAQIRELVELPLRHPQLFKSIGVKPPKGILLYGPPGSGKTLIAKAVANETGAFFFCINGPEIMSKLAGESEGNLRKAFEEAEKNAPSIRIVSQLLTLMDGLKSRAHVIVIGATNRPNSIDPALRRFGRFDREIDIGVPDEVGRLEVLRIHTKNMKLSDDAIQKEKGIIVDLERIAKDSHGYVGADLAALCTEAALQSIREKMDVIDLEDEAIDAEVLNSMAVTDKHFKTALGTTNPSALRETVVEVPNVSWEDIGGLEYVKRELQETVQYPVEHPEKFEQFGMSPSRGVLFYGPPGCGKTLLAKAIANECQANFISVKGPELLTKWFGESEANVREIFDKARQSASCVLFFDELDSIATQRGSNLGDAGGADRVLNQLLIEMDGMSAKKTVFIIGATNRPDIIDPALLRPGRLDQLIYIPLPDEDSRHQIFKACLRKSPVSKHVDLRALAKYTQGFSGADITEICQRACKYAIRENIEKDIEKKRGREENPKAMDEDLEEEVAEITASHFEESMKYARRSVSEADIRKYQAFAQQSRGFGSQFRFSEAGPGGSGSNPLGTSTSGPEEDDLYTHITDKRSAMGVIVTLPVKWTKIFQMELALHTLPLKTSRDFKPHIHNAFDPDPISSTDVKLQAQRRKICRVSYALPETAASVAIAATVVGAAATLLVRRSRPSEATEIPLKICEDCGGSGICSECNGEGFVLKKLSEASAEKARLTAKNMATRYTAGLPKKWSYCTKCSSARSCSTCGGSGKLSS

SEQ ID NO: 13668 - protein, 709 aa, Pinus pinaster
MASLIPGESSEGKGTKKDFSTAILERKKSPNRLVVDEAINDDNSVVALNSKTMETLQLFRGDTILVKGKKRKDTVCIVLADDTCEEHKIRMNKVVRSNLRVRLGDVVSVHQCPDVKYGKRVHILPIDDTIEGVTGNLFDVYLKPYFLEAYRPVRKGDLFLVRGGMRSVEFKIIETDPGEYCVVSPDTEIFCEGEPIKREDEDRLDDVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKSRSHVIVMGATNRPNSIDPALRRFGRFDREIDIGVPDEVGRLEVLRIHTKNMKLSEDVDLERISKNTHGYVGADLAALCTEAALHCIREKMDVIDLEDETIDAEVLNSMAVTNEHFQAALGSSNPSALRETVVEVPNVSWEDIGGLENVKRELQETVQYPVEHPEKFEKFGMSPSKGVLFYGPPGCGKTLLAKAIANECQANFISVKGPELLTMWFGESEANVRDIFDKARQSAPCVLFFDELDSIATQRGSSAGDAGGAADRVLNQLLTEMDGMSAKKTVFIIGATNRPDIIDSALLRPGRLDQLIYIPLPDEASRFQIFKACLRKSPVAKDVEIVTLAQYTQGFSGADITEICQRACKYAIREHI

SEQ ID NO: 13669 - protein, 780 aa, Sorghum bicolor
MKKAANKLVVEEPTNDDVSICNLHPATMEKLSIYHGDVVLLKGKRRRDTICIAMNNEGCGEHALGINRSVRSNLRVRLGDVVSVHPCHDAAYGAKVHVLPLDDTVEGLTGDLFEAYLKPHFLNAYRPVRKGDLFLVRGGMRSVEFKVVDIHPPAEYCIVADDTVVFCDGEPVKREDEERLDGVGYDDVGGMRKQLAQIRELVELPLRHPQLFKSIGVKPPKGILLYGPPGSGKTLIARAVANETGAFFFCINGPEIMSKLAGESESNLRKAFQEAEKNAPSIIFIDEIDSIAPKREKTHGEVERRIVSQLLTLMDGLKTRAHVIVMGATNRPNSIDPALRRFGRFDREIDIGVPDEVGRLEVLRVHTKNMKLAEDVNLEAVSKDTHGYVGADLAALCTEAALQCIREKMDVIDLEDDTIDAEILNSMAITNDHLKTALAGTNPSALRETVVEVPNVSWADIGGLEGVKRELQETVQYPVEHPDMFEKFGMSPSRGVLFYGPPGCGKTLLAKAIANECQANFISVKGPELLTMWFGESEANVRDIFDKARQSAPCVLFFDELDSIAMQRGSHVGDAGGAADRVLNQLLTEMDGMSAKKTVFIIGATNRPDIIDPALLRPGRLDQLIYIPLPDEASRQQIFKACLRKSPVAKNVDLGALARFTAGFSGADITEICQRACKYAIREDIEKDIERERKAKENPGEMAVDCADDEPAQIGAVHFEESMRYARRSVSDADIRKYQAFAQTLQQSRGFGTEFRFPIRPQQAAEAEAAADSEEDDIYS

SEQ ID NO: 13670 - protein, 798 aa, Setaria italica
MADDAAAASSCPTPTATKKRAANRLVVEEATTDENSVCNLHPATMEELSIFSGDIILLKGKRRRDTICMAMPDEECGENKIRINKVVRSNLRVRLADVVSVHQCHDARYGAAVHFLPLDDTVEGITGDLVQAYLKPYFDDAYRPVRKGDLFLVRGGMRSVDFKVVDIKPAAEYCIVANDTEIVCEGEPVKREDEERLDDVGYDDVGGMRKQLAQIRELVELPLRHPQLFKSIGVKPPKGILLYGPPGSGKTLIARVVANETGAFFFCINGPEIMSKMAGESESNLRKAFEEAEKNAPSIVFIDEIDSIAPNRDKTHGEVERRIVSQLLTLMDGLKARAHVIVMGATNRPNSIDPALRRFGRFDREIDIGVPDEVGRLEVLRVHTRNMKLTEDVDLEVVAKDTHGYVGADLAALCTEAALQCIREKMDVIDLDDETIDAEILNSMAITNDHLKTALAGTNPSALRETMVEVPNVSWADIGGLEGVKRELQETVQYPVEHPDKFEMFGMSPSKGVLFYGPPGCGKTLLAKAIANECQANFISVKGPELLTKWFGESEANVRDIFDKARQSAPCVLFFDELDSIATQRGGSVGDAGGAGDRVLNQMLTEMDGMNAKKTVFVIGATNRPDIIDPAMLRPGRLDQLIYIPLPDEASRHQIFKACLRKSPVAKDVDLGALAKFTAGFSGADITEICQRACKYAIREDIEKEIERERQAKERPDDMAVDGAEDEEPAQIKAVHFEESMRFARRSVSDADVRKYQAFAQTLQQSRGFGSEFRFSKQPQAAEPAATANADAEDDLYD

SEQ ID NO: 13671 - protein, 648 aa, Brassica napus
RSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGGGGDAGGAADRVLNQLLTEMDGMNAKKTVFIIGATNRPDIIDSALLRPGRLDQLIYIPLPDEDSRLNIFKACLRKSPVAKDVDINALAKYTQGFSGADITEICQRACKYAIRENIEKDIEKEKRRSENPEAMEEDGVDEVSEIKAAHFEESMKYARRSVSDADIRKYQAFAQTLQQSRGFGSEFRFETNAAGSGATTGVADPFATSAAAAADDDDLYN

SEQ ID NO: 13672 - protein, 436 aa, Vinca minor
MTEPSKVIHVRNVGHEISENDLLQLFQPFGVITKLVMLRAKNQALLQMQDVPSAVNALQSYKNVQPSIRGRNVYIQFSSHQELTTMDQNTQGRGDEPNRIVLVTIHHMLYPITVEVLHQVFSPHGLVEKIVTFQKSAGFQALIQYQLQQSAVAARNSLQGRNIYDGCCQLDIQFSNLDELQVNYNNERSRDFTNPSLQSEQKGGRSSHPGGYGDMGVGYPQMANAAAIAAAFGGGLPPGISGTNDRCTVLVSNLNSDRIDEDKLFNLFSIYGNIVRIKLLRNKPDHALVQMGDGFQAELAVHFLKGAKLFGKRLEVNYSKHPNITTGADTHEYSNSNLNRFNRNAAAAKNYRYCCSPTKMIHISTLPQNVTEEEIVAHLEEHGTIVNSKLFEMNGKKQALVLFENEEDATEALVCKHATSLGGSTIRISFSQLQTI

SEQ ID NO: 13673 - protein, 433 aa, Helianthus annuus
MAEPSKVIHVRNVGHEISEPDLLQLFQPFGVINKLVMLRAKNQALLQMQDVPAAVSAMQFYANVQPSIRGRNVYVQFSSHQELTTMEQNTQGRVDEEPNRILLVTIHHMLYPITVEVLHQVFSPHGYVEKIVTFQKSAGFQALIQFQLRQSAVVARNSLQGRNIYDGCCQLDIQFSNLEELQVNYNNERSRDFTNPSLPSEQKGRPSQPGYGDAGAGYPQMNNAAAIAAAFGGGLPPGITGTNDRCTVLASNLNPDRIDEDKLFNLFSLYGNIVRIKLLRNKPDHALVQMGDGFQAELAVHFLKGATLFGKRLEVNFSKHPNITMGAETHEYLNSNLNRFNRNAAKNYRYCCSPTKMIHLSTLPQDVTEDEIISHLEEHGSIVNTKVFEMNGKKQALVMFENEEQATEALVCKHATTLADSMIRISFSQLQTI

SEQ ID NO: 13674 - protein, 432 aa, Flaveria ramosissima
MTEPSKVIHVRNVGHEISEPDLLHLFQPFGAINKLVMLRAKNQALLQLQDVPSAVSAMQFYANVQPIIRGRNVYVQFSSHQELTTMEQNTQGRVDEPNRILLVTIHHMLYPITVEVLHQVFSPHGYVEKIVTFQKSAGFQALIQFQLRQSAVAARNSLQGRNIYDGCCQLDIQFSNLEELQVNYNNERSRDFTNPSLPSEQKGRPSQPGYGDAGVGYPQMNNAAAIAAAFGGGLPPGISGTNDRCTVLASNLNPDRIDEDKLFNLFSLYGNIVRIKLLRNKPDHALVQMGDGFQAELAVHFLKGATLFGKRLEVNFSKHPNITMGAETHEYLNSNLNRFNRNAAKNYRYCCSPTKMIHLSTLPQDVTEDEIISHLEEHGNIINTKVFEMNGKKQALVLFENEEQATEALVCKHATTLADSMIRISFSQLQTI

SEQ ID NO: 13675 - protein, 433 aa, Tragopogon dubius
MTEPSKVIHVRNVGHEISEPDLLQLFQPFGVINKLVMLRAKNQALLQMQDVPSAVNAMQFYANVQPSIRGRNVYVQFSSHQELTTMEQNTQGRGDEEPNRILLVTIHHMLYPITVEVLHQVFSPHGYVEKVVTFQKSAGFQALIQFQSRQSAVSARNSLQGRNIYDGCCQLDIQFSNLEELQVNYNNERSRDFTNPSLPSEQKGRPSQPGYGDAGVGFPQMNNAAAIAAAFGGGLPPGISGTNERCTVLASNLNPDRIDEDKLFNLFSLYGNIVRIKLLRNKPDHALVQMGDGFQSELAVHFLKGATLFGKRLEVNYSKHPNITMGAETHEYLNSNLNRFNRNAAKNYRYCCSPTKMIHLSTLPQDVTEEEIVSHLEEHGSIVNSKVFEMNGKKQALVMFENEEQATEALVCKHASTLGDSMIRISFSQLQTI

SEQ ID NO: 13676 - protein, 433 aa, Flaveria ramosissima
MTEPSKVIHVRNVGHEISEPDLLQLFQPFGVINKLVMLRAKNQALLQLQDVPSAVSAMQFYANVQPSIRGRNVYVQFSSHQELTTMEQNTQGRVDEEPNRILLVTIHHMLYPITVEVLHQVFSPHGYVEKIVTFQKSAGFQALIQFQLRQSAVAARNSLQGRNIYDGCCQLDIQFSNLEELQVNYNNERSRDFTNPSLPSEQKGRPSQPGYGDSGVGYPQMNNAAAIAAAFGGGLPPGISGTNDRCTVLASNLNPDRIDEDKLFNLFSLYGNIVRIKLLRNKPDHALVQMGDGFQAELAVHFLKGATLFGKRLEVNFSKHPNITMGAETHEYLNSNLNRFNRNAAKNYRYCCSPTKMIHLSTLPQDVTEDEIISHLEEHGSIINTKVFEMNGKKQALVLFENEEQATEALVCKHATTLADSMIRISFSQLQTI

SEQ ID NO: 13677 - protein, 432 aa, Flaveria ramosissima
MTEPSKVIHVRNVGHEISEPDLLHLFQPFGAINKLVMLRAKNQALLQLQDVPSAVSAMQFYANVQPIIRGRNVYVQFSSHQELTTMEQNTQGRVDEPNRILLVTIHHMLYPITVEVLHQVFSPHGYVEKIVTFQKSAGFQALIQFQLRQSAVAARNSLQGRNIYDGCCQLDIQFSNLEELQVNYNNERSRDFTNPSLPSEQKGRPSQPGYGDTGVGYPQMNNAAAIAAAFGGGLPPGISGTNDRCTVLASNLNPDRIDEDKLFNLFSLYGNIVRIKLLRNKPDHALVQMGDGFQAELAVHFLKGATLFGKRLEVNFSKHPNITMGAETHEYLNSNLNRFNRNAAKNYRYCCSPTKMIHLSTLPQDVTEDEIISHLEEHGSIINTKVFEMNGKKQALVLFENEEQATEALVCKHATTLADSMIRISFSQLQTI

SEQ ID NO: 13678 - protein, 388 aa, Cirsium arvense
MTEPSKVIHVRNVGHEISEPDLLQLFQPFGVINKLVMLRAKNQALLQMQDVPSAVNAMQFYANVQPSIRGRNVYVQFSSHQELTTMEQNTQGRGDEEPNRILLVTIHHMLYPITVEVLHQVFSPHGYVEKVVTFQKSAGFQALIQFQSRQSAVSARNSLQGRNIYDGCCQLDIQFSNLEELQVNYNNERSRDFTNPSLPSEQKGRPSQPGYGDAGVGFPQMNNAAAIAAAFGGGLPPGISGTNERCTLLASNLNPDRIDEDKLFNLFSLYGNIVRIKLLRNKPDHALVQMGDGFQAELAVHFLKGATLFGKRLEVNFSKHPNITMGAETHEYLNSNLNRFNRNAAKNYRYCCSPTKMIHLSTLPQDVTEEEIVSHLEEHGSIVNTKTV

SEQ ID NO: 13679 - protein, 433 aa, Ambrosia trifida
MTEPSKVIHVRNVGHEISEPDLLQLFQPFGVINKLVMLRAKNQALLQLQDLPSAVSAMQFYANVQPSIRGRNVYVQFSSHQELTTMEQSTQGRVDEEPNRILLVTIHHMLYPITVEVLHQVFSPHGYVEKIVTFQKSAGFQALIQFQLRQSAVAARNSLQGRNIYDGCCQLDIQFSNLEELQVNYNNERSRDFTNPSLPSEQKGRPSQPGYGDAGAGYPQMNNAAAIAAAFGGGLPPGISGTNDRCTVLASNLNPDRIDEDKLFNLFSLYGNIVRIKLLRNKPDHALVQMGDGFQAELAVHFLKGATLFGKRLEVNFSKHPNITMGAETHEYLNSNLNRFNRNAAKNYRYCCSPTKMIHLSTLPQDVTEDEIISHLEEHGSIVNTKVFEMNGKKQALVMFENEEQATEALVCKHATTLSDSMIRISFSQLQTI

SEQ ID NO: 13680 - protein, 437 aa, Mimulus guttatus
MAEPSKVIHVRNVGHEIAENDLLQLFQPFGVITKLVMLRAKNQALLQMQDITSAVNALQFYSNVQPSIRGRNVYVQFSSHQELTVIDQNSQARGDEPNRVLLVTVHHMLYPITVEVLHQVFSPHGFVEKIVTFQKSAGFQALIQYQLQQSAILARNSLQGRNIYDGCCQLDIQFSNLDELQVNYNNERSRDFTNPSLPSEQKGKSSQPGYGDAGMYAHPVGYPQMGNAAAIAAAFGGVLPPGLSGTNDRCTVLVSNLNPDRIDEDKLFNLFSIYGNIIRIKLLRNKPDHALVQMGDGFQAELVVHFLKGAMLFGKRLEVNFSKHVNITTGSDTHDYSNSNLNRFNRNAAKNYRYCCSPTKMIHISTLPQDVTEEEIASHLEEHGTIVGTKLFEMNGKKQSLVLYENEEQATEALVCKHATSLGGSTIRISFSQLQTI

SEQ ID NO: 13681 - protein, 434 aa, Lactuca sativa
MTEPSKVIHVRNVGHEISEPDLLQLFQPFGVINKLVMLRAKNQALLQMQDVPSAVNAMQFYANVQPSIRGRNVYVQFSSHQELTTMEQNTQGRGDEEPNRILLVTIHHMLYPITVEVLQQVFSPHGYVEKIVTFQKSAGFQALIQFQSRQSAISARNSLQGRNIYDGCCQLDIQFSNLDELQVNYNNDRSRDFTNPSLPSEQKGRPSSQPGYGDAGVGFPQMNNGAAIAAAFGGGLPPGISGTNDRCTVLASNLNPDRIDENKLFNLFSLYGNIARIKLLRNKPDHALIQMGDDFQSELAVHFLKGATLFGKRLEVNYSKHPHITMGAETHEYLNSNLNRFNRNAAKNYRYCCSPTKMIHLSTLPQDITEEEIVAHLEEHGSIINTKLFEMNAKKQALVLFENEEQATEALVCKHASSLGDSMIRISFSQLQTI

SEQ ID NO: 13682 - protein, 154 aa, Momordica charantia
MTEPSKVIHVRNVGHEVSENDLLQLFQPFGVITKLVMLRAKNQALIQMQDVPSAVNALQFFANVQPSIRGRNVYVQFSSHQELTTADQNAQGRGDEPNRILLVTIHHMLYPITVEVLHQVIFSTWICGEDRHISEVSWVSGSHSVSITPVCCFC

SEQ ID NO: 13683 - protein, 422 aa, Arnica chamissonis
NVGHEISEPDLLQLFQPFGVINKLVMLRAKNQALLQLQDVPSAVSAMQFYANVQPSIRGRNVYVQFSSHQELTTMEQNTQGRVDEEPNRILLVTIHHMLYPITVEVLHQVFSPHGYVEKVVTFQKSAGFQALIQFQLRQSAVAARNSLQGRNIYDGCCQLDIQFSNLEELQVNYNNERSRDFTNPSLPSEQKGRPSQPGYGDAGAGYPQMNNAAAIAAAFGGGLPPGISGTNDRCTILVSNLNPDRIDEDKLFNLFSLYGNIVRIKLLRNKPDHALVQMGDGFQAELAVHFLKGATLFGKRLEVNFSKHPNITMGADTHEYLNSNLNRFNRNAAKNYRYCCSPTKMIHLSTLPQDVTEDEIISHLEEHGSIMNTKVFEMNGKKQALVLFENEEQATEALVCKHATTLADSMIRISFSQLQTI

SEQ ID NO: 13684 - protein, 443 aa, Vitis vinifera
MTEPSKVIHVRNVGHEISENDLLQLFQPFGVITKLVMLRAKNQALLQMQDVPSAANAMQFYTNVQPSIRGRNVYVQFSSHQELTTVDQNAQGRGDEPNRILLVTIHHLLYPITVEVLHQVFSPHGFVEKIVTFQKSAGFQALIQYQSRQSAVAARNSLQGRNIYDGCCQLDIQFSNLDELQVNYNNERSRDFTNPSLPSEQKGRSSQSGYGDAGGMYALQPGARTVGFPQMPNASAIAAAFGGGLPPGISGTNDRCTVLVSNLNPDRIDEDKLFNLFSIYGNIVRIKLLRNKPDHALVQMGDGFQAELAVHFLKGAMLFGKRLEVNFSKYSNITTGADTHEYMNSSLNRFNRNAAKNYRYCCSPTKMIHVSTLNQDITEEEIVSHLEEHGTIVNTKLFEMNGKKQALVMFENEEQATEALVCKHATPLGGLAIRISFSQLQGI

SEQ ID NO: 13685 - protein, 441 aa, Valeriana officinalis
MPLKSFTFAMSDMKYPRTICFRCFSHLELSPNLLCFVPKIRLSFKCKMFLQLLMLCNSIRMSSRAVRGRNVYIQFSSHQELTTVEQNSQGRGDEPNRILLVTIHHMLYPITVEVLHQVFSPHGFVEKIVTFQKSAGFQALIQFQSRQSAIAARNSLQGRNIYDGCCQLDIQFSNLDELQVNYNNERSRDFTNPSLPSEQKGRSSQSGYNDAGVYGVQPSGSGGVGFPQMGNAAAIAAAFGGGLPPGISGTNDRCTVLVSNLNPDRIDEDKLFNLFSLYGNIVRIKLLRNKPDHALVQMGDGFQAELAVHFLKGAILFDKRLEVNFSKHSNITTGADTHEYSNSNLNRFNRNAAKNYRYCCSPTKMIHLSTLPQDVIEDEIVAHLEEHGTIVNTKLFDMNGKKQALVLFDNEEQATEALVCKHATSLGGSMIRISFSQLNTI

SEQ ID NO: 13686 - protein, 444 aa, Citrullus lanatus
MTEPSKVIHVRNVGHEISENDLLQLFQPFGVITKLVMLRAKNQALMQMQDVPSAVNALQFFANVQPSIRGRNVYVQFSSHQELTTADQNAQGRGDEPNRILLVTIHHMLYPITVEVLHQVFFPHGFVEKIVTFQKSAGFQALIQYQTRQCAVSARTALQGRNIYDGCCQLDIQFSNLDELQVNYNNERSRDFTNPSLPSEPKGRSSQPGYGDTGGMYALQASGARPVAFSQMANAAAVAAAFGGGLPPGVSGTNDRCTVLVSNLNPDRIDEDKLFNLFSIYGNIVRIKLLRNKPDHALVQMGDGFQAELAVHFLKGAMLFGKRLEVNFSKHPNITQGADTHEYANSNLNRFNRNAAKNYRYCCSPTKMIHISSLSQEVTEEEIVSLLEEHGPIINTKLFEMNGKKQALIMFDTEEQATEALVCKHASSLSGSIIRISFSQLQTI

SEQ ID NO: 13687 - protein, 445 aa, Cucurbita pepo
MTEPSKVIHVRNVGHEISENDLLQLFQPFGVITKLVMLRAKNQALIQMQDVPSAVNALQFFANVQPSIRGRNVYVQFSSHQELTTADQNAQGRGDEPNRILLVTIHHMLYPITVEVLHQVFFPHGFVEKIVTFQKSAGFQALIQYQTRQCAISARTALQGRNIYDGCCQLDIQFSNLDELQVNYNNERSRDFTNPSLPSEPKGRSSQQPGYGDAGGMYALQASGAGPVGFPQMANAAAVAAAFGGGLPPGVSGTNDRCTVLVSNLNPDRIDEDKLFNLFSIYGNIARIKLLRNKPDHALVQMGDGFQAELAVHFLKGAMLFGKRLEVNFSKHPNITQGADTHEYANSNLNRFNRNAAKNYRYCCSPTKMIHISSLSQEVTEEEIVNLLEEHGPIINTKLFEMNGKKQALIMFDTEEQATEALVCKHASSLSGSIIRISFSQLQSI

SEQ ID NO: 13688 - protein, 297 aa, Artemisia annua
MATQEPSKVIHVRNVGHEISEPDLLQLFQPFGVVNKLVMLRAKNQALLQMQDVPSAVSAMQFYATHQPSIRGRNVYVQFSSHQELTTMEQSTQGRGDEEPNRILLVTIHHMLYPITVEVLHQVFSPHGYVEKVVTFQKSAGFQALIQFQSRQNAIAARNALQGRNIYDGCCQLDIQFSNLEELQVNYNNERSRDFTNPSLPSEQKGRPSQPGYGDAGVGYPQMNNAAAIAAAFGGGLPPGISGTNDRCTLLASSLNPDMIDEDKLFNLFSLYGNIVRINATNQIMHLFRWVMVFRPS

SEQ ID NO: 13689 - protein, 360 aa, Orobanche aegyptiaca
MAEPSKVIHVRNVGHEISENDLLQLFQPFGVVAKLVMLRAKNQALLQMQDIPAAVNALQVYTNVQPSIRGRNVYVQFSSHQELTIMDQNAQARGDEPNRILLVTVHQMLYPITVEVLHQVFSPHGFVEKIVTFQKSAGFQSLIQYQSHQSAISARNSLQGRNIYDGCCQLDIQFSNLDELQVNYNNERSRDFTNPSLPSEQRGKSSQLGYGDASLYAHPVGFPQMSNAAAIAAAFGGGLPPGISGTNDRCTILVSNLNPDKIDEDKLFNLFSIYGNIDRIKLLRNKPDHALVQMGDGFQAELAVHFLKGAMLFGKRLEVNFSKHATITTGAETHEYSNSNLNRFNRNAAKITGIVVHQQK

SEQ ID NO: 13690 - protein, 444 aa, Actinidia deliciosa
  misc_feature (254)..(254): Xaa can be any naturally occurring amino acid
  misc_feature (416)..(416): Xaa can be any naturally occurring amino acid
MTEPSKVIHVRNVGHEISENDLLQLFQPFGVITKLVMLRAKNQALLQMQDVPSAVNALQFYSNVQPSIRGRNVYVQFSSHQELTTMEQNSQGRGDEPNRILLVTIHHMLYPITVEVLQQVFSPHGVVEKVVTFQKSAGFQALIQYQLCQSAVLARNSLQGRNIYDGCCQLDIQFSNLDELQVNYNNERSRDFTNPSLPSEQKGRSSQPGYGDAGSMYALQASGTRAVGFPQMGDAAAIAAAFGGGLPPGISGSXDRCTVLVSNLNPDRIDEDKLFNLFSLYGNIVRIKLLRNKPDHALVQMGDGFQAELAVHFLKGAMLFGKRLEVNFSKHAHITTGADTHEYSNSNLNRFNRNAAKNYRYCCSPTKMIHLSTLPQDVTEEEIVSHLEEHGTIVNTKLFEMNGKKQALVLFENEEXATEALISKHASALRDAMIRISFSQLQNI

SEQ ID NO: 13691 - protein, 444 aa, Cucumis melo
MTEPSKVIHVRNVGHEISENDLLQLFQPFGVITKLVMLRAKNQALMQMQDVPSAVNALQFFANLQPSIRGRNVYVQFSSHQELTTADQNAQGRGDEPNRILLVTIHHMLYPITVEVLHQVFFPHGFVEKIVTFQKSAGFQALIQYQTRQCAVSARTALQGRNIYDGCCQLDIQFSNLDELQVNYNNERSRDFTNPSLPSEPKGRSSQPGYGDTGGMYALQASGARPVGFSQMANAAAVAAAFGGGLPPGVSGTNDRCTVLVSNLNPDRIDEDKLFNLFSIYGNIVRIKLLRNKPDHALVQMGDGFQAELAVHFLKGAMLFGKRLEVNFSKHPNITQGADTHEYANSNLNRFNRNAAKNYRYCCSPTKMIHISSLSQEVTEEEIVSLLEEHGPIVNSKLFEMNGKKQALIMFDTEEQATEALVCKHASLLSGSIIRISFSQLQTL

SEQ ID NO: 13692 - protein, 444 aa, Cucumis sativus
MTEPSKVIHVRNVGLSLSLSQNDLLQLFQPFGVITKLVMLRAKNQALMQMQDVPSAVNALQFFANLQPSIRGRNVYVQFSSHQELTTADQNAQGRGDEPNRILLVTIHHMLYPITVEVLHQVFFPHGFVEKIVTFQKSAGFQALIQYQTRQCAVSARTALQGRNIYDGCCQLDIQFSNLDELQVNYNNERSRDFTNPSLPSEPKGRSSQPGYGDTGGMYPLQPSGARPGALMANAAAVAAAFGGGLPPGVSGTNDRCTVLVSNLNPDRIDEDKLFNLFSIYGNIVRIKLLRNKPDHALVQMGDGFQAELAVHFLKGAMLFGKRLEVNFSKHPNITQGADTHEYANSNLNRFNRNAAKNYRYCCSPTKMIHISSLSQEVTEEEIVSLLEEHGPIVNSKLFEMNGKKQALIMFDTEEQATEALVCKHASLLSGSIIRISFSQLQTL

SEQ ID NO: 13693 - protein, 396 aa, Brassica napus
MARPAIQDGDEGISLLVFNGDGDGDRSWQLNFDDFQVSPEHKEKKSPSKLHNCLGCLGPEDNVADYYQQQVEMLEGFTEMDELAERGFVPGMSKEEQDNLAKSETLAIRISNIANMVLFAAKVYASVTSGSLAIVASTLDSLLDLLSGFILWFTAFSMQTPNPYQYPIGKKRMQPLGILVFASVMATLGLQIILESLRTMVSSQKEFSLTKEQESWVVGIMLSVTLVKLLLVLYCRSFSNEIVKAYAQDHFFDVITNIIGLIAVILANYFDNWMDPVGAIILALYTIRTWSMTVLENVNSLVGKSATPEYLQKLTYLCWNHHREIRHIDTVRAYTFGSHYFVEVDIVLPADMPLQVAHDIGEALQEKLEQLQEIERAFVHLDYEYTHKPEHASSHC

SEQ ID NO: 13694 - protein, 394 aa, Raphanus sativus
MARPSIENADEEISLLEFHGEGDRSWQLNFDDFQVSPEHKEKKSPSKLHNCLGCLGPEDNVADYYQQQVEMLEGFTEMDELAERGFVPGMSKEEQDNLAKSETLAIRISNIANMVLFAAKVYASVTSGSLAIVASTLDSLLDLLSGFILWFTAFSMQTPNPYQYPIGKKRMQPLGILVFASVMATLGLQIILESLRTMVSSHKEFSLTKEQESWVVGIMLSVTLVKLLLVLYCRSFSNEIVKAYAQDHFFDVITNIIGLIAVILANYFDNWMDPLGAIILALYTIRTWSMTVLENVNSLVGKSATPEYLQKLTYLCWNHHREIRHIDTVRAYTFGSHYFVEVDIVLPADMPLQVAHDIGEALQEKLEQLQEIERAFVHLDYEYTHKPEHASSHC

SEQ ID NO: 13695 - protein, 396 aa, Brassica napus
MARPVIQDGDEEISLLVFNGDGDGDRSWQLNFDDFQVSPEHKEKKSPSKLHNCLGCLGPEDNVADYYQQQVEMLEGFTEMDELAVRGFVPGMSKEEQENLAKSETLAIRISNIANMVLFAAKVYASVTSGSLAIVASTLDSLLDLLSGFILWFTAFSMQTPNPYQYPIGKKRMQPLGILVFASVMATLGLQIILESLRTMVSSQKEFSLTKEQESWVVGIMLSVTLVKLLLVLYCRSFSNEIVKAYAQDHFFDVITNIIGLIAVILANYFNNWMDPVGAIILALYTIRTWSMTVLENVNSLVGKSATPEYLQKLTYLCWNHHREIRHIDTVRAYTFGSHYFVEVDIVLPADMPLQVAHDIGEALQEKLEQLQEIERAFVHLDYEYTHKPEHASSHC

SEQ ID NO: 13696 - protein, 392 aa, Raphanus sativus
MVRPDGDEEGILLLEFQGNGDRSWQLNFDDFQVSPEHKEKKSTSKLHNCLGCLGPEDNVADYYQQQVEMLEGFTEMDELAERGFVPGMSKEEQDNLAKSETLAIRISNIANMLLFAAKVYASVTSGSLAIVASTLDSLLDLLSGFILWFTAFSMQTPNPYQYPIGKKRMQPLGILVFASVMATLGLQIILESLRTMLSSQKEFSLTREQESWVVGIMLSVTLVKLLLVLYCRSFSNEIVKAYAQDHFFDVITNIIGLIAVILANYIDNWMDPVGAIILALYTIRTWSMTVLENVNSLVGKTATPEYLQKLTYLCWNHHREIRHIDTVRAYTFGSHYFVEVDIVLPADMPLQVAHDIGESLQEKLELMQEIERAFVHLDYEYTHKPEHARSHC

SEQ ID NO: 13697 - protein, 394 aa, Eutrema halophilum
MVGPAIQDGDEGIALLELHGNVDRSWQLNFDDFQVSPEHKEKKSPSKLHNCLGCLGPEDNVADYYQQQVEMLEGFTEMDELAERGFVPGMSKEEQEKLAKSETLAIRISNIANMVLFAAKVYASVTSGSLAIIASTLDSLLDLLSGFILWFTAFSMQTPNPYQYPIGKKRMQPLGILVFASVMATLGLQIILESLRTMLSSHKEFSLTKEQESWVIGIMLSVTLVKLLLVLYCRSFSNEIVKAYAQDHFFDVITNIIGLIAVILANYIDNWMDPVGAIILALYTIRTWSMTVLENVNSLVGKSATPEYLQKLTYLCWNHHKAIRHIDTVRAYTFGSHYFVEVDIVLPADMPLQVAHDIGESLQEKLELLEEIERAFVHLDYEYTHKPEHARSHC

SEQ ID NO: 13698 - protein, 394 aa, Cleome gynandra
MAEPVTNDRDEGISLLGDQGNNDRSWQLNFEDYQVSPEHTEKKPPNKLHDCLGCLGPEDDVAEYYQQQVEMLEGFNEMDALAERGFVPGMSKEEREKLARSETFAIRISNLANMILFIAKVYASVRSGSLAIIASTLDSLLDLLSGFILWFTAFSMQTPNPYMYPIGKKRMQPLGILVFASVMATLGLQIILESIRTMISNDGGFNLTSEQERWVIGIMLSVTLVKFLLVIYCRSFSNEIVKAYAQDHFFDVITNIIGLIAALLANYIDDWMDPVGAIILALYTIRTWSMTVLENVNSLVGKSATPEYLQKLTYLCWNHHKAIRHIDTVRAYTFGSHYFVEVDIVLPAAMLLQEAHDIGESLQEKLELLPEIERAFVHLDYEYTHKPEHAKAHC

SEQ ID NO: 13699 - protein, 394 aa, Unknown
  Sequence found in Organisms: Citrus sinensis, Citrus clementina, Citrus sinensis
MVEPVARESDEETSLLAQQGNVDRSWRLNFDGFQVSPERTEKKPPRGLHDCLGVLGPEDNVAEYYQQQVQMLEGFNEMDALAERGFVPGMTKEERENLARSETLAIRISNVANMVLFAAKVYASVKSGSLAIIASTLDSLLDLLSGFILWFTAFSMQTPNPYQYPIGKKRMQPLGILVFASVMATLGLQIILESLRTLVSNEDQFNLTKEQEQWVVGIMLSVTLVKLLLVVYCRAFTNEIVKAYAQDHFFDVITNIIGLVAVLLANYIDDWMDPVGAIILALYTIRTWSMTVLENVNSLVGRSAAPEYLQKLTYLCWNHHKSIRHIDTVRAYTFGSHYFVEVDIVLPASMPLQEAHDIGESLQEKLELLPEIERAFVHLDYEYTHRPEHAQAHY

SEQ ID NO: 13700 - protein, 393 aa, Tripterygium wilfordii
MVEPATHDRDEELSLLSLHSNGDDSWRLNFDEFQLSPEHTENKAPRGLQDCLGVLGPEDNVAVYYQQQVEMLEGFNEMDALSERGFVPGMSKEERENLARSETLAIRLSNVANMVLFAAKVYASVRSGSLAIIASTLDSLLDLLSGFILWFTAFSMQTPNPYQYPIGKKRMQPLGILVFASVMATLGLQIILESVRTMVSDEKEFSLTKEQESWVVGIMLSVTLVKLILVVYCRSFKNEIVKAYAQDHFFDVITNIIGLIAALLANYIADWIDPVGAIILALYTIRTWSMTVLENVNSLVGRSATPDFLQKLTYLCWNHHKAVRHIDTVRAYTFGSHYFVEVDIVLPASMPLQEAHDIGESLQEKLELLPEIERAFVHLDYEYTHKPEHAQVY

SEQ ID NO: 13701 - protein, 394 aa, Malus domestica
MVEPVTPDYDEERSLLQESSIVEGSWRLNFDGFQVSPEHKEKKHPRGIHDCLGVFGPEDNVAEYYQQQVEMLEGFTEMDALAERGSIPGMSKEEQEKLAKSETFAIRISNIANMVLFAAKVYASVRSGSLAIIASTLDSLLDLLSGFILWFTAFSMQTRSPYQYPIGKKRMQPLGILVFASVMATLGLQIILESMRTLVSDEDEFSLTKDQERWVVGIMLSVTLVKFLLMLYCRSFKNEIVKAYAQDHFFDVITNIIGLVAVLLANYFDDWMDPVGAIILALYTIRTWSLTVLENVNSLVGKSAAPEYLQKLTYLCWNHHKAIRHIDTVRAYTFGSHYFVEVDIVLPADMPLQEAHDIGENLQEKLELLPEIERAFVHLDFEFSHKPEHAQSHS

SEQ ID NO: 13702 - protein, 393 aa, Euonymus alatus
MVEPATHDRDEELSLLSLHSNGDHSWRLNFDEFQLSTEHTENKPPRGLQDCLGVLGPEDNVAVYYQQQVEMLEGFNEMDALSERGFVPGMSKEERENLARSETLAIRLSNIANMFLFAAKVYASIRSGSLAIIASTLDSLLDLLSGFILWFTAFSMQTPNPYQYPIGKKRMQPLGILVFASVMATLGLQIILESVRTMVYDDKEFNLTKEQEHWVVGIMLSVTLVKLILVIYCRSFKNEIVKAYAQDHFFDVITNIIGLIAALLANYIDGWIDPVGAIILALYTIRTWSMTVLENVNSLVGRSATPDFLQKLTYLCWNHHKAIRHIDTVRAYTFGSHYFVEVDIVLPASMPLQEAHDIGESLQEKLELLPEIERAFVHLDYEYTHKPEHAQAY

SEQ ID NO: 13703 - protein, 396 aa, Gossypium hirsutum
MVETVARESDEELALLPHQNNGDRSWRLNFDGFQLSPEHKDVKKPPRSLHDCLGVLGPEDNVAEYYQQQVEMLEGFNEMDALAERGFIPGMSKEEREKLARSETLAIRISNVANMVLFAAKVYASVWSGSLAIIASTLDSLLDLLSGFILWFTAFSMSTPNPYQYPIGKKRMQPLGILVFASVMATLGLQIILESVRTMVSDDDEFNLTNEQERWVVGIMLGVTLVKLFLVFYCRTFTNEIVKAYAQDHFFDVITNIIGLIAVLLANYIDDWMDPVGAIILALYTIRTWSMTVLENVNSLVGKSAAPEYLQKLTYLCWNHHKAIRHIDTVRAYTFGSHYFVEVDIVLPANMALQEAHDIGESLQEKLELLPEIERAFVHLDYEFSHKPEHAQAHAL

SEQ ID NO: 13704 - protein, 394 aa, Malus domestica
MVDPVTPCYDEESSLLQESSIVDGSWRLNFDGFEVSSEHKEKKPPRGIHDCLGVLGTEDTVAEYYQQQVEMLEGFTEMDALAERGFIPGMSKEEKEKLAKSETFAIRISNIANMVLFAAKVYASVRSGSLAIIASTLDSLLDLLSGFILWFTAFSMQTPSPYQYPIGKKRMQPLGILVFASVMATLGLQIILESLRTLVSDEDEFSLTTDQERWVVGIMLSVTLVKFLLMLYCRSFKNEIVKAYAQDHFFDVITNIIGLVAVLLAHYFDDWMDPVGAIILALYTIRTWSLTVLENVNSLVGRSAAPEYLQKLTYLCWNHHKAIRHIDTVRAYTFGSHYFVEVDIVLPADMPLQEAHDIGETLQEKLELLPEIERAFVHLDYEFSHKPEHAQSHS

SEQ ID NO: 13705 - protein, 393 aa, Fragaria vesca
MASPVTSDHDEAQSLLRDSGNVDGSWRLNFESFQVASEHKEKQPRAFHDCLGVKGPEDNVAEYYQQQVEMLEGFNEMDALAERGFIPGMSKEERDNLAKSETFAIRISNVANMALFAAKVYASYRSGSLAIIASTLDSLLDLLSGFILWFTAFSMQTPNPYQYPIGKRRMQPLGILVFASVMATLGLQIILESMRTLFSDEDEFNLTKDQERWVVGIMLGVTLVKLLLMLYCRTFSNEIVKAYAQDHFFDVITNIIGLVAVLLANYFDEWMDPVGAIILALYTIRTWSLTVLENVNSLVGKSAAPEYLQKLTYLCWNHHKAIRHIDTVRAYTFGSHYFVEVDIVLPAAMPLQEAHDIGEALQEKLELLPEIERAFVHLDYEFSHKPEHAQSHS

SEQ ID NO: 13706 - protein, 395 aa, Theobroma cacao
MGEPEARESDEELCLLSHQSNGDRSWRLNFDGFQLSPEHKDKKPPRSLHDCLGVSGPEDNVAEYYQQQVEMLEGFNEMDALAERGFIPGMSKEEREKLARSETLAIRISNIANMVLFAAKVYASVRSGSLAIIASTLDSLLDLLSGFILWFTAFSMSTPNPYQYPIGKKRMQPLGILVFASVMATLGLQIILESVQTMISDEDEFNLTKEQERWVVVIMLGVTVVKLLLVFYCRTFTNEIVKAYAQDHFFDVITNIIGLVAALLANYIDDWIDPVGAIILALYTIRTWSMTVLENVNSLVGRSAAPEYLQKLTYLCWNHHKAIRHIDTVRAYTFGSHYFVEVDIVLPANMPLQEAHDIGESLQEKLELLPEIERAFVHLDYEYTHKPEHAQAHAL

SEQ ID NO: 13707 - protein, 397 aa, Amsonia hubrichtii
MVEPLTLDCDHGGSEEQLLLQESGNADSSWRLNFDGFQLSCEHKEKPPRGLQDCLGVLGPEDNVAEYYQQQVEMLEGFNEMDALAERGFVPGMSKEEREKLARSETTAIRLSNIANMVLFAAKVYASVRSGSLAIIASTLDSLLDLLSGFILWFTAFSMQTPNPYQYPIGKKRMQPLGILVFASVMATLGLQIILESLRTLIYDEDDFNLTKEQEHWVVGIMLSVTLVKLLLVVYCRSFTNEIVKAYAQDHFFDVITNIIGLIAALLANYVNGWMDPVGAIILALYTIRTWSLTVLENVNSLVGKSAAPEYLQKLTYLCWNHHKAIRHIDTVRAYTFGSHYFVEVDIVLPASMPLQEAHDIGEALQEKLELLPEIERAFVHLDYEYSHKPEHAQAQH

SEQ ID NO: 13708 - protein, 399 aa, Catharanthus roseus
MVEPLTLDGGHDASEERLLLQETGNATTDHSWRLNFDGFHLSCEHKEKPPRGLQDCLGVLGSEDNVAEYYQQQVEMLEGFNEMDALAERGFVPGMSKEEREKLARSETTAIQLSNIANMVLFAAKVYASVRSGSLAIIASTLDSLLDLLSGFILWFTAFSMQTPNPYQYPIGKKRMQPLGILVFASVMATLGLQIILESLRTLIYDDGDFSLTKEQERWVVGIMLSVTLVKLFLVFYCRSFTNEIVKAYAQDHFFDVITNIIGLIAALLANYVTDWMDPVGAIILALYTIRTWSLTVLENVNSLVGKSAAPEYLQKLTYLCWNHHKAIRHIDTVRAYTFGSHYFVEVDIVLPADMPLREAHDIGEALQEKLELLPEIERAFVHLDYEYSHKPEHAQSHH

SEQ ID NO: 13709 - protein, 396 aa, Quercus alba
MTELVAFDNDEERSLLSEPDITVDRSWRLNFDDFQVSTDHQDKKPPRGLHDCCLGVLGPEDNVAEYYQQQAEMLEGFNAMDELTEHGSLPSMSKEERDNLARSETFAIRISNIANMFLFAAKVYASVQSGSLAIIASTLDSLLDLLSGFILWFTAFSMKTPNPYQYPIGKRRMQPLGILVFASVMATLGLQIILESIRTLLSDESDFSLTKEQEEWVVGIMLSVTLVKLGLVLYCRSFTNEIVKAYAQDHFFDVITNVIGLIAALLANYIDDWMDPVGAIILAVYTIRTWSMTVLENVNSLVGRSAAPEYLQKLTYLCWNHDKAIKHIDTVRAYTFGSHYFVEVDIVLPADMPLQKAHDIGESLQEKLEHLPEIERAFVHLDYEYSHKPEHAQSHH

SEQ ID NO: 13710 - protein, 395 aa, Gossypium hirsutum
MVEMVARETDEELSLLPHQSNVDRSWRLNFDGFQLSPEHKDKKPPRSLHDCLGVLGPEDNVAEYYQQQVEMLEGFSEMDALAERGFIPGMSKEERERLARSETLAIRISNIANMVLFAAKVYASMRSGSLAIIASTLDSLLDLLSGFILWFTAFSMSTPNPYQYPIGKKRMQPLGILVFASVMATLGLQIILESVRTMVSNEDEFNLTNEQERWVVGIMLGVTLTKLLLMFYCRTFTNEIVKAYAQDHFFDVITNIIGLVAVLLAKYIDDWMDPVGAIILALYTIRTWSMTVLENVNSLVGRSAAPEYLQKLTYLCWNHHKAIKNIDTVRAYTFGSHYFVEVDIVLPANMALQEAHDIGESLQEKLELLPDIERAFVHLDYEFSHKPEHAQAHAL

SEQ ID NO: 13711 - protein, 397 aa, Tabernaemontana elegans
MVEPLTLNCDHDASEEQLLLQETGNADSSWRLNFDGFQLSCEQKEKPPRGLQDCLGVSGPEDNVAEYYQQQVEMLEGFNEMDALAERGFVPGMSKEEKEKLARSETTAIRLSNMANMVLFAAKVYASIRSGSLAIIASTLDSLLDLLSGFILWFTAFSMQTPNPYQYPIGKRRMQPLGILVFASVMATLGLQIILESVRTLISDEANFSLTKEQERWVVGIMLSVTLVKLFLVLYCRSFTNEIVKAYAQDHFFDVITNIIGLIAALLANYVSDWMDPVGAIILALYTIRTWSLTVLENVNSLVGKSAAPEFLQKLTYLCWNHHKAIRHIDTVRAYTFGSHYFVEVDIVLPADMPLQEAHDIGEALQEKLELLPEIERAFVHLDYEYSHKPEHAQAHH

SEQ ID NO: 13712 - protein, 392 aa, Aquilegia formosa
MVDPVSSDEYSEEQLLLETGTEERSWRLNFDGIQRSEYTKVKPSRGLHDCLGVLASEDVVAVYYQQQEEMLDGFNEMDALAERGFFPGMSKEEREQLAKSETLAIRISNIANMVLFIAKVYASVRSGSLAIIASTLDSLLDLLSGFILWFTAFSMQTPNPYQYPIGKKRMQPLGILVFASVMATLGLQIILESVRTLVSDEDEFNLTKEQEAWVISIMLSVTLVKLLLCVYCRSFTNEIVKAYAQDHFFDVITNIIGLIAALLANYISDWMDPVGAILLALYTIRTWSITVLENVNSLVGKSAAPEYLQKLTYLCWNHHEAIRHIDTVRAYTFGSHYFVEVDIVLPSTMPLREAHDIGEALQEKLEQLPEIERAFVHLDYEFTHKPEHAQSH

SEQ ID NO: 13713 - protein, 395 aa, Cucumis melo
MVHPVVSIENDEESSLLLQSTAGDLSWRLNFDGFQLSPEHKEKKPSRPLHDCLGVLSPEDYVAEYYQQQVEMLEGFNEMDALTDRGYVPGMSKEERENLAKSETFAIRISNIANMVLFAAKVYASIRSGSLAIIASTLDSLLDLLSGFILWFTAFSMQTPNPYQYPIGKKRMQPLGILVFASVMATLGLQIILESIRTLLLGDSVFNLTKEQERWVVGIMISVTIVKLVLMVYCRTFTNEIVKAYAQDHFFDVVTNAIGLVAALLANYIAGWIDPLGAIILALYTIRTWSMTVLENVNSLVGRSAAPEYLQKLTYLCWNHHKAIRHIDTVRAYTFGSHYFVEVDIVLPGDMPLEEAHDIGESLQEKLELLPEIERAFVHLDYEYKHKPEHAQAHS

SEQ ID NO: 13714 - protein, 404 aa, Vinca minor
MVEPLVLDSGRHGGCSEEQLLLQETGKAAAADHSWRLNFDGFQLSSEHSKEKPPRGGLQDCLGVLGPEDNVAEYYQQQVEMLEGFNEMDALAERGFIPGMSKEDREKLARSETTAIRLSNIANMVLFVAKVYASIRSGSLAIIASTLDSLLDLLSGFILWFTAFSMQTPNPYQYPIGKKRMQPLGILVFASVMATLGLQIILESLRTLVSDDADFNLTKEQELWVVGIMLSVTLVKLFLVFYCRSFTNEIVKAYAQDHFFDVITNIIGLIAALLANYVSDWMDPVGAIILALYTIRTWSLTVLENVNSLAGKSAAPEYLQKLTYLCWNHHKAIRHIDTVRAYTFGSHYFVEVDIVLPASMPLQEAHDIGEALQEKLEQLPEIERAFVHLDYEYSHKPEHAQAHL

SEQ ID NO: 13715 - protein, 395 aa, Citrullus lanatus
MVQPVVSTENDEESSLLLDSTAGDVSWRLNFDGFQLSPEHKEKKPSRPLHDCLGVLSPEDYVAEYYQQQVEMLEGFNEMDALTDRGYVPGMSKEEREKLAKSETFAIRISNVANMVLFAAKVYASIRSGSLAIIASTLDSLLDLLSGFILWFTAFSMQTPNPYQYPIGKKRMQPLGILVFASVMATLGLQIILESIRTLLLGDSVFNLTKEQERWVVGIMLSVTLVKLFLMVYCRAFTNEIVKAYAQDHFFDVVTNAIGLVAALLANYIAAWIDPLGAIILAIYTIRTWSMTVLENVNSLVGRSAAPEYLQKLTYLCWNHHKAIRHIDTVRAYTFGSHYFVEVDIVLPGDMPLEEAHDIGESLQEKLELLPEIERAFVHLDYEYKHKPEHAQAHS

SEQ ID NO: 13716 - protein, 395 aa, Cucumis sativus
MVQPVVSIENDEESSLLLQSTAGDLSWRLNFDGFQFSPEHKEKKPSRPLHDCLGVLSPEDYVAEYYQQQVEMLEGFNEMDALTDRGYVPGMSKEERENLAKSETFAIRISNVANMVLFAAKVYASIRSGSLAIIASTLDSLLDLLSGFILWFTAFSMQTPNPYQYPIGKKRMQPLGILVFASVMATLGLQIIMESIRTLLLSDSVFNLTKEQERWVVGIMISVTIVKLVLMIYCRTFTNEIVKAYAQDHFFDVVTNAIGLVAALLANYIAGWIDPLGAIILALYTIRTWSMTVLENVNSLVGRSAAPEYLQKLTYLCWNHHKAIRHIDTVRAYTFGSHYFVEVDIVLPGDMPLEEAHDIGELLQEKLELLPEIERAFVHLDYEYKHKPEHAQAHS

SEQ ID NO: 13717 - protein, 383 aa, Brassica napus
MGGEAEIKERLQPKSSSETTMHNVKGKRLWQKVKYQLVEYHALPAYLRDNEYILRHYRSEWPIKQILLSIFTIHNETLNVWTHLIGFFLFLALTIYTATKVPSVVDLHSLQHRLPDVLRKTDLHKLHSDLMSRLPSSPSKWHVMELLYNCLPERFSHGNSTDMCVLHSVKEDLANMIAPLIFRPITRWPFYAFLGGAMFCLLASSTCHLLSCHSERVSYIMLRLDYAGIAALISTSFYPPVYYSFMCDPFFCNLYLGFITILGISTVLVSLLPVFQSPEFRVVRASLFFGMGFSGAAPILHKLIIFWDQPEALHTTGYEVLMGLLYGLGALVYATRIPERWMPGKFDIAGHSHQLFHVLVVAGAFTHYRAGLVYLKWRDIEGC

SEQ ID NO: 13718 - protein, 383 aa, Raphanus sativus
  misc_feature (157)..(157): Xaa can be any naturally occurring amino acid
MGGGEAEEIKERLQPTKEKKKQQHKNVKGKRLWQKVKYQLVEYHALPAYLRDNEYILGHYRSEWPLKHILLSIFSIHNETLNVWTHLIGFFLFLALTIYTATKVPSVVDLQHRLPHLLRKTDLHKLHSDLMSRLPSSPSKWHLMELLYNCLPDRFSXANSTDMCVLHSVKEDLANMIAPLILRPITRWPFYAFLGGAMFCLLASSTCHLLSCHSERVSYIMLRLDYAGIAALISTSFYPPVYYSFMCDPFFCNLYLGFITILGISTVLVSLLPVFQSPEFRVVRASLFFGMGFSGAAPILHKLIIFWDQPEALHTTGYEVLMGLLYGLGALVYATRIPERWMPGKFDIAGHSHQLFHVLVVAGAFTHYRAGLVYLKWRDIEGC

SEQ ID NO: 13719 - protein, 386 aa, Eutrema parvulum
MGSEAEIKEHLQPKSPSETMEKKQQNVKGKRLWQKVKYQLVEYHSLPAYLRDNEYIIGHYRSEWPIKQILLSIFTIHNETLNVWTHLIGFFLFLALTIYTATRVPSVVDLHSLQHRLPDVLRKTDLHKLHSELMSRLPSSPSSWHVMELLYNCLPERFSHGNYTNMCVLHSVKEDLANMIAPLIFRPITRWPFYAFLGGAMFCLLASSTCHLLSCHSERVSYIMLRLDYAGIAALIATSFYPPVYYSFMCDPFFCNLYLGFITILGIATVLVSLLPVFQSPEFRVVRASLFFGMGFSGAAPILHKLIIFWDQPEALHTTGYEILMGLLYGLGALVYATRIPERWMPGKFDIAGHSHQLFHVLVVAGAFTHYKAGLVYLKWRDIEGC

SEQ ID NO: 13720 - protein, 386 aa, Arabidopsis lyrata
MGGEDAEIKEHLKPQASSETMEKKHNVKGKRLWQKVKYQLVEYHSLPAYLRDNEYIIGHYRSEWPIKQILLSIFTIHNETLNVWTHLIGFFLFLALTIYTATKVPSVVDLHSLQHRLPDLLRKTDLHKLHAELMSRLPSSPSSWHVMDLLYNCLPERFSHGNYTDMCVLHSVREDLANMIAPLIFRPITRWPFYAFLGGAMFCLLASSTCHLLSCHSERVSYIMLRLDYAGIAALIATSFYPPVYYSFMCDPFFCNLYLGFITILGIATVLVSLLPVFQSPEFRVVRASLFFGMGFSGLAPILHKLIIFWDQPEALHTTGYEILMGLLYGLGALVYATRIPERWMPGKFDIAGHSHQLFHVLVVAGAFTHYRAGLVYLKWRDIEGC

SEQ ID NO: 13721 - protein, 386 aa, Eutrema halophilum
MDGESEIKEHLQPKSPSETMEKKQNPKGKRLWRKVKYQLVEYHSLPDYLRDNEYIIGHYRSEWPIKQILLSTFTIHNETLNVWTHLIGFFLFLALTIYTATKVPSVVDLHSLQHRLPDVLRKTDLHKLHSELMSRLPSSPSSWHVMELLYNCLPERFSHGNYTDMCVLHSVKEDLANMIAPLIFRPITRWPFYAFLGGAMFCLLASSTCHLLSCHSERVSYIMLRLDYAGIAALIATSFYPPVYYSFMCDPFFCNLYLGFITILGIATVLVSLLPVFQSPEFRVVRASLFFGMGFSGAAPILHKLIIFWDQPEALHTTGYEILMGLLYGLGALIYATRIPERWMPGKFDIAGHSHQLFHVLVVAGAFTHYRAGLVYLKWRDIEGCS

SEQ ID NO: 13722 - protein, 385 aa, Arabidopsis thaliana
MGDEAEIKEHLKPQASSETMDKKHNVKGKRLWQKVKYQLVEFHSLPAYLRDNEYIIGHYRSEWPIKQILLSIFTIHNETLNVWTHLIGFFLFLALTIYTATKVPSVVDLHSLQHRLPDLLRKTDLHKLHSELMARLPSSPSSWHVMDLLYNCLPERFSHGNYTDMCVLHSVREDLANLIAPLIFRPITRWPFYAFLGGAMFCLLASSTCHLLSCHSERVSYIMLRLDYAGIAALIATSFYPPVYYSFMCDPFFCNLYLGFITILGIATVLVSLLPVFQSPEFRVVRASLFFGMGFSGLAPILHKLIIFWDQPEALHTTGYEILMGLLYGLGALVYATRIPERWMPGKFDIAGHSHQLFHVLVVAGAFTHYRAGLVYLKWRDIEGC

SEQ ID NO: 13723 - protein, 219 aa, Brassica oleracea
  misc_feature (179)..(179): Xaa can be any naturally occurring amino acid
LVEYHALPAYLRDNEYILGHYRSEWPIKQILLSIFTIHNETLNVWTHLIGFFLFLALTIYTATKVPSVVDLHSLQHRLPDVLRKTDLHKLHSDLMSRLPSSPSKWHVMELLYNCLPERFSHGNSTDMCVLHSVKEDLANMIAPLIFRPITRWPFYAFLGGAMFCLLASSTCHLLSCHSXRVSYIMLRLDYAGIAALISTSFYPPVYYSFMCDPFFCTST

SEQ ID NO: 13724 - protein, 360 aa, Brassica napus
MVVGETSMELDQCFQMMMMKMEGVSIKEWKDIPVELLMRILSLVDDRNVIAASGVCCGWRDAISLGLTRLRLSWCNNNMNSLVLSLAPKFIKLQTLILRQDKPQLEDNAVEAIANHCHELQELDLSKSLRLTDRSLYALAHGCPNLTKLNLSACTSFSDKAIAYLTTFCRNLKVLNLCGCVNAVSDYTLEAIGNNCNQMQSLNLGWCEKISDDGVMSLAYGCPDLRTLDLCGCVLITDESVVALADWCVHLRSLGLYYCRNITDRAMYSLAQSGVKNKPGGQWKSSAKKSKFDEEGLRSLNISQCTALTPSAVQAVCDTFPALHTCSGRHSLVMSGCLNLTSVHCACILQAHRSVPHSAH

SEQ ID NO: 13725 - protein, 358 aa, Eutrema halophilum
MVGGASMELDQCFQKMKMEGISIKEWKDIPVELLMRILSLVDDRNVIVASGVCSGWRDAISLGLTRLRLSWCKNNMNSLVLSLAPKFVKLQALILRQDKPQLEDNAVEAIANHCHELQELDLSKSLKLTDRSLYALAHGCPNLTKLNLSGCTSFSDTAIAYLIRFCRKLKVLNLCGCVQAVSDHALEAIGNNCNQLQSLNLGWCENISDDGVMSLAYGCPDLRTLDLCGCVLITDESVVALADWCVHLRSLGLYYCRNITDRAMYSLAQSGVKNKPGQWKSVKKEKYDEEGLRSLNISQCTALTPSAVQAVCDTFPALHTCSGRHSLVMSGCLNLTSVHCACILQAHRAHSVFPHPAH

SEQ ID NO: 13726 - protein, 358 aa, Eutrema parvulum
MVGEASMELDQCFQMMKMEGISIKEWKDIPVELLMRILSLVDDRNVIVASGVCSGWRDAISLGLTRLRLSWCNNSMNSLVLSLAPKFVKLQTLILRQDRPQLEENAVEAIANHCRELQELDLSKSLKLTDRSLYALAHGCPNLTKLNLSGCTSFSDTAIAYMTRFCRKLKGLNLCGCVQAVSDHALEAIGNNCNQLQSLNLGWCEKISDDGVMNLAYGCPDLRTLDLCGCVLITDESVVALADWCVHLRSLGLYYCRNITDRAMYSLAQSGVKNKPGLWKSAKKSKYDEEGLRSLNISQCTALTPSAVQAVCDSFPALHTCSGRHSLVMSGCLNLTSVHCACIFRAHRAHSSVPHPAH

SEQ ID NO: 13727 - protein, 360 aa, Arabidopsis lyrata
MVMGGEASMELDQCFQKMKMEGISIKEWRDIPVELLMRILSLVDDRNVIVASGVCCGWRDAFSFGLTRLRLSWCNNNMNSLVLSLAPKFVKLQTLILRQDKPQLEDNAVEAIANHCHELQELDLSKSLKITDRSLYALAHGCPDLTKLNLSGCTSFSDTAIAYLTRLCRKLKVLNLCGCVKAVTDNALEAIGNNCNQMQSLNLGWCENISDDGVMNLAYGCPDLRTLDLCGCVLITDESVVALADWCVHLRSLGLYYCRNITDRAMYSLAQSGVKNKPGSWKSVKKGKYDEEGLRSLNISQCTALTPSAVQAVCDSFPALHTCSGRHSLVMSGCLNLTTVHCACILQAHRAHNAVPHPAH

SEQ ID NO: 13728 - protein, 358 aa, Arabidopsis thaliana
MGGEASMELDQCFQKMKMEGISIKEWKDIPVELLMRILSLVDDRNVIVASGVCTGWRDAISFGLTRLRLSWCNNNMNSLVLSLVPKFVKLQTLNLRQDKPQLEDNAVEAIANHCHELQELDLSKSLKITDRSLYALAHGCPDLTKLNLSGCTSFSDTAIAYLTRFCRKLKVLNLCGCVKAVTDNALEAIGNNCNQMQSLNLGWCENISDDGVMSLAYGCPDLRTLDLCGCVLITDESVVALADWCVHLRSLGLYYCRNITDRAMYSLAQSGVKNKPGSWKSVKKGKYDEEGLRSLNISQCTALTPSAVQAVCDSFPALHTCSGRHSLVMSGCLNLTTVHCACILQAHRAHNAVPHPAH

SEQ ID NO: 13729 - protein, 326 aa, Brassica rapa
  misc_feature (257)..(257): Xaa can be any naturally occurring amino acid
  misc_feature (270)..(270): Xaa can be any naturally occurring amino acid
MVVGETSMELDQCFQMMMMKMEGVSIKEWKDIPVELLMRILSLVDDRNVIAASGVCCGWRDAISLGLTRLRLSWCNNNMNSLVLSLAPKFVKLQTLILRQDKPQLEDNAVEAIANHCHELQELDLSKSLKLTDRSLYALAHGCPNLTKLNLSGCTSFSDKAIAYLTRSCRNLKVLNLCGCVNAVSDYTLEAIGNNCNQMQSLNLGWCEKISDDGVMSLAYGCPDLRTLDLCGCVLITDESVVALADWCVHLRSLGLXYCRNITDRAMYSXAQSGVKNKPGGQWKSSAKKSKFDEEGLRSLNISQCTALTPSAVQAVCDTFPALHTC

SEQ ID NO: 13730 - protein, 359 aa, Brassica napus
MVSEEGSATLDRCFEKMKMEGIVISEWKDIPVELLMKILNLVDDRTVIIASGVCSGWRDAISFGLTRLSLSWCKKNLNSLVLSLAPKLVKLQTLVLRQDNPQLEDNAVEAIANHCHELQDLDLSKSLKLTDHSLYSLARGCTNLTKLNLSGCTSFSDTALAYLTRFCRKLKVLNLCGCVEAVSDNALQAIGENCNEMQSLNLGWCENISDDGVMSLAYGCPDLRTLDLCGCVLITDESVVALANKCVHLRSLGLYYCRNITDRAMYSLAQSGVKNKHEMWRSVKKGKFDEEGLRSLNISQCTYLTPSAVQAVCDTFPALHTCSGRHSLVMSGCLNLTSVHCACILQAHRTHTALPHPAH

SEQ ID NO: 13731 - protein, 364 aa, Eutrema parvulum
MVSEGGSASLSRCFEKMKEMKMEGIVITEWKDIPVELLMRILNLVDDRTVIIASGVCSGWRDAISFGLTPLSLSWCKKNMNSLVLSLAPKFVKLQTLVLRQDKPQLEDNAVEAIANHCHELQDLDLSKSLKLTDHSLYSLAHGCTNLTKLNLSGCTSFSDTALAYLTRFCRKLKILNLCGCVKAVSDNTLQAIGDNCSQMQSLNLGWCENISDDGVMSLAYGCPDLRSLDLCGCVLITDESVVALANRCVHLRSLGLYYCRNITDRAMYSLAQSGVKNKHEMWRSVKKGKFDEEGLRSLNISQCTYLTPSAVQAVCDTFPALHTCSGRHSLVMSGCLNLTSVHCACILQAHRTHTHTAYPHPAH

SEQ ID NO: 13732 - protein, 355 aa, Brassica napus
MMSEGGSLNLCFEKMEGNMITEWKDIPVELLMRILNLVDDRTVIIASGVCSGWRDAISFGLTRLSLSWCKKDMNSLVLSLAPKLVKLQTLVLRQDKPQLEDNAVEAIANHCHELQALDLSKSLKLTDHSLYSLARGCTNLTKLNLSGCTSFSDTALAYLTRFCRKLKVLNLCGCVEAVSDSALQAIGENCSQMQSLNLGWCEKISDDGVMSLAYGCPDLRSLDLCGCVLITDESVVALANRCVHLRSLGLYYCRNITDRAMYSLAQSGVKNKHEMWRSVKKGKFDEEGLRNLNISQCTYLTPSAVQAVCDTFPALHTCSGRHSLVMSGCLNLTSVHCACILQAHRTRTALPHPAH

SEQ ID NO: 13733 - protein, 355 aa, Brassica napus
MMSEGGSLNLCFEKMEGNMITEWKDIPVELLMRILNLVDDRTVIIASGVCSGWRDAISFGLTHLSLSWCKKDMNSLVLSLAPKLVKLQTLVLRQDKPQLEDNAVEAIANHCHELQALDLSKSLKLTDHSLYSLARGCTNLTKLNLSGCTSFSDTALAYLTRFCRKLKVLNLCGCVEAVSDSALQAIGENCSQMQSLNLGWCEKISDDGVMSLAYGCPDLRSLDLCGCVLITDESVVALANRCVHLRSLGLYYCRNITDRAMYSLAQSGVKNKHEMWRSVKKGKFDEEGLRNLNISQCTYLTPSAVQAVCDTFPALHTCSGRHSLVMSGCLNLTSVHCACILQAHRTHTALPHPAH

SEQ ID NO: 13734 - protein, 360 aa, Arabidopsis thaliana
MVSEGATRKELNLCFENMKMEGVLISEWKDIPVELLMKILNLVDDRTVIIASCICSGWRDAVSLGLTRLSLSWCKKNMNSLVLSLAPKFVKLQTLVLRQDKPQLEDNAVEAIANHCHELQDLDLSKSSKITDHSLYSLARGCTNLTKLNLSGCTSFSDTALAHLTRFCRKLKILNLCGCVEAVSDNTLQAIGENCNQLQSLNLGWCENISDDGVMSLAYGCPDLRTLDLCSCVLITDESVVALANRCIHLRSLGLYYCRNITDRAMYSLAQSGVKNKHEMWRAVKKGKFDEEGLRSLNISQCTYLTPSAVQAVCDTFPALHTCSGRHSLVMSGCLNLQSVHCACILQAHRTHTVYPHPAH

SEQ ID NO: 13735 - protein, 363 aa, Arabidopsis lyrata
MVSEGATRKELNLCFEKMKMEGIVISEWKDIPVELLMRILNLVDDRTVIIASCICSGWRDAISLGLTRLSLSWCKKNMNSLVLSLAPKFVKLQTLVLRQDKPQLEDSAVEAIANHCHELQDLDLSKSLKLTDHSLYSLARGCTNLTKLNLSACTSFSDTALAHLTRFCRKLKILNLCGCVEAVSDNTLQAIGENCNQLQSLNLGWCENISDDGVMSLAYGCPDLRTLDLCGCVLITDESVVALANRCIHLRSLGLYYCRNITDRAMYSLAQSGVKNKHEMWRTVKKGKFDEEGLRSLNISQCTYLTPSAVQAVCDTFPALHTCSGRHSLVMSGCLNLQSVHCACILQAHRAHRTHTAFPHPAH

SEQ ID NO: 13736 - protein, 365 aa, Eutrema halophilum
MSEGGAGTRELSRCFEKMKEMKMEGIMITEWKDIPLELLMRILNLVDDRTVIIASGVCSGWRDAISFGLTRLSLSWCKKNMNGLVLSLAPKFVKLQTLVLRQDKPQLEDNAVEAIANHCPELQDLDLSKSLKLTDCSLYSLARGCTNLTKLNLSGCTSFSDTALAYLTRFCRKLKILNLCGCVEAVSDNALQAIGENCNQMQSLNLGWCENISDDGVMNLAYGCPDLRSLDLCGCVLITDESVVALANRCVHLRSLGLYYCRNITDRAMYSLAQSGVKNKHEMWRSVKKGKFDEQGLRSLNISQCTYLTPSAVQAVCDTFPALHTCSGRHSLVMSGCLNLTSVHCACILQAHRAHTHTAFPHPAH

SEQ ID NO: 13737 - protein, 470 aa, Brassica rapa
MEGRRITASPRPCSGGRRVVAKKRPRPDGFVNSVKKLQRREISSRKDRAFSISTAQERFRNMRLVEQYDTHDPKGHCLVALPFLMKRTKVIEIVAARDIVFALAHSGVCAAFSRETNRRICFLNVSPDEVIRSLFYNKNNDSLITVSVYASDNFSSLKCRSTRIEYILRGQPDAGFALFESESLKWPGFVEFDDVNGKVLTYSAQDSVYKVFDLKNYTMLYSISDKHVQEIKISPGIMLLIFKRATSHVPLKILSIEDGTVLKSFNHLLHRNKKVDFIEQFNEKLLVKQENENLQILDVRNAQLMEVSRAEFMTPSAFIFLYENQLFLTFRNRNVSVWNFRGELVTSFEDHLLWHPDCNTNNIYITSDQDLIISYCKADTEDQWIEGNAGSINISNILTGKCLAKITSSSGPPKEDESSSSSSSSLGNNSKLRRNAVAEALEDITALFYDEERNEIYTGNRHGFVHVWSN

SEQ ID NO: 13738 - protein, 468 aa, Brassica napus
MEGRRITASPRPCSGRRVVAKKRTRPDGFVNSVKKLQRREISSRKDRAFSISTAQERFRNMRLVEQYDTHDPKGHSLVALPFLMKRTKVIEIVAARDIVFALAHSGVCAAFSRETNRRICFLNVSPDEVIRSLFYNKNNDSLITVSVYASDNFSSLKCRSTRIEYILRGQPDAGFALFESESLKWPGFVEFDDVNGKVLTYSAQDSVYKVFDLKNYTMLYSISDKHVQEIKISPGIMLLIFKRATSHVPLKILSIEDGTVLKSFNHLLHRNKKVDFIEQFNEKLLVKQENENLQILDVRNAQLMEVSRAEFMTPSAFIFLYENQLFLTFRNRNVSVWNFRGELVTSFEDHLLWHPDCNTNNIYITSDQDLIISYCKADTEDQWIEGNAGSINISNILTGKCLAKITSSSGPPKEDESSSSSSSLGNNSKQRRNAVAEALEDITALFYDEERNEIYTGNRHGFVHVWSN

SEQ ID NO: 13739 - protein, 469 aa, Brassica napus
MEGRRITASPRPCSGGRRVVAKKRPRPDGFVNSVKKLQRREISSRKDRAFSISTAQERFRNMRLVEQYDTHDPKGHCLVALPFLMKRTKVIEIVAARDIVFALAHSGVCAAFSRETNRRICFLNVSPDEVIRSLFYNKNNDSLITVSVYASDNFSSLKCRSTRIEYILRGQPDAGFALFESESLKWPGFVEFDDVNGKVLTYSAQDSVYKVFDLKNYTMLYSISDKHVQEIKISPGIMLLIFKRATSHVPLKILSIEDGTVLKSFNHLLHRNKKVDFIEQFNEKLLVKQENENLQILDVRTAEQMEVSRAEFMTPSAFIFLYENQLFLTFRNRNVSVWNFRGELVTSFEDHLLWHPDCNTNNIYITSDQDLIISYCKADTEDQWIEGNAGSINISNILTGKCLAKITSSSGPPKEDESSSSSSSLGTNSKQRRNAVAEALEDITALFYDEERNEIYTGNRHGFVHVWSN

SEQ ID NO: 13740 - protein, 467 aa, Eutrema halophilum
MEGRRITASPRPCSGRRVVAKKRSRPDGFVNSVKKLQRREISSRKDRAFSISTAQERFRNMRLVEQYDTHDPKGHCLVALPFLMKRTKVIEIVAARDIVFALAHSGVCAAFSRETNRRICFLNVSPDEVIRSLFYNKNNDSLITVSVYASDNFSSLKCRSTRIEYILRGQPDAGFALFESESLKWPGFVEFDDVNGKVLTYSAQDSVYKVFDLKNYTMLYSISDKHVQEIKISPGIMLLIFKRATSHVPLKILSIEDGTVLKSFNHLLHRNKKVDFIEQFNEKLLVKQENENLQILDVRNADLMEVSRAEFMTPSAFIFLYENQLFLTFRNRNVSVWNFRGELVTSFEDHLLWHPDCNTNNIYITSDQDLIISYCKADTEDQWIEGNAGSINISNILTGKCLAKITSSSGPPKEDESSSSSCFGKSSKQRRNAVAEALEDITALFYDEERNEIYTGNRHGLVHVWSN

SEQ ID NO: 13741 - protein, 467 aa, Arabidopsis lyrata
MEGRRITASPRPCSGRRVVAKKRSRPDGFVNSVKKLQRREISSRKDRAFSISTAQERFRNMRLVEQYDTHDPKGHCLVALPFLMKRTKVIEIVAARDIVFALAHSGVCAAFSRESNKRICFLNVSPDEVIRSLFYNKNNDSLITVSVYASDNFSSLKCRSTRIEYILRGQPDAGFALFESESLKWPGFVEFDDVNGKVLTYSAQDSVYKVFDLKNYTMLYSISDKNVQEIKISPGIMLLIFKRAASHVPLKILSIEDGTVLKSFNHLLHRNKKVDFIEQFNEKLLVKQENENLQILDVRNAELMEVSRAEFMTPSAFIFLYENQLFLTFRNRNVSVWNFRGELVTSFEDHLLWHPDCNTNNIYITSDQDLIISYCKADTEDQWIEGNAGSINISNILTGKCLAKITPSSGPPKEDESSSSSCLGKNSKQRRNAVAEALEDITALFYDEERNEIYTGNRHGLVHVWSN

SEQ ID NO: 13742 - protein, 466 aa, Eutrema parvulum
MDGRRITASPRPCSGRRVVAKKRSRPDGFVNSVKKLQRREISSRKDRAFSISTAQERFRNMRLVEQYDTHDPKGHCLVALPFLMKRTKVIEIVAARDIVFALAHSGVCAAFSRETNRRICFLNVSPDEVIRSLFYNKNNDSLITVSVYASDNFSSLKCRSTRIEYILRGQPDAGFALFESESLKWPGFVEFDDVNGKVLTYSAQDSVYKVFDLKNYTMLYSISDKHVQEIKISPGIMLLIFKRATSHVPLKILSIEDGTVLKSFNHLLHRNKKVDFIEQFNEKLLVKQENENLQILDVRNAELMEVSRAEFMTPSAFIFLYENQLFLTFRNRNVSVWNFRGELVTSFEDHLLWHPDCNTNNIYITSDQDLIISYCKADTEDQWIEGNAGSINISNILTGKCLAKITPSSGPPKEDESSSSNLGTNSKQRRNAVAEALEDITALFYDEERNEIYTGNRHGLIHVWSN

SEQ ID NO: 13743 - protein, 467 aa, Brassica napus
MEGRRITASPRPCSSGRRVVAKKRPRPDGFVNSVKKLQRREISSRKDRAFSINTAQERFRNMRLVEQYDTHDPKGHCLVALPFLMKRTKVIEIVAARDIVFALAHSGVCAAFSRETNRRICFLNVSPDEVIRSLFYNKNNDSLITVSVYASDNFSSLKCRSTRIEYILRGQPDAGFALFESESLKWPGFVEFDDVNGKVLTYSAQDSVYKVFDLKNYTMLYSISDKHVQEIKISPGIMLLIFKRATSHVPLKILSIEDGTVLKSFNHLLHRNKKVDFIEQFNEKLLVKQENENLQILDVRTAEQMEVSRAEFMTPSAFIFLYENQLFLTFRNRNVSVWNFRGELVTSFEDHLLWHPDCNTNNIYITSDQDLIISYCKADTEDQWIEGNAGSINISNILTGKCLAKITSSSGPPKEDESSSSSLGTNSKQRRNAVAEALEDITALFYDEERNEIYTGNRHGFVHVWSN

SEQ ID NO: 13744 - protein, 467 aa, Brassica napus
MEGRRITASPRPCSSGRRVVAKKRPRPDGFVNSVKKLQRREISSRKDRAFSINTAQERFRNMRLVEQYDTHDPKGHCLVALPFLMKRTKVIEIVAARDIVFALAHSGVCAAFSRETNRRICFLNVSPDEVIRSLFYNKNNDSLITVSVYASDNFSSLKCRSTRIEYILRGQPDAGFALFESESLKWPGFVEFDDVNGKVLTYSAQDSVYKVFDLKNYTMLYSISDKHVQEIKISPGIMLLIFKRASSHVPLKILSIEDGTVLKSFNHLLHRNKKVDFIEQFNEKLLVKQENENLQILDVRTAEQMEVSRAEFMTPSAFIFLYENQLFLTFRNRNVSVWNFRGELVTSFEDHLLWHPDCNTNNIYITSDQDLIISYCKADTEDQWIEGNAGSINISNILTGKCLAKITSSSGPPKEDESSSSSLGTNSKQRRNAVAEALEDITALFYDEERNEIYTGNRHGFVHVWSN

SEQ ID NO: 13745 - protein, 472 aa, Raphanus sativus
MEGRRITASPRPCSGRRRVAVAAKKRPRPDGFVSSVKKLQRREISSRKDRAFSISTAQERFRNMRLVEQYDTHDPKGHCLVALPFLMKRTKVIEIVAARDIVFALAHSGVCAAFSRETNTRVCFLNVSPDEVIRSLFYNKNNDSLITVSVYASDNFSSLKCRSTRIEYILRGQPDAGFALFESESLKWPGFVEFDDVNGKVLTYSAQDSVYKVFDLKNYTMLYSISDKNVQEIKISPGIMLLIFKRATSHVPLKILSIEDGTVLKSFNHLLHRNKKVDFIEQFNEKLLVKQENENLQILDVRTAKQMEVSRAEFMTPSAFIFLYENQLFLTFRNRNVSVWNFRGELVTSFEDHLLWHPDCNTNNIYITSDQDLIISYCKADTEDQWIEGNAGSINISNILTGKCLAKITSSSGPPKENESSTSSSSSLGTNSKQRRNAVAEALEDITALFYDEERNEIYTGNRHGFVHVWSN

SEQ ID NO: 13746 - protein, 467 aa, Arabidopsis thaliana
MEGRRITASPRPCSGRRIVAKKRSRPDGFVNSVKKLQRREISSRKDRAFSISTAQERFRNMRLVEQYDTHDPKGHCLVALPFLMKRTKVIEIVAARDIVFALAHSGVCAAFSRESNKRICFLNVSPDEVIRSLFYNKNNDSLITVSVYASDNFSSLKCRSTRIEYILRGQPDAGFALFESESLKWPGFVEFDDVNGKVLTYSAQDSVYKVFDLKNYTMLYSISDKNVQEIKISPGIMLLIFKRAASHVPLKILSIEDGTVLKSFNHLLHRNKKVDFIEQFNEKLLVKQENENLQILDVRNAELMEVSRAEFMTPSAFIFLYENQLFLTFRNRNVSVWNFRGELVTSFEDHLLWHPDCNTNNIYITSDQDLIISYCKADTEDQWIEGNAGSINISNILTGKCLAKITPSSGPPKDDESSSSNCMGKNSKQRRNAVAEALEDITALFYDEERNEIYTGNRHGLVHVWSN

SEQ ID NO: 13747 - protein, 468 aa, Raphanus sativus
  misc_feature (9)..(9): Xaa can be any naturally occurring amino acid
  misc_feature (26)..(26): Xaa can be any naturally occurring amino acid
  misc_feature (30)..(30): Xaa can be any naturally occurring amino acid
  misc_feature (79)..(79): Xaa can be any naturally occurring amino acid
  misc_feature (88)..(88): Xaa can be any naturally occurring amino acid
  misc_feature (105)..(105): Xaa can be any naturally occurring amino acid
  misc_feature (117)..(117): Xaa can be any naturally occurring amino acid
  misc_feature (119)..(119): Xaa can be any naturally occurring amino acid
  misc_feature (247)..(247): Xaa can be any naturally occurring amino acid
MEGRRITAXPRPCSGRRVVAAAKKRXRPDXFVNSVKKLQRREISSRKDRAFSISTAQERFRNMRLVEQYDTHDPKGHCXVALPFLMKXTKVIEIVAARDIVFALXHSGVCAAFSREXNXRICFLNVSPDEVIRSLFYNKNNDSLITVSVYASDNFSSLKCRSTRIEYILRGQPDAGFALFESESLKWPGFVEFDDVNGKVLTYSAQDSVYKVFDLKNYTMLYSISDKHVQEIKISPGIMLLIFKRAXSHVPLKILSIEDGTVLKSFNHLLHRNKKVDFIEQFNEKLLVKQENENLQILDVRNADQMEVSRAEFMTPSAFIFLYENQLFLTFRNRNVSVWNFRGELVTSFEDHLLWHPDCNTNNIYITSDQDLIISYCKADTEDQWIEGNAGSINISNILTGKCLAKITPSSAPPKEDESSSTSLGNNSKQRINAVAEALEDITALFYDEERNEIYTGNRHGFVHVWSN

SEQ ID NO: 13748 - protein, 466 aa, Arabidopsis lyrata
MEGRRIIANPRPCSGSKRVVAKKRSRPDGIVNSVKKLQRREISSRMDRAFSISTAQERFRNMRLVEQYDTHDPKGYCLVSLPNLLKRSKVIEIVAARDIVFALTLSGVCASFSRETNKRVCFLNVSPDEVIRSLFYNKNNDSLITVSVYASDNYSSLKCRSTRIEYILRGQADAGFPLFESESLKWPGFVEFDDVNGKVLTYSAQDSVYKVFDLKNYALLYSVSDKNVQEIKISPGIMLLIFKRAVSHVPLKILSIEDGTVLKSFNHLLHRNKKVDFIEQFNEKLLVKQENENLQILDVRNAELIEVSRTEFMTPSAFIFLYENQLFLTFRNRNVSVWNFRGELVTSFEDHLLWHPDCNTNNIYITSDQDLIISYCKADTEDQWIEGNAGSINISNILTGKCLAKIKADNGPPKEEDCSSSDMGNSNRRISAVAEALEDITALFYDEERNEIYTGNRHGFLHVWSN

SEQ ID NO: 13749 - protein, 466 aa, Arabidopsis thaliana
MEGRRIIANPRPCSGSRRVIAKKRSRPDGFVNSVKKLQRREISSRMDRAFSISTAQERFRNMRLVEQYDTHDPKGYCLVSLPNLLKRSKVIEIVAARDIVFALTLSGVCASFSRETNKKVCFLNVSPDEVIRSLFYNKNNDSLITVSVYASDNYSSLKCRSTRIEYILRGQADAGFPLFESESLKWPGFVEFDDVNGKVLTYSAQDSVYKVFDLKNYALLYSISDKNVQEIKISPGIMLLIFKRAASHVPLKILSIEDGTLLKSFHHLLHRNKKVDFIEQFNEKLLVKQENENLQILDVRNAELIEVSRTDFMTPSAFIFLYENQLFLTFRNRNVSVWNFRGELVTSFEDHLLWHPDCNTNNIYITSDQDLIISYCKADTEDQWIEGNAGSINISNILTGKCLAKIKANNGPPKEEDCSSSDLGNSSRRRSAVAEALEDITALFYDEERNEIYTGNRHGLLHVWSN

SEQ ID NO: 13750 - protein, 461 aa, Eutrema halophilum
MEGRRIIADPRPCIGRRVVANKRSRPDGFVNSVKKLQRREISSRRDRGFSISTAQERFRNMRLVEQYDTHDLKGDCLVALPFLMKRTKLIEIVAARDIVFALAHSGVCASFSRETNKRVCFLNVSPDEVIRSLFYNKNNDSLITVSVYASDNFSSLKCRSTRIEYIMRGQADAGFPLFESESLKWPGFVEFDDVNGKVLTYSAQNSVYKVFDLKNYAMLYSISDKNVQEIKISPGIMLLIFKRASSHVPLKILSIEDGTVLKSFNHLLHRNKKVDFIEQFNEKLLVKQENENLQILDVRNADVIEVSRTEFMTPSAFIFLYENQLFLTFRNRNVSVWNFRGELVTSFEDHLLWHPDCNTNNIYITSDQDLIISYCKADTEDQWMEGNAGSINISNILTGKCLAKIKASNGLQNEEESCSSSNQRNSAVSEALEDITALYYDEERNEIYTGNRHGFLHVWSN

SEQ ID NO: 13751 - protein, 469 aa, Citrullus lanatus
MEGRRISASPRPCSGRRILAKKRPRVDGFVNSVKKLQRREICSKRDRAFSMSNAQERFRNMRLMEEYDTHDPKGHCSPVLPFLMKRTKVIEIVAARDIVFALAHSGVCAAFSRETNERICFLNVSPDEVIRSLFYNKNNDSLITVSVYASDNFSSLKCRSTRIEYIRRGKPDAGFALFESESLKWPGFVEFDDVNGKVLTYSAHDSIYKVFDLKNYTMLYSISDKHVQEIKISPGIMLLIFNRASSHVPLKILSIEDGTVLKAFNHLLHRNKKVDFIEQFNEKLLVKQENENLQILDVRNAELMEVSRTEFMTPSAFIFLYENQLFLTFRNRTVAVWNFRGELVTSFEDHLLWHPDCNTNNIYITSDQDLIISYCKADSDDHWMEGNAGSINISNILTGKCLAKINASNGNPKVDDSSSAGISRKKCNSSQMRNTVAEALEDITALFYDEERNEIYTGNKNGLVHVWSN

SEQ ID NO: 13752 - protein, 466 aa, Manihot esculenta
MEGRRISANPRPCSGRRILAKKRPRTNGFVNTVKKLQRREISSKRDRAFSMSNAQERFRNMRLMEEYDTHDPKGHCSVVLPFLMKRTKVIEIVAARDIVFALAHSGVCAAFSRETNQRICFLNVSPDEVIRSLFYNKNNDSLITVSVYASDNFSSLKCRSTRIEYIRRGKPDAGFALFESESLKWPGFVEFDDVNGKVLTYSAQDSVYKVFDLKNYTMLYSISDKHVQEIKISPGIMLLIFNRASSHVPLKILSIEDGTVLKAFNHLLHRNKKVDFIEQFNEKLLVKQENENLQILDVRNSELMEVSRTEFMTPSAFIFLYENQLFLTFRNRTVAVWNFRGELVTSFEDHLLWHPDCNTNNIYITSDQDLIISYCKAESEDQWMEGNAGSINVSNILTGKCLAKINASNGNPKGDECSGSTSKQSHSPMRSTVAEALEDITALFYDEERNEIYTGNRHGLVHVWSN

SEQ ID NO: 13753 - protein, 419 aa, Brassica napus
ISTAQERFRNMRLVEQYDTHDPKGHSLVALPFLMKRTKVIEIVAARDIVFALAHSGVCAAFSRETNRRICFLNVSPDEVIRSLFYNKNNDSLITVSVYASDNFSSLKCRSTRIEYILRGQPDAGFALFESESLKWPGFVEFDDVNGKVLTYSAQDSVYKVFDLKNYTMLYSISDKHVQEIKISPGIMLLIFKRATSHVPLKILSIEDGTVLKSFNHLLHRNKKVDFIEQFNEKLLVKQENENLQILDVRNAQLMEVSRAEFMTPSAFIFLYENQLFLTFRNRNVSVWNFRGELVTSFEDHLLWHPDCNTNNIYITSDQDLIISYCKADTEDQWIEGNAGSINISNILTGKCLAKITSSSGPPKEDESSSSSSSSLGNNSKLRRNAVAEALEDITALFYDEERNEIYTGNRHGFVHVWSN

SEQ ID NO: 13754 - protein, 474 aa, Cucumis sativus
MEGRRISASPRPCSGRRILAKKRPRVDGFVNSVKKLQRREICSKRDRAFSMSNAQERFRNMRLMEEYDTHDPKGHCSPVLPFLMKRTKVIEIVAARDIVFALAHSGVCAAFSRETNERICFLNVSPDEVIRSLFYNKNNDSLITVSVYASDNFSSLKCRSTRIEYIRRGKPDAGFALFESESLKWPGFVEFDDVNGKVLTYSAQDSIYKVFDLKNYTMLYSISDKHVQEIKISPGIMLLIFNRASSHVPLKILSIEDGTVLKAFNHLLHRNKKVDFIEQFNEKLLVKQENENLQILDVRNAELMEVSRTEFMTPSAFIFLYENQLFLTFRDRTVAVWNFRGELVTSFEDHLLWHPDCNTNNIYITSDQDLIISYCKADSDDHWMVGNAGSINISNILTGKCLAKINASNGNPKVNDSSSSSSSSAGSSRKVCNSSQMRNTVAEALEDITALFYDEERNEIYTGNKNGLVHVWSN

SEQ ID NO: 13755 - protein, 492 aa, Eutrema parvulum
MEGRRIVANPRPCSGRRVVAKKRSRPDGFVNSVKKLQRREISSRMDRGFSISTAQERFRNMRLVEQYDTHDPKGHCLVSLPFLMKRTKVIEIVAARDIVFALAHSGVCASFSRETNKRVCFLNVSPDEVIRSLFYNKNNDSLITVSVYASDNFSSLKCRSTRIEYALLSYCCVFLGLVLRLFKFMCFSCTDRYIMRGQADAGFPLFESESLKWPGFVEFDDVNGKVLTYSAQDSVYKVFDLKNYAMLYSISDKNVQEIKISPGIMLLIFKRATSHVPLKILSIEDGTVLKSFNHLLHRNKKVDFIEQFNEKLLVKQENENLQILDVRNAELIEVSRTEFMTPSAFIFLYENQLFLTFRNRNVSVWNFRGELVTSFEDHLLWHPDCNTNNIYITSDQDLIISYCKADTEDQWIEGNAGSINVSNILTGKCLAKIKASNGLPKEEECSSSLGKSKQRKTAVAEALEDITALFYDEERNEIYTGNRHGFLHVWSN

SEQ ID NO: 13756 - protein, 474 aa, Citrus sinensis
MEGLGRRISASPRPCSGRRVLAKKRVRSDGFVNSVKKLQRREICSKRDRAFSISNAQERFRNMHLVEEYDTHDPKGHCPFVLPFLMKRTKVIEIVAARDIVFALAHSGVCAAFSRETNRRICFLNVSPDEVIRSLFYNKNNDSLITVSVYASDNFSSLKCRSTKIEYIRRGKPDSGFALFESESLKWPGFVEFDDVNGKVLTYSAQDSIYKVFDLKNYTMLYSISDKHVQEIKISPGIMLLIFNRSSSHVPLKILSIEDGTVLKVFYHLLHRNKKVDFIEQFNEKLLVKQENENLQILDVRNAELMEVSRTEFMTPSAFIFLYENQLFLTFRNRTVAVWNFRGELVTSFEDHLLWHPDCNTNNIYITSDQDLIISYCKAEPEDQWMEGSAGSINVSSILTGKCLAKINATNCSPKVDDELGSSSTGKSKKLNKSSYIRSTVGEALEDITSLFYDEERNEIYTGNRHGLVHVWSN

SEQ ID NO: 13757 - protein, 474 aa, Unknown
  Sequence found in Organisms: Citrus sinensis, Citrus clementina
MEGLGRRISASPRPCSGRRVLAKKRVRSDGFVNSVKKLQRREICSKRDRAFSISNAQERFRNMHLVEEYDTHDPKGHCPFVLPFLMKRTKVIEIVAARDIVFALAHSGVCAAFSRETNRRICFLNVSPDEVIRSLFYNKNNDSLITVSVYASDNFSSLKCRSTKIEYIRRGKPDSGFALFESESLKWPGFVEFDDVNGKVLTYSAQDSIYKVFDLKNYTMLYSISDKHVQEIKISPGIMLLIFNRSSSHVPLKILSIEDGTVLKVFYHLLHRNKKVDFIEQFNEKLLVKQENENLQILDVRNAELMEVSRTEFMTPSAFIFLYENQLFLTFRNRTVAVWNFRGELVTSFEDHLLWHPDCNTNNIYITSDQDLIISYCKAEPEDQWMEGSAGSINVSSILTGKCLAKINATNCSPKVDDELGSSSTGKSKKLNKCSYIRSTVGEALEDITSLFYDEERNEIYTGNRHGLVHVWSN

SEQ ID NO: 13758 - protein, 471 aa, Prunus persica
MEGGRRISASPRPCNGRRVVAKKRPRVGGVDGFVNSVKKLQRREISSKRDRAFTMSDAQERFRNIRLQEEYDTHDPKGHCAMVLPFLRKRSKIIEIVAARDIVFALAQSGVCAAFSRETNQRICFLNVSPDEVIRSLFYNKNNDSLITVSVYASDNFSSLKCRSTRIEYIRRGKPDAGFALFESESLKWPGFVEFDDVNGKVLTYSAQDNIYKVFDLKNYTMLYSISDKHVQEIKISPGIMLLIFTKASSHVPLKILSIEDGTVLKSFNHLLHRNKKVDFIEQFNEKLLVKQENENLQILDVRNFELTEVSRTEFMTPSAFIFLYENQLFLTFRNRTVAVWNFRGELVTSFEDHLLWHPDCNTNNIYITSDQDLIISYCKADSDDPLSEGNAGSINISNILTGKCLAKIRASNNKEIECGSSCNSKKRALSSRIRSTVAEALEDITALFYDEERNEIYTGNRLGLVHVWSN

SEQ ID NO: 13759 - protein, 472 aa, Quercus alba
MEGGPGHRLSAPCWGRRVIANNKKRVRGGDGCINSVKKLHRREISSNRNRAFSITNAQERFRNMRLMEEYDTHDPKGHNSPVLPFLMKRAKVIEIVAARDIVFALAHSGVCAAFSRETNQRICFLNVCHDEVIRSLFYNKNNDSLITVSVYASDNFSSLKCRSTRIEYIRRGKPDAGFPLFESESLKWPGFVEFDDVNGKVLTYSAQDSIYKVFDLKNYTMLYSISDKHVQEIKISPGIMLLIFNRASSHVPLKILSIEDGTVLKSFNHLLHRNKKVDFIEQFNEKLLVKQENENLQILDVRNAELMEVSRAEFMTPSAFIFLYENQLFLTFRDRTVAVWNFRGELVTSFEDHLLWHPDCNTNNIYITSDQDLIISYCKADSDEQWMEGNAGSINISNILTGKCLAKINATNGIPKGDECSTSAGSSKKQDYSKVRSTVAEALEDITALFYDEERNEIYTGNRHGLVHVWSN

SEQ ID NO: 13760 - protein, 409 aa, Cleome gynandra
MEGRRITASPRPCSGRRVVAKKRSRPDGFVNSVKKLQRREISSRKDRSFSISTAQEKFRNMRLVEQYDTHDPKGHCLVALPFLMKRTKVIEIVAARDIVFALAHSGVCAAFSRETNKRICFLNVSPDEVIRSLFYNKNNDSLITVSVYASDNFSSLKCRSTRIEYILRAQPDAGFALFESESLKWPGFVEFDDVNGKVLTYSAQDSVYKVFDLKNYTMLYSISDKHVQEIKISPGIMLLIFKRATSHVPLKILSIEDGTVLKSFNHLLHRNKKVDFIEQFNEKLLVKQENENLQILDVRNAELMEVSRTEFMTPSAFIFLYENQLFLTFRNRTVSVWNFRGELVTSFEDHLLWHPDCNTNNIYITSDQDLIISYCKADTEDQWIEGNAGSINISNILTGKCLAKITASS

SEQ ID NO: 13761 - protein, 464 aa, Vitis vinifera
MEGRRISAIPRPCAGRRVSASKKRPRVDGFLNSVKKLQRREISSRRDRGFSISNAQERFRNMRLREEYDTHDPKGPYSPVLPFKRTKVIEIVAARDIVFALAHSGVCAAFSRETNERICFLNVSPDEVIRSLFYNKNNDSLITVSVYASDSFSSLKCRSTRIEYIRRGKPEEGFALFESESLKWPGFVEFDDVNGKVLTYSAQDSIYKVFDLKNYVMLYSISDENVQEIKISPGIMLLIFNRATSHVPLKILSIEDGTVLKDFNHLLHRNKKVDFIEQFNEKLLVKQENENLQILDVRNTELKEVNRTEFMTPSAFIFLYENQLFLTFRNRTVAVWNFRGELVTSFEDHLLWHPDCNTNNIYITSDQDLIISYCKADSSDHWTEGNAGSINISNILTGKCLAKINASDGRPKVEERKRRRTGSSCMIRSTVAEALEDITALFYDEERNEIYTGNKNGLVHVWSN

SEQ ID NO: 13762 - protein, 472 aa, Populus trichocarpa
MEGSGRRISAANPRPCSGRRILAAKKRGRSDGFLNSVKKLQRREISSKSDRSFSITNAQERFRNMRLMEEYDTHDPKGHCSMVLPFLMKRTKVIEIVAARDIVFALAHSGVCAAFSRETNQRICFLNVSPDEVIRSLFYNKNNDSLITVSVYASDNFSSLKCRSTRIEYIRRGKPDAGFPLFESESLKWPGFVEFDDVNGKVLTYSAQDSIYKVFDLKNYTMLYSISDTDVQEIKISPGIMLLILNRSSGYVPLKILSIEDGTILKDFKHLLHRNKKVDFIEQFNEKLLVKQENENLQILDVRHTGIREVSRTDFMTPSAFIFLYENQLFLTFRNRTVAVWNFRGELVTSFEDHLLWHPDCNTNNIYITSDQDLIISYCKADSDDQWMEGNAGSINISNILTGKCLAKINATNGSPKDEECSSSTGSSKQSRLMMRSTVAAALEDITALFYDEERNEIYTGNRHGLVHVWSN

SEQ ID NO: 13763 - protein, 471 aa, Euonymus alatus
MEGRRISASPRPCSGRRVVAKKRARSDVIMNSVKKLQRREISSKRDRAFTVSNAQERFRNMRLTVEYDTHDPKGHCSVVLPFLVKRTKVIEIVAALDIVFALAHSGVCAAFSRETNDRICFLNVSHDEVIRSLFYNKNNDSLITVSVYASDNFSSLKCRSTRIEYIRRGKPDAGFALFESESLKWPGFVEFDDVNGKVLTYSAQDSIYKVFDLKNYTMLYSISDKNVQEIKISPGIMLLIFNRASSHVPLKILSIEDGTVLKAFNHLLHRNKKVDFIEQFNEKLLVKQENENLQIRDVRTSELMEVGRNEFMTPSAFIFLYENQLFLTFRNRTVAVWNFRGELVTSFEDHLLWHPDCNTNNIYITSDQDLIISYCRAESDYQWGEGNAGSINISNILTGKCLAKINATNASPTVEECSSTSTSNSKKRIIAAPMTSTVSEALEDITALFYDEERNEIYTGNRHGLVHVWSN

SEQ ID NO: 13764 - protein, 483 aa, Eucalyptus grandis
MEGRRILANPRPCSGRRVVAKKRPRGEGFVNSVKKLQRREIRSKRDRAFSMSNAQERFRNMRLTEEYDTHDPSGHCSPVLPFLMNRTKVIEIVAAHDIVFALNHSGVCAAFSRESNERICFLNVTPDEVIRSLFYNKNNDSLITVSVYASDNFSSLKCRSTRIEYIRRGQPDAGFALFESESLKWPGFVEFDDVNGKVLTYSAQDSIYKVFDLKNYTMLYSISDKHVQEIKISPGIMLLIFNRSTSHVPLKILSIEDGTVLKAFNHLLHRNKKVDFIEQFNEKLLVKQENENLQILDVRNAEVMEVSRTEFMTPSAFIFLYENQLFLTFRNRTVSVWNFRGELVTSFEDHLLWHPDCNTNNIYITSDQDLIISYCKADSDDHWAEGNAGSINISNILTGKCLAKINATNGSPKVDECSSDGGNTKKMKLLGGKLKKQKLLSHSQRMRSTVSEALEDITALFYDEERNEIYTGNRRGLVHVWSN

SEQ ID NO: 13765 - protein, 477 aa, Coffea canephora
MDGRRITASPRPCSGRRVVAKKRPRGGMDGFVNSVKKLQRREISSRRDRAFSMSDAQERFRNIRLQEEYDTHDPKGQCSVVLPFLRKRSKIIEIVAARDIVFALAQSGVCAAFSRETNERICFLNVSPDEVIRSLFYNKNNDSLITVSVYASDNFSSLKCRTTRIEYIRKGKPDAGFPLFESESLKWPGFVEFDDVNGKVLTYSAQDSIYKVFDLKNYTMLYSISDKNVQEIKISPGIMLLIFTKACGHVPLQILSIEDGTVLKSFNHLLHRNKKVDFIEQFNEKLLVKQENENLQILDVRNSELTEVSRTEFMTPSAFIFLYENQLFLTFRNRTVAVWNFRGELVTSFEDHLLWHPDCNTNNIYITSDQDLIISYCKADSDDPLSEGNAGSINISNILTGKCLAKIKVSNSSPLDDCCCSSSCGGRSCNSQKRVQAAKVRSTVAEALEDITALFYDEERNEIYTGNRLGLVHVWSN

SEQ ID NO: 13766 - protein, 478 aa, Malus domestica
MEGGRRISASPRPCNGRRVVAKKRPRIGGVDGFVNSVKKLQRREISSKRDRAFTMSDAQERFRNIRLQDEYDTHDPKGHCAMVLPFLRKRSKIIEIVAARDIVFALAQSGVCAAFSRETNQRICFLNVSPDEVIRSLFYNKNNDSLITVSVYASDNFSSLKCRSTRIEYIRRGKPDAGFALFESESLKWPGFVEFDDVNGKVLTYSAQDSIYKVFDLKNYTMLYSISDKNVQEIKISPGIMLLIFTKASSHVPLKILSIEDGTVLKSFNHLLHRNKKVDFIEQFNEKLLVKQENENLQILDVRNFEMTEVSRTQFMTPSAFIFLYENQLFLTFRNRTVAVWNFRGELVTSFEDHLLWHPDCNTNNIYITSDQDLIISYCKADSDDPLSEGNAGSINISNILTGKCLAKIRATNNAEKECTCSGESCGSSCNSKKRALSSRIRSTVAEALEDITALFYDEERNEIYTGNRLGLVHVWSN

SEQ ID NO: 13767 - protein, 476 aa, Amsonia hubrichtii
MDGRRITASPRPCSGRRVVAKKRPRGGMDGFVNSVKKLQRREISSKRDRAFSMSDAQERFRNIRLQEEYDTHDPKGQVSMVLPFLRKRSKIIEIVAARDIVFALAQSGVCAAFSRETNERICFLNVSPDEVIRSLFYNKNNDSLITVSVYASDNFSSLKCRTTRIEYIRRGKPDAGFPLFESESLKWPGFVEFDDVNGKVLTYSAQDSIYKVFDLKNYTMLYSISDKNVQEIKISPGIMLLIFTKASGHVPLKILSIEDGTVLKSFNHLLHRNKKVDFIEQFNEKLLVKQENENLQILDVRNSELTEVSRTEFMTPSAFIFLYENQLFLTFRNRTVAVWNFRGELVTSFEDHLLWHPDCNTNNIYITSDQDLIISYCKADSDDPLSGGNAGSINISNILTGKCLAKIKASNGVPLDDCTCDADCGGRSCNSRKRVKASMRSSVAEALEDITALFYDEERNEIYTGNRLGLVHVWSN

SEQ ID NO: 13768 - protein, 467 aa, Tripterygium wilfordii
RISASPRPCSGRRVVAKKRAQSDVIMNSVKKLQRREISSKIDRAFTVSNAQERFRNMRLTVEYDTHDSKGHCSVVLPFLAKRTKVIEIVAARDIVFALAHSGVCAAFSRETNDRICFLNVSPDEVIRSLFYNKNNDSLITVSVYASDSFSSLKCRSTRIEYIRRGKPDAGFALFESESLKWPGFVEFDDVNGKVLTYSAQDSIYKVFDLKNYTMLYSISDKNVQEIKISPGIMLLIFNRASSHVPLKILSIEDGTVLKAFNHLLHRNKKVDFIEQFNEKLLVKQENENLQIRDVRTSELMEVSRNEFMTPSAFIFLYENQLFLTFRNRTVAVWNFRGELVTSFEDHLLWHPDCNTNNIYITSDQDLIISYCRAESDYQWGEGNAGSINISNILTGKCLAKINVTNASPTVEECSSSSTGNSKKRIVAAPMMSTVSEALEDITALFYDEERNEIYTGNRLGLVHVWSN

SEQ ID NO: 13769 - protein, 435 aa, Manihot esculenta
NTVKKLQRREISSKRDRAFSMSNAQERFRNMSLTEEYDTHDPKGHCSVVLPFLMKRTKVIEIVAARDIVFALAHSGVCAAFSRETNQRICFLNVSPDEVIRSLFYNKNNDSLITVSVYASDNFSSLKCRSTRIEYIRRGKPDAGFALFESESLKWPGFVEFDDVNGKVLTYSAQDSVYKVFDLKNYTMLYSISDKHVQEIKISPGIMLLIFNRATSHVPLKILSIEDGTVLKAFNHLLHRNKKVDFIEQFNEKLLVKQENENLQILDVRNAELMEVSRTEFMTPSAFIFLYENQLFLTFRNRTVAVWNFRGELVTSFEDHLLWHPDCNTNNIYITSDQDLIISYCKAESEDQWMEGKAGSINVSNILTGKCLAKINASNGNPKCDEPSGSSSKRIHSPISTVAEALEDITALFYDEERNEIYTGNRHGLVHVWSN

SEQ ID NO: 13770 - protein, 470 aa, Populus trichocarpa
MEGRRISAANPRPCSGRRILAAKKRGRSDGFLNSVKKLQRREISSKPDRSFSITNAQERFRNMRLMEEYDTHDPKGHCSVVLPFLMKRTKVIEIVAAQDIIFALAHSGVCAAFSRVTNHRICFLNASPDEVILSLFYNKNNDSVITVSVYASDNFSSLKCRSTRIEYIRRGNPDAGFALFESESLKWPGFVEFDDVNGKVLTYSAQDSMYKVFDLKNYTMLYSISDKDVQEIKISPGIMLLILNRSSSYVPLKILSIEDGTILKDFHHLLHRNKKVDFIEQFNEKLLVKQENENLQILDVRHTGIREVSRTEFLTPSAFIFLYENQLFLTFRNRTVAVWNFRGELVTSFEDHLLWRPDCNTNNTYITSDQDLIISYCKAESDDQWMEGNGGSINISNILTGKCLAKINATNGSPKDEECCSSTGSSKQSCSLMKSTVAEALEDITALFYDEDRNEIYTGNRHGLVHVWSN

SEQ ID NO: 13771 - protein, 473 aa, Theobroma cacao
MDGGRRIAVSPRPCSGRRIVASKKRGRADSFVNSVKKLQRREICSKRHRAFSITDAQERFRNIRLQEEYDTHDPKGHCSMVLPFLRKRSKIIEIVAARDIVFALAQSGVCAAFSRETNQRICFLNVTADEVIRSLFYNKNNDSLITVSVYASDNFSSLKCRSTRIEYIRRGQPDAGFALFESESLKWPGFVEFDDVNGKVLTYSAQDSIYKVFDLKNYTMLYSISDKNVQEIKISPGIMLLIFTKVGGHVPLKILSIEDGTVLKSFSHLLHRNKKVDFIEQFNEKLLVKQENENLQILDVRNTELTEVDKIEFKTPSAFIFLYENQLFLTFRNRTVAVWNFRGELVTSFEDHLLWHPDCNTNNIYITSDQDLIISYCKADSDDPLSEGNGSINISNILTGKCLAKIRASNSFPVENECSYGYGCSSSKKQSNMSRIRSTVAEALEDITALFYDEERNEIYTGNRHGLVHVWSN

SEQ ID NO: 13772 - protein, 478 aa, Solanum lycopersicum
MDGRRISASPRPCCGRRVVAKKRSRGGVDGFVNSVKKLQRREICSKRDRSFSMSDAQERFRNIRLQEEYDTHDPKGHCAMVLPFLKKRSKIIEIVAARDIVFALAQSGVCAAFSRETNERICFLNISPDEVIRSLFYNKNNDSLITVSVYASDNFSSLKCRTTRIEYIRRGKPDAGFALFESESLKWPGFVEFDDVNGKVLTYSAQDSIYKVFDLKNYTMLYSISDKNVQEIKISPGIMLLIFTKASGHVPLKILSIEDGTVLKSFNHLLHRNKKVDFIEQFNEKLLVKQENENLQILDVRNSELTEVSRTEFMTPSAFIFLYENQLFLTFRNRTVAVWNFRGELVTSFEDHLLWHPDCNTNNIYITSDQDLIISYCKADSDDPLSEGNAGSINISNILSGKCLAKIKATSGKATDDCNASSSVPGKKSYNSNKRVQDSRIRSTVAEALEDITALFYDEERNEIYTGNRLGLVHVWSN

SEQ ID NO: 13773 - protein, 477 aa, Tabernaemontana elegans
MDGRRITASPRPCSGRRVVAKKRPRGGMDGFVNSVKKLQRREISSKRDRAFSMSDAQERFRNIRLQEEYDTHDPKGQVSMVLPFLRKRSKIIEIVAARDIVFALAQSGVCAAFSRETNERICFLNVSPDEVIRSLFYNKNNDSLITVSVYASDNFSSLKCRTTRIEYIRRGKPDAGFPLFESESLKWPGFVEFDDVNGKVLTYSAQDSIYKVFDLKNYTMLYSISDKNVQEIKISPGIMLLIFTKESGYVPLKILSIEDGTVLKSFNHLLHRNKKVDFIEQFNEKLLVKQENENLQILDVRNSELTEVSRTEFMTPSAFIFLYENQLFLTFRNRTVAVWNFRGELVTSFEDHLLWHPDCNTNNIYITSDQDLIISYCKADSDDPLSEGNAGSINISNILTGKCLAKIKASNSVPLDNCTCNADCSGKACNSRKRAKAASMRSTVAEALEDITALFYDEERNEIYTGNRLGLVHVWSN

SEQ ID NO: 13774 - protein, 474 aa, Gossypium hirsutum
MDGGRRLAVSPRPCSGRRIVASKKRGRADGFVNSVKKLQRREICSKRHRAFSITDAQERFRNIRLQEEYDTHDPKGHCSMVLPFLRKRSKIIEIVAARDIVFALAQSGVCAAFSRETNQRICFLNVTADEVIRSLFYNKNNDSLITVSVYASDNFSSLKCRSTRIEYIRRGQPDAGFALFESESLKWPGFVEFDDVNGKVLTYSAQDSIYKVFDLKNYTMLYSISDRNVQEIKISPGIMLLIFTKVGGHVPLKILSIEDGTVLKSFSHLLHRNKKVDFIEQFNEKLLVKQENENLQILDVRNAELTEVRKNEFMTPSAFIFLYENQLFLTFRNRTVAVWNFRGELVTSFEDHLLWHPDCNTNNIYITSDQDLIISYCKADSDDPLSEGNGSINISNILTGKCLAKIRASNSFPVEEQCSCSDKCGCSSKTQSNASRIRSRVAEALEDITALFYDEERNEIYTGNRYGLVHVWSN

SEQ ID NO: 13775 - protein, 480 aa, Eucalyptus grandis
MEGKRVSASPRPCSGRRVLASKKRPRWWCGGDGLVNSVKKLQRREISSKRDRAFSMTDAQERFRNIRLQEEYDTHDPKGHCAMVLTFLRKRSKIIEIVAARDIIFALAQSGVCAAFSRETNQRICFLNVSHGEVIRSLFYNKNNDSLITVSVYASDNFSSLKCRSTRIEYIRRGKPDAGFALFESESLKWPGFVEFDDVNGKVLTYSAQDSIYKVFDLKNYTMLYSISDKNVKEIKISPGIMLLIFTKASGHVPLKILSIEDGTVLKSFNHLLHRSKKVDFIEQFNEKLLVKQENENLQILDVRNFELTEVGRSEFMTPSAFIFLYENQLFLTFRNRTVAVWNFRGELVTSFEDHLLWHPDCNTNNIYITSDQDLIISYCKADAEDPLSEGNAGSINVSNILTGKCLAKVKASNSVPVEDECSCSGECSGDCRSKKRARASTIRSTVAEALEDITALFYDEERNEIYTGNRHGLVHVWSN

SEQ ID NO: 13776 - protein, 469 aa, Cannabis sativa
MEVGRRISASPRPCSVRRVSANKRPRADGFVNCVKKLQRREICSKRDRAFSTSNALERFRNMRLTDEYDTHDPKGQFLSEFPLLSKRAKIIEIVSAHDIVFALAYSGVCAAFCRETNERLCFMNVSPGEVIRSLFYNKNNDSLITVSVYSSDSFSSLKCRSTRIEYIRRGKPDAGFALFESESLKWPGFVEFDDVNGKVLTYSAQDSIYKVFDLKNYTMLYSISDKHVQEIKISPGIMLLIFNRATSHVPLKILSIEDGTVLKSFNHLLHRNKKVEFIEQFNEKLLVKQESENLQILDVRNTELMEVSKTEFMTPSAFIFLYENQLFLTFRNRTVSVWNFRGERVTSFEDHMLWHPDCNTNNIYITCDQDLIISYCKASSDDHWAEGNAGSINISNILTGKCLAKINSTNHPLEADDCGCSSNCSKQKYSPVRSTVSEALEDITALFYDEERNEIYTGNRHGLVHVWSN

SEQ ID NO: 13777 - protein, 474 aa, Solanum tuberosum
RISASPRPCCGRRVVAKKRSRGGIDGFVNSVKKLQRREICSKRDRSFSMSDAQERFRNIRLQEEYDTHDPKGHCAMVLPFLKKRSKIIEIVAARDIVFALAQSGVCAAFSRETNERICFLNISPDEVIRSLFYNKNNDSLITVSVYASDNFSSLKCRTTRIEYIRRGKPDAGFALFESESLKWPGFVEFDDVNGKVLTYSAQDSIYKVFDLKNYTMLYSISDKNVQEIKISPGIMLLIFTKASGHVPLKILSIEDGTVLKSFNHLLHRNKKVDFIEQFNEKLLVKQENENLQILDVRNSELTEVSRTEFMTPSAFIFLYENQLFLTFRNRTVAVWNFRGELVTSFEDHLLWHPDCNTNNIYITSDQDLIISYCKADSDDPLSEGNAGSINISNILTGKCLAKIKATSGKATDDCNASGSVPGKKSYNSNKRVQDSRIRSTVAEALEDITALFYDEERNEIYTGNRLGLVHVWSN

SEQ ID NO: 13778 - protein, 475 aa, Gossypium hirsutum
MDGGRRIAVSPRPCSGRRILASKKRGRPDAFVNSVKKLQRREICSKPHRAFSVTDAQERFRNIRLQEEYDTHDPKGHCSMVLPFLRKRSKIIEIVAAQDIVFALAQSGVCAAFSRETNRRICFLNVTADEVIRSLFYNKNNDSLITVSVYASDNFSSLKCRSTRIEYIRRGQPDAGFALFESESLKWPGFVEFDDVNGKVLTYSAQDSIYKVFDLKNYTMLYSISDKNVQEIKISPGIMLLIFTKVGGHVPLKILSIEDGTVLKSFSHLLHRNKKVDFIEQFNEKLLVKQENENLQILDVRNSELTEVSKNEFMTPSAFIFLYENQLFLTFRNRTVAVWNFRGELVTSFEDHLLWHPDCNTNNIYITSDQDLIISYCKADSDDPLSEGNGSINISNILTGKCLAKIRASNGFPVEKQCSCCDVECGCRSKVQSSSSRIRSTVAEALEDITALFYDEERNEIYTGNRYGLVHVWSN

SEQ ID NO: 13779 - protein, 484 aa, Medicago truncatula
MEGTGRRITVSPRPCCGRRVRVDAKKTGRGGRTVDGFVNSVKKLQRREISSKRDRAFSMTDAQERFRNIRLQEEYDTHDPKGPSSVVLPFLRKRSKIIEIVAAQDIVFALAQSGVCAAFSRETNQRICFLNVSPDEVIRSLFYNKNNDSLITVSVYASDSYSSLKCRSTRIEYIRRGKPDAGFALFESESLKWPGFVEFDDVNGKVLTYSAQDSIYKVFDLKNYTMLYSISDKNVQEIKISPGIMLLIFAKASSHVPLKILSIEDGTVLKSFNHLLYRNKKVDFIEQFNEKLLVKQENENLQILDVRTFELTEVSRSEFMTPSAFIFLYENQLFLTFRNRTVAVWNFRGELVTSFEDHLLWHPDCNTNNIYITSDQDLIISYCKADSDDSLTEGNAGSINVSNILSGKCLAKIRASNSSPMDDKCSCCDSSSGGSCNSRKRKHVSKMRSTVAEALEDITALFYDEDRNEIYTGNRHGLVHVWSN

SEQ ID NO: 13780 - protein, 455 aa, Theobroma cacao
MEGSRISASPRPCSGRRVWANKKRPRLDGYVNTFSKLLRREISSKPCFSISNAYEKFRNMRLVEEYDSHDPKGHCPVALPFLMKRKKVIEIVAACDIVCALAHSGVCAAFDRERSKRICFVNVSPDEVIRSLFYNKNNDSLITVSVYASDNFSSLKCRSTKIEYIRRGKPDAGFALFESESLKWPGFVEFDDVNGKVLTYSAQDSIYKVFDLKNYTMLYSISDKHVHEIKISPGIMLLIFNRASGHIPLKILSIEDGKVLKTFKHLLHRNKKVDFIEQFNEKLLVKQENENLQILDVRSSELMEVSSTEFMTPSAFIFLYENQLFLTFKNRTVAVWNFRGELVTSFEDHLLWHPDCNTNNICITSDQELIISYCKAESDDQWMEGNAGSINISNILTGKCLAKINASNGSPKVDSSKMRSTVSEALEDITALFYDEERNEIYTGNRQGLIHVWSN

SEQ ID NO: 13781 - protein, 480 aa, Solanum phureja
MDGRRITASPRPCCGRRVVAKKRPRGGMDGFVNSVKKLQRREIGSKRDRSFSMSDAQERFRNIHLQEEYDTHDPKGHCALVLPFLKKRSKIIEIVAARDIVFALAQSGVCAAFSRESNRRICFLNVSPDEVIRSLFYNKNNDSLITVSVYASDNFSSLKCRTTRIEYIRRGKPDAGFALFESESLKWPGFVEFDDVNGKVLTYSAQDSIYKVFDLKNYTMLYSISDKNVQEIKISPGIMLLIFTKASSHVPLKILSIEDGTVLKSFNHLLHRNKKVDFIEQFNEKLLVKQENENLQILDVRNSELTEVSRAEFMTPSAFIFLYENQLFLTFRNRTVAVWNFRGELVTSFEDHLLWHPDCNTNNIYITSDQDLIISYCKADSDDPLSEATAGSINISNILTGKCLAKIKATERRTTDDCSCSTNCNGHGGRSCNAKKRIQASRTRSTVAEALEDITALFYDEEHNEIYTGNNFGLIHVWSN

SEQ ID NO: 13782 - protein, 478 aa, Catharanthus roseus
MDGRRITASPRPCTNGRRVVAKKRSRGAMDGFVNSVKKLQRREISSKRDRSFSMSDAQERFRNIRLQEEYDTHDPKGQTTMVLPFLRKRSKIIEIVAARDIVFALAQSGICAAFSRETNEKICFLNISPDEVIRSLFYNKNNDSLITVSVYASDNFSSLKCRTTRIEYIRRGKPDAGFPLFESESLKWPGFVEFDDVNGKVLTYSAQDSIYKVFDLKNYTMLYSISDKNVQEIKISPGIMLLIFTKSSGHVPLKILSIEDGTVLKSFNHLLHRNKKVDFIEQFNEKLLVKQENENLQILDVRNSELTEVSRTEFMTPSAFIFLYENQLFLTFRNRTVAVWNFRGELVTSFEDHLLWHPDCNTNNIYITSDQDLIISYCKADTDDPLSEANAGSINISNILTGKCLAKIKASNSLPLDDCTCNADCGGSACNAKKRAKAASMRSTVAEALEDITALFYDEERNEIYTGNRLGLVHVWSN

SEQ ID NO: 13783 - protein, 457 aa, Euonymus alatus
AGRVVAKKRARSDVIMNSVKKLQRREISSKIDRTFTVSNAQERFRNMRLTVEYDTHDPKGHCSVVLPFLAKRTKVIEIVAARDIVFALAHSDVCAAFSRETNKRICFLNVSPDEVIRSLFYNKNNDSLITVSVYASDNFSSLKCRSTRIEYIRRGKPDAGFALFESESLKWPGFVEFDDVNGKVLTYSAQDSIYKVFDLKNYTMLYSISDKNVQEIKISPGIMLLIFNRASSHVPLKILSIEDGTVLKAFNHLLHRNKKVDFIEQFNEKLLVKQENENLQILDVRTSETMEVNRNEFMTPSAFIFLYENQLFLTFRNRTVAVWNFRGELVTSFEDHLLWHPDCNTNNIYITSDQDLIISYCRAESDYQWGEGNAGSINISNILTGKCLSKINVTSASTTVEECSSSSTSNSKRRIITAPMSSTVSEALEDITALFYDEERNEIYTGNRHGLVHVWSN

SEQ ID NO: 13784 - protein, 474 aa, Populus trichocarpa
MDGGGGRRITVSPRPCNGKRVVAKKRGRSFGGGDGFVNSVKKLQRREICSKRDRSFTMTDAQERFRNIRLQEEYDTYDPKGHCTMVLPFLRKRSKIIEIVAARDIVFALAQSGVCAAFSRETNQRICFLNVTPDEVIRSLFYNKNNDSLITVSVYASDNFSSLKCRSTRIEYIRRGQPDAGFALFESESLKWPGFVEFDDVNGKVLTYSAQDSIYKVFDLKNYTMLYSIADKNVQEIKISPGIMLLILTKSSGCVPLEILSIEDGTVLKSFNHLLHRNKKVDFIEQFNEKLLVKQENENLQILDVRNFDLTEVSRTEFMTPSAFIFLYENQLFLTFRNRTVAVWNFRGELVTSFEDHLLWHPDCNTNNIYITSDQDLIISYCKADSDDPLSEGNAGSINISNILTGKCLAKIKASNSFPNENECGQNSKKHRHASRIRSTAAEALEDITALFYDEERNEIYTGNRHGLVHVWSN

SEQ ID NO: 13785 - protein, 478 aa, Glycine max
MEGGKRITVSPRPCCGRRIVAAKKRPRANDGFVNSVKKLQRREISSKRDRAFTMSDAQERFRNIRLQEEYDTHDPKGPSSMVLPFLRKRSKIIEIVAARDIVFALAQSGVCAAFSRETNQRICFLNVSPDEVIRSLFYNKNNDSLITVSVYASDSYSSLKCRSTRIEYIRRGTPDAGFALFESESLKWPGFVEFDDVNGKVLTYSAQDSIYKVFDLKNYTMLYSISDKNVQEIKISPGIMLLIYAKASSHVPLKILSIEDGTILKSFSHLLYRNKKVDFIEQFNEKLLVKQENENLQILDVRTFEHTEVCRSEFMTPSAFIFLYENQLFLTFRNRTVAVWNFRGELVTSFEDHLLWHPDCNTNNIYITSDQDLIISYCKADSDDSLSEGNAGSINVSNILTGKCLAKIRASNSFPVDNSCSDNPSGSCCCNSKKRKHGSKTRSTVAEALEDITALFYDEERNEIYTGNRHGLVHVWSN

SEQ ID NO: 13786 - protein, 480 aa, Solanum lycopersicum
MDGRRITASPRPCCGRRVVAKKRPRGGMDGFVNSVKKLQRREIGSKRDRSFSMSDAQERFRNIHLQEEYDTHDPKGHCAMVLPFLKKRSKIIEIVAARDIVFALAQSGVCAAFSRESNRRICFLNVSPDEVIRSLFYNKNNDSLITVSVYASDNFSSLKCRTTRIEYLRRGKPDAGFALFESESLKWPGFVEFDDVNGKVLTYSAQDSIYKVFDLKNYTMLYSISDKNVQEIKISPGIMLLIFTKASGHVPLKILSIEDGTVLKSFNHLLHRNKKVDFIEQFNEKLLVKQENENLQILDVRNSELTEVSRAEFMTPSAFIFLYENQLFLTFRNRTVAVWNFRGELVTSFEDHLLWHPDCNTNNIYITSDQDLIISYCKADSDDPLSEATAGSINISNILTGKCLAKIKATERRRSDDCSCSTNCNGHGGRSCNAKKRIQASRTRSTVAEALEDITALFYDEEHNEIYTGNSFGLIHVWSN

SEQ ID NO: 13787 - protein, 484 aa, Lotus japonicus
MEGGGGRRITVSPRPCCGRRVVAKKGPRRGGAVDGFVNSVKKLQRREISSKRDRAFTMTDAQERFRNIRLQEEYDTHDPKGPSSAVVLPFLRRRSKIIEIVAAQDIVFALAQSGVCAAFSRESNQRICFLNVSPDEVIRSLFYNKNNDSLITVSVYASDSYSSLKCRSTRIEYIRRGKPDAGFALFESESLKWPGFVEFDDVNGKVLTFSAQDSIYKVFDLKNYTMLYSISDKNVQEIKISPGIMLLIFAKASSHVPLKILSIEDGTVLKSFNHLLYRNKKVDFIEQFNEKLLVKQENENLQILDVRTFELTEVSRSEFMTPSAFIFLYENQLFLTFRNRTVAVWNFRGELVTSFEDHLLWHPDCNTNNIYITSDQDLIISYCKADSDDSVTEGNAGSINVSNILTGKCLAKIRASNSFPMEDNCSCCETSSGNSCNSRKRKHASKIRSTVAEALEDITALFYDEDRNEIYTGNRHGLVHVWSN

SEQ ID NO: 13788 - protein, 455 aa, Amorphophallus konjac
MEGRRFSVSPRPCCNRRIVAGKRPRSDGFVNSVKKLQRREMCSKRDRAFNTSSAQERFRNIQLQEEYDTHDPKGHSFLQLPFLKKRSRIVEIVAARDIVFALAQSGVCAAFSRETNQRICFLNVSPDEVIRSLFYNKNNESLITVSVYDADNFSSLKCRTTRIEYIKRGKPDAGFALFESESLKWPGFVEFDDVNGKVLTFSAQDSIYKVFDLKNYTLLYSISDKNVQEIKISPGIMLLIFKRASSHVPLKVLSIEDGTVLKSFNHLLHRNKKVDFIEQFNEKLLVKQENENLQILDVRNFQLTEVSRTEFMTPSAFIFLYENQLFLTFRNRTAAVWNFRGELVTSFEDHLLWHPDCNTNNIYITSDQDLIISYCKADSDETTDGNAGSINISNILTGKCLAKIRASNSKKELFPSRFRNTVAEALEDVTALYYDEDRNEIYTGNRQGLVHVWSN

SEQ ID NO: 13789 - protein, 474 aa, Silene vulgaris
MDGRRISASPRPCTVRRVVAKKRPRGGGVDGFVNSVRKLQRREICSKRYRAFSMSDAQERFRNILLQEEYDTHDPKGQCPTVLPFLRKRSKIIEIVAAHNIVFALAQSGICAAFSRETNQRICFLNVSSDEVIRSLFYNKNNDSLITVSVYASDNFSSLKCRTTRIEYIKRGKPDAGFALFESESLKWPGFVEFDDVNGKVLTYSAQDSVYKVFDLKNYTMLYSISDKNVQEIKISPGIMLLIFNKEASHVPLKILSIEDGTVLKSFTHLIRRNKKVDFIEQFNEKLLVKQENENLQILDVRNSELTEVSKTDFMTPSAFIFLYENQLFLTFRNRTVAVWNFRGELVTSFEDHLLWHPDCNTNNIYITSDQDLIISYCKADSDDPLPEANAGSINVSNILTGKCLAKIKPDNCSTVEDDGSSSSNSNSKKRIRASRIQSTPAEALEDITALFYDEERNEIYTGNRHGLVHVWSN

SEQ ID NO: 13790 - protein, 478 aa, Mimulus guttatus
MDGRRITASPRPCSGRRVVAKKRPRGGLDGFVNSVKKLQRREISSKRDRSFSMSDAQERFRNIRLQEEYDTHDPKGYCSMSLPFLKKRSKIIEIVAARDIVFALAQSGVCAAFSRETNQRICFLNVCPDEVIRSLFYNKNNDSLITVSVYASDNFSSLKCRTTRIEYIRRGKPDAGFALFESESLKWPGFVEFDDVNGKVLTYSAQDSIYKVFDLKNYTMLYSISDKNVQEIKISPGIMLLIFTKGQGGVPLQILSIEDGTVLKSFSHLLHKGKKVDFIEQFNEKLLVKQENENLQIVDVRNTEITEVSRTEFMTPSAFIFLYENQLFLTFRNRTVAVWNFRGELVTKFEDHLLWHPDCNTNNIYITSDQDLIISYCKADSEEPLSDGNAAGSINISNILTGKCLAKIKASNSLPINECNCSASCGGKKCNSRKRIQASRMRSTVAEALEDITALFYDEDRNEIYTGNRLGLVHVWSN

SEQ ID NO: 13791 - protein, 482 aa, Fagopyrum esculentum
MDGRRISASPRPCSVRRVVAKRRPREIDGFVNSVKKLQRREISSKRDRAFSMSNAQERFRNIRLQEEYDTHDPKGHCFTVLPFLRKRTKIIEIVAAHDIVFALAMSGLCAAFSRDTNEKVCFLNISEDEVIRSLFYNKNNDSLITVSVYASDSFSSLKCRSTRIEYIKRGKPDAGFALFESESLKWPGFVEFDDVNGKVLTYSAQDSVYKVFDLKNYRMLYSISDQNVQEIKISPGIMLLIFNKGVSHVPLKILSIEDGTVLKSFNHLIHRNKKVDFIEQFNEKLLVKQENENLQILDVRNSDLKEVSRTEFMTPSAFIFLYENQLFLTFRNRTVAVWNFRGELVTSFEDHLLWHSDCNTNNIYITSDQDLIISYCKADADDPKAEGTAGSINVSNILSGKCLAKIRVEKKSDDGEDISSSGNSNGSSSSSRRRNTRKRAHASRMGRTVEEALEDITALFYDEERNEIYTGNSRGLLHVWSN

SEQ ID NO: 13792 - protein, 473 aa, Populus trichocarpa
MDGGGGRRITASPRPCNGKRVVARKRGRGFGGGDGFVNSVKKLQRREICSKRDRTFTMTDAQERFRNIRLQEEYDTHDPKGHCTMVLPFLRKRSKIIEIVAARDMVFALAQSGVCAAFSRETNQRICFLNVTPDEVIRSLFYNKNNDSLITVSVYASDNFSSLKCRSTRIEYIQRGQPDAGFALFESESLKWPGFVEFDDVNSKVLTYSAQDSIYKVFDLKNYTMLYSIANKNVQEIKISPGIMLLILTKSGGCVPLEILSIEDGTVLKSFNHLLHRNKKVDFIEQFNEKLLVKQENENLQILDVRDFQLIEVSRTEFMTPSAFIFLYENQLFLTFRNRTVAVWNFRGELVTSFEDHLLWHPDCNTNNIHITSDQDLIISYCKADSDDPLSEGNGSINISNILTGKCLAKIKAGNSFPNENECSQSSKKHMCASTVRSTAAEALEDITALFYDEERNEIYTGNRLGLVHVWSN

SEQ ID NO: 13793 - protein, 461 aa, Cephalotaxus harringtonia
MEPRKIAASPRPCSGRRVVAGKRQRIGDTTNCVRKLQRREIGTSGNRAFNISNAQEKFRNFQLQEEFDTYDPKAHGFELQFLKKRSKIIEIVAARDIVFALAQSGVCAAFSREANKKICFLNISPDEVIRSLFYNKNNDSLITVSVYASDNFSSLKCRTTPIEYIRRGQPDAGFALFESESLKWPGFVEFDDVNGKVLTYSAQDGIYKVFDLKNYTMLYSISDEHVQEIKISPGIMLLIFDRASGHVPLKILSIEDGTVLKAFNHLLHRNKKVDFIEQFNEKLLVKQENENLQILDVRNAQLTEVSRTEFMTPSAFIFLYENQLFLTFRNRTVAVWNFRGELVTSFEDHLLWHPDCNTNNIYITSDQDLIISYCKAHPHSSDEEENVGSINISNILTGKCLAKIRANDPNVQISPRNRPNASAIRSTVQEALEDITALFYDEERNEIYTGNRHGLVHVWSN

SEQ ID NO: 13794 - protein, 462 aa, Sciadopitys verticillata
MEAKKIGASPRPCSGRRVVAGKRQRIGDTTNCVRKLQRREIGTSGNRAFNISNAQEKFRNFQLQEEFDTYDPKAHWFLKLQFLKKRSKIIEIVAARDIVFALAQSGVCAAFSREANKKICFLNISPDEVIRSLFYNKNNDSLITVSVYASDNFSSLKCRTTPIEYIRRGQPDAGFALFESESLKWPGFVEFDDVNGKVLTYSAQDGIYKVFDLKNYTMLYSISDEHVQEIKISPGIMLLIFDRASGHVPLKILSIEDGTVLKAFNHLLHRNKKVDFIEQFNEKLLVKQENENLQILDVRNAQLTEVSRTEFMTPSAFIFLYENQLFLTFRNRTVAVWNFRGELVTSFEDHLLWHPDCNTNNIYITSDQDLIISYCKAHPHSSDEEENVGSINISNILTGKCLAKIRANDPNVQISPRNRPNASAIRSTVQEALEDITALFYDEERNEIYTGNRHGLVHVWSN

SEQ ID NO: 13795 - protein, 487 aa, Lactuca sativa
MDGRRITASPRPCNGRRVVAKKRPRGGVDGFVNSVKKLQRREICSKRDRSFSMCDAQERFRNIRLQEEYDTHDPKGHCSMVLPFLKKRSKIVEIVAARDIVFALAQSGICAAFSRETNQRICFLNVSPDEVIRSLFYNKNNDSLITVSVYASDSFSSLKCRTTGIEYIRRGKPDAGFALFESESLKWPGFVEFDDVNGKVLTFSAQDSIYKVFDLKNYMMLYSISDKNVQEIKISPGIMLLIFNKASGHVPLKILSIEDGTVLKTFNHLLHRNKKVDFIEQFNEKLLVKQENENLQILDVRNSELTEVSRTEFMTPSAFIFLYENQLFLTFRNRTVAVWNFRGELVTSFEDHLLWHPDCNTNNIYITSDQDLIISYCKADSDDPLTEGNGSINISNILTGKCLAKVKAINGGGILEDCICSDSDNDIMMKSKGGKRCRCSSQDQVVGRRITSSVTEALEDITALFYDEERNEIYTGNRLGLVHVWSN

SEQ ID NO: 13796 - protein, 477 aa, Mimulus guttatus
MDGRRITASPRPCTGRRVVAKKRRRGGIDGFVNSVKKLQRREISTKRDRAFSMCDAQERFRNIRLQEEYDTHDPKGYSPSSLPFLKKRSKIIEIVAARDIVFALAQSGVCAAFSRETNQRICFLNVSHDEVIRSLFYNKNNDSLITVSVYASDNFSSLKCRTTRIEYIRRGKPDAGFALFESESLKWPGFVEFDDVNGKVLTYSAQDSIYKVFDLKNYTMLYCISDKNVQEIKISPGIMLLILTKTHSGVPLKILSIEDGSVLKSFSHLLHKTKKVDFIEQFNEKLLVKQENENLQILDVRNSELTEVSSTEFMTPSAFIFLYENQLFLTFRNGTVAVWNFRGERVTSFDDHLLWHPDCNTNNIYITSDQDLIISYCKSDTDESLSDGNAGSINISNILTGKCLAKIKASNSLQADECWCSANCGGRNCNSRKRVEASRIKSTVAEALEDITALFYDEDRNEIYTGNRLGLIHVWSN

SEQ ID NO: 13797 - protein, 462 aa, Pinus taeda
MEGRRIAASPRPCSGRRIVAAKRQRVDASANCVRKLQRREIGTSGNRAFNITNSQEKFRNFQLQEEFDTYDPKAHWFLKLQFLKKRSKIIEIVAARDIVFALAQSGVCAAFSREANKKICYLNISPDEVIRSLFYNKNNDSLITVSVYASDNFSSLKCRTTPIEYIRRGQPDAGFALFESESLKWPGFVEFDDVNGKVLTYSAQDGIYKVFDLKNYTLLYSISDEHVQEIKISPGIMLLIFDRASGHVPLKILSIEDGTVLKAFNHLLHRNKKVDFIEQFNEKLLVKQENENLQILDVRNTQLTEVSRAEFLTPSAFIFLYENQLFLTFRNRTVAVWNFRGELVTSFEDHLLWHPDCNTNNIYITSDQDLIISYCKALPLSSGAEENVGSINISNILTGKCLAKIRANDPNVQISPRNRPNASTIRSTVEEALEDITALFYDEERNEIYTGNWHGLVHVWSN

SEQ ID NO: 13798 - protein, 611 aa, Brassica napus
MFDWDDEELTNMIWGDDGETGDHIVPFKVRNRKEQGDESNKAVKPAEQKTTHLHDSKLGGSSSGQNIECMSSWPDSSVSNARKADPGPGSSEPARYDSTRSEKTSELGKGPDIFHSTDESKEHGDFDEYGWANIGSFDDLDRMFSSDVPIFGDGSLSGADELWSSSKDVSKPLPSILDSQDLGLDIRTQFEQQENQQFPLTGETNGGPSSQSAPRVRVTPKAEQYHEHKSQSSVDDQPYQQHKMMKLSEMLGTCEAGSFQDPYGQRSRGKFVNQLAPSRSTLMGVNLRSESQGSGTSHYPQMPNQYMATSGFGNPYSAVHVVSAFQCPDVNKNQLMHPSYNPASAISANTVTDDCAPPSTMTPQEKLEKLRRRQQMQAMLAIQRQQQQFRHQVPVADQSITQLVDKTSLQGLTAIPSFDPNSSLELDDSGNFAAAVDNPSEFSVLYRLQDVVAKLDMETRTCIRDSLFRLADSAGQRHHTSDTPHSNKTSQDDREVIPQEKSRYRYAGMLDTETVTNPTDRTVAYLLFHRPFDMYAAKHTEGLESPSSSKMGAEVKGSFPSTRESRMIKQKAKEEDVPAVSLALGYASNSGSSSTVAERVVEASQGNKRKL

SEQ ID NO: 13799 - protein, 485 aa, Brassica napus
MALLVEKTSSGREYKVKDMSQADFGRLEIELAEVEMPGLVSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKTGQVPDPTSTDNPEFQIVLSIIKDGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMLGLETFPGVKRITIKPQTDRWVFPDTKTGIIVLAEGRLMNLGCATGHPSFVMSCSFTNQVIAQLELWNEKSSGKYEKKVYVLPKHLDEKVAALHLGKLGARLTKLTKDQSDYVSIPVEGPYKPVHYRY

SEQ ID NO: 13800 - protein, 485 aa, Brassica napus
MALLVEKTSSGREYKVKDMSQADFGRLEIELAEVEMPGLVSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKTGQVPDPTSTDNPEFQIVLSIIKDGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMQGLETYPGVKRITIKPQTDRWVFPDTKSGIIVLAEGRLMNLGCATGHPSFVMSCSFTNQVIAQLELWNEKSSGKYEKKVYVLPKHLDEKVAALHLGKLGARLTKLTKDQSDYVSIPVEGPYKPVSYRY

SEQ ID NO: 13801 - protein, 485 aa, Brassica napus
MALLVEKTSSGREYKVKDMSQADFGRLEIELAEVEMPGLVSCRTEFGPSQPLKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKTGQVPDPTSTDNPEFQIVLSIIKDGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMLGLETFPGVKRITIKPQTDRWVFPDTKTGIIVLAEGRLMNLGCATGHPSFVMSCSFTNQVIAQLELWNEKSSGKYEKKVYVLPKHLDEKVAALHLGKLGARLTKLTKDQSDYVSIPVEGPYKPVHYRY

SEQ ID NO: 13802 - protein, 485 aa, Brassica napus
MALLVEKTSSGREHKVKDMSQADFGRLEIELAEVEMPGLVSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKTGQVPDPTSTDNPEFQIVLSIIKDGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMLGLETFPGVKRITIKPQTDRWVFPDTKTGIIVLAEGRLMNLGCATGHPSFVMSCSFTNQVIAQLELWNEKSSGKYEKKVYVLPKHLDEKVAALHLGKLGARLTKLTKDQSDYVSIPVEGPYKPVHYRY

SEQ ID NO: 13803 - protein, 480 aa, Brassica rapa
  misc_feature (461)..(461): Xaa can be any naturally occurring amino acid
MALLVEKTSSGREYKVKDMSQADFGRLEIELAEVEMPGLVSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKTGQVPDPSSTDNPEFQIVLSIIKDGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMQGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGARLTXLTKDQSDYVSIPIEGPYKP

SEQ ID NO: 13804 - protein, 485 aa, Unknown
  Sequence found in Organisms: Brassica napus, Brassica rapa
MALLVEKTSSGREYKVKDMSQADFGRLEIELAEVEMPGLVSCVTEFGPSQPLKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKTGQLPDPTSTDNPEFQIVLSIIKDGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMQGLETYPGVKRITIKPQTDRWVFPDTKSGIIVLAEGRLMNLGCATGHPSFVMSCSFTNQVIAQLELWNEKSSGKYEKKVYVLPKHLDEKVAALHLGKLGARLTKLTKDQSDYVSIPVEGPYKPVSYRY

SEQ ID NO: 13805 - protein, 478 aa, Brassica napus
TSSGREYKVKDMSQADFGRLEIELAEVEMPGLVSCRTEFGPSQPLKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKTGQVPDPSSTDNPEFQIVLSIIKDGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMQGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGARLTKLTKDQSDYVSIPIEGPYKPGHYRY

SEQ ID NO: 13806 - protein, 252 aa, Brassica rapa
MALLVQKTSSGREYKVKDMSQADFGRLEIELAEVEMPGLVSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKTGQVPDPTSTDNPEFQIVLSIIKDGLQVDPKKYHKMKERLVGVSEETTTGVKRLYQMQETGVFCSLPLTLMTLSPRASLTTCMDVATLSPTVS

SEQ ID NO: 13807 - protein, 485 aa, Eutrema halophilum
MALLVEKTSSGREYKVKDMSQADFGRLEIELAEVEMPGLVSCRTEFGPSQPLKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKTGQFPDPTSTDNPEFQIVLSIIKDGLQVDPKKYHKMKERLVGVSEETTTGVKRLYQMQETGTLLFPAINVNDSVTKSKFDNLYGCRHSLPDGLMRATDVMIAGKVAVICGYGDVGKGCAAAMKTAGARVIVTEIDPICALQALMEGLQVLTLEDVLSEADIFVTTTGNKDIIMVDHMRKMKNNAIVCNIGHFDNEIDMLGLETFPGVKRITIKPQTDRWVFPDTKTGIIVLAEGRLMNLGCATGHPSFVMSCSFTNQVIAQLELWNEKSSGKYEKKVYVLPKHLDEKVAALHLGKLGARLTKLTKDQSDYVSIPIEGPYKPVHYRY

SEQ ID NO: 13808 - protein, 485 aa, Raphanus sativus
  misc_feature (43)..(43): Xaa can be any naturally occurring amino acid
  misc_feature (133)..(133): Xaa can be any naturally occurring amino acid
  misc_feature (190)..(190): Xaa can be any naturally occurring amino acid
MALLVEKTSSGREYKVKDMSQADFGRLEIELAEVEMPGLVSCXTEFGPSQPLKGARITGSLHMTIQTAVLIETLTALGAEVRWCSCNIFSTQDHAAAAIARDSAAVFAWKGETLQEYWWCTERALDWGPGGGXDLIVDDGGDATLLIHEGVKAEEIFAKTGQLPDPTSTDNPEFQIVLSIIKDGLQVDPXKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMQGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGARLTKLTKDQSDYVSIPVEGPYKPVSYRY

SEQ ID NO: 13809 - protein, 485 aa, Arabidopsis thaliana
MALLVEKTSSGREYKVKDMSQADFGRLEIELAEVEMPGLVSCVTEFGPSQPLKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKNGTFPDPTSTDNPEFQIVLSIIKDGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMLGLETYPGVKRITIKPQTDRWVFPDTNSGIIVLAEGRLMNLGCATGHPSFVMSCSFTNQVIAQLELWNEKSSGKYEKKVYVLPKHLDEKVAALHLGKLGARLTKLTKDQSDYVSIPVEGPYKPVHYRY

SEQ ID NO: 13810 - protein, 485 aa, Unknown
  Sequence found in Organisms: Brassica napus, Brassica rapa
MALIVEKTSSGREYKVKDMSQADFGRLELELAEVEMPGLMACRTEFGPAQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGQVPDPTSTDNPEFQIVLSIIKEGLQVDPKKYHKMKERLVGVSEETTTGVKRLYQMQESGALLFPAINVNDSVTKSKFDNLYGCRHSLPDGLMRATDVMIAGKVAVICGYGDVGKGCAAAMKTAGARVIVTEIDPICALQAMMEGLQVLTLEDVVSEADIFVTTTGNKDIIMVDHMRKMKNNAIVCNIGHFDNEIDMQGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPIEGPYKPAHYRY

SEQ ID NO: 13811 - protein, 485 aa, Raphanus sativus
MALIVEKTSSGREYKVKDMSQADFGRLELELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGQVPDPSSTDNPEFQIVLSIIKEGLQVDPKKYHKMKERLVGVSEETTTGVKRLYQMQETGALLFPAINVNDSVTKSKFDNLYGCRHSLPDGLMRATDVMIAGKVVVVCGYGDVGKGCAAAMKTAGARVIVTEIDPICALQAMMEGLQVLTLEDVVSEADIFVTTTGNKDIIMVDHMRKMKNNAIVCNIGHFDNEIDMLGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPIEGPYKPAHYRY

SEQ ID NO: 13812 - protein, 485 aa, Eutrema parvulum
MALLVEKTSSGREYKVKDMSQADFGRLEIELAEVEMPGLVSCVTEFGPSQPLKGARITGSLHMTIQTAVLIETLTKLGAEVRWCSCNIFSTQDHAAAAIARDSAAVFAWKGETLQEYWWCTERALDWGPGGGPDLIVDDGGDATLLIHEGVKAEEIFAKNGQLPDPTSTENPEFQIVLSIIKDGLQVDPKKYHKMKERLVGVSEETTTGVKRLYQMQETGTLLFPAINVNDSVTKSKFDNLYGCRHSLPDGLMRATDVMIAGKVAVICGYGDVGKGCAAAMKTAGARVIVTEIDPICALQALMEGLQVLTLEDVLSEADIFVTTTGNKDIIMVDHMRKMKNNAIVCNIGHFDNEIDMHGLETFPGVKRITIKPQTDRWVFPDTKTGIIVLAEGRLMNLGCATGHPSFVMSCSFTNQVIAQLELWNEKSSGKYEKKVYVLPKHLDEKVAALHLGKLGARLTKLTKDQSDYVSIPVEGPYKPVHYRY

SEQ ID NO: 13813 - protein, 485 aa, Brassica napus
MALVVEKTSSGREYKVKDMSQADFGRLELELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGQVPDPTSTDNPEFQIVLSIIKEGLQVDPKKYHKMKERLVGVSEETTTGVKRLYQMQETGALLFPAINVNDSVTKSKFDNLYGCRHSLPDGLMRATDVMIAGKVVVVCGYGDVGKGCAAAMKTAGARVIVTEIDPICALQAMMEGLQVLTLEDVVSEADIFVTTTGNKDIIMVDHMRKMKNNAIVCNIGHFDNEIDMLGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPIEGPYKPAHYRY

SEQ ID NO: 13814 - protein, 485 aa, Brassica oleracea
MALIVEKTSSGREYKVKDMSQADFGRLELELAEVEMPGLMACRTEFGPAQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGQVPDPTSTDNPEFQIVLSIIKEGLQVDPKKYHKMKERLVGVSEETTTGVKRLYQMQESGALLFPAINVNDSVTKSKFDNLYGCRHSLPDGLMRATDVMIAGKVAVICGYGDVGKGCAAAMKTAGARVIVTEIDPICALQAMMEGLQVLTLEDVVSEADIFVTTTGNKDIIMVDHMRKMKNNAIVCNIGHFDNEIDMQGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPVEGPYKPAHYRY

SEQ ID NO: 13815 - protein, 485 aa, Eutrema parvulum
MALLVEKTSSGREYKVKDMSQADFGRLELELAEVEMPGLMACRTEFGPAQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGQVPDPTSTDNPEFQIVLSIIKEGLQVDPKKYHKMKERLVGVSEETTTGVKRLYQMQESGALLFPAINVNDSVTKSKFDNLYGCRHSLPDGLMRATDVMIAGKVAVICGYGDVGKGCAAAMKTAGARVIVTEIDPICALQAMMEGLQVLTLEDVVSEADIFVTTTGNKDIIMVDHMRKMKNNAIVCNIGHFDNEIDMLGLETFPGVKRITIKPQTDRWVFPDTKTGIIVLAEGRLMNLGCATGHPSFVMSCSFTNQVIAQLELWNEKSSGKYEKKVYVLPKHLDEKVAALHLGKLGAKLTKLSKDQSDYVSIPIEGPYKPAHYRY

SEQ ID NO: 13816 - protein, 485 aa, Arabidopsis lyrata
MALLVEKTSSGREYKVKDMSQADFGRLEIELAEVEMPGLVSCRTEFGPSQPLKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGTFPDPTSTDNPEFQIVLAIIRDGLQVDPKKYHKMKERLVGVSEETTTGVKRLYQMQETGTLLFPAINVNDSVTKSKFDNLYGCRHSLPDGLMRATDVMIAGKVAVICGYGDVGKGCAAAMKTAGARVIVTEIDPICALQALMEGLQVLTLEDVLPEADIFVTTTGNKDIIMVDHMRKMKNNAIVCNIGHFDNEIDMLGLETYPGVKRITIKPQTDRWVFPDTKSGIIVLAEGRLMNLGCATGHPSFVMSCSFTNQVIAQLELWNEKSSGKYEKKVYVLPKHLDEKVAALHLGKLGARLTKLSKDQSDYVSIPIEGPYKPVHYRY

SEQ ID NO: 13817 - protein, 485 aa, Brassica oleracea
  misc_feature (325)..(325): Xaa can be any naturally occurring amino acid
MALVVEKTSSGREYKVKDMSQADFGRLELELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGQVPDPTSTDNPEFQIVLSIIKEGLQVDPKKYHKMKERLVGVSEETTTGVKRLYQMQETGALLFPAINVNDSVTKSKFDNLYGCRHSLPDGLMRATDVMIAGKVVVVCGYGDVGKGCAAAMKTAGARVIVTEIDPICALQAMMEGLQVLTLEDVVSEADIFVTTXGNKDIIMVDHMRKMKNNAIVCNIGHFDNEIDMLGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPIEGPYKPAHYRY

SEQ ID NO: 13818 - protein, 485 aa, Brassica rapa
MALVVEKTSSGREYKVKDMSQADFGRLELELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGQVPDPTSTDNPEFQIVLSIIKEGLQVDPKKYHKMKERLVGVSEETTTGVKRLYQMQETGALLFPAINVNDSVTKSKFDNLYGCRHSLPDGLMRATDVMIAGKVVVVCGYGDVGKGCAAAMKTAGARVIVTEIDPICALQAMMEGLQVLTLEDVVSEADIFVTTTGNKDIIMVDHMRKMKNNAIVCNIGHFDNEIDMLGLETFPGVKRITIKPQTDRWVFPDTNSGIIVLAEGRLMNLGCATGHPSFVMSCSFTNQVIAQLELWNEKSSGKYEKKVYVLPKHLDEKVAALHLGKLGAKLTKLTKDQSDYVSIPIEGPYKPAHYRY

SEQ ID NO: 13819 - protein, 485 aa, Brassica napus
MALVVEKTSSGREYKVKDMSQADFGRLELELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGAGPDLIVDDGGDATLLIHEGVKAEEIFEKTGQVPDPTSTDNPEFQIVLSIIKEGLQVDPKKYHKMKERLVGVSEETTTGVKRLYQMQEAGALLFPAINVNDSVTKSKFDNLYGCRHSLPDGLMRATDVMIAGKVVVVCGYGDVGKGCAAAMKTAGARVIVTEIDPICALQAMMEGLQVLTLEDVVSEADIFVTTTGNKDIIMVDHMRKMKNNAIVCNIGHFDNEIDMLGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPIEGPYKPAHYRY

SEQ ID NO: 13820 - protein, 485 aa, Arabidopsis lyrata
MALLVEKTSSGREYKVKDMSQADFGRLELELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGQVPDPTSTDNPEFQIVLSIIKEGLQVDPKKYHKMKERLVGVSEETTTGVKRLYQMQENGTLLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETKTGIIVLAEGRLMNLGCATGHPSFVMSCSFTNQVIAQLELWNEKSSGKYEKKVYVLPKHLDEKVAALHLGKLGARLTKLSKDQSDYISIPIEGPYKPPHYRY

SEQ ID NO: 13821 - protein, 485 aa, Eutrema halophilum
MALIVEKTSSGREYKVKDMSQADFGRLELELAEVEMPGLMACRTEFGPAQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGQVPDPNSTDNPEFQIVLSIIKEGLQVDPKKYHKMKERLVGVSEETTTGVKRLYQMQESGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETKTGIIVLAEGRLMNLGCATGHPSFVMSCSFTNQVIAQLELWNEKSSGKYEKKVYVLPKHLDEKVAALHLGKLGARLTKLSKDQSDYISIPIEGPYKPAHYRY

SEQ ID NO: 13822 - protein, 480 aa, Brassica napus
EKTSSGREYKVKDMSQADFGRLELELAEVEMPGLMACRTEFGPAQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGQVPDPTSTDNPEFQIVLSIIKEGLQVDPKKYHKMKERLVGVSEETTTGVKRLYQMQESGALLFPAINVNDSVTKSKFDNLYGCRHSLPDGLMRATDVMIAGKVAVICGYGDVGKGCAAAMKTAGARVIVTEIDPICALQAMMEGLQVLTLEDVVSEADIFVTTTGNKDIIMVDHMRKMKNNAIVCNIGHFDNEIDMQGLETFPGVKRITIKPQTDRWVFPDTKSGIIVLAEGRLMNLGCATGHPSFVMSCSFTNQVIAQLELWNEKSSGKYEKKVYVLPKHLDEKVAALHLGKLGAKLTKLTKDQSDYVSIPVEGPYKPAHYRY

SEQ ID NO: 13823 - protein, 485 aa, Arabidopsis thaliana
MALLVEKTSSGREYKVKDMSQADFGRLELELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGQVPDPTSTDNPEFQIVLSIIKEGLQVDPKKYHKMKERLVGVSEETTTGVKRLYQMQQNGTLLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETKAGIIVLAEGRLMNLGCATGHPSFVMSCSFTNQVIAQLELWNEKASGKYEKKVYVLPKHLDEKVALLHLGKLGARLTKLSKDQSDYVSIPIEGPYKPPHYRY

SEQ ID NO: 13824 - protein, 126 aa, Eutrema halophilum
MLRQNVNLLLVLTTRLLVPKLKLGNHLVGERARHDETRVTSGTTQVHETTLSQNNDSGLGLREHPPVCLGLDGDTLHTRVSLESKHVDLVVKVTNVAHNGVVLHLPHVVDHDDVFVTGGGDKDVSF

SEQ ID NO: 13825 - protein, 485 aa, Cleome gynandra
MALLVEKTSSGREYKVKDMSQADFGRLEIELAEVEMPGLMACRTEFGASQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIYEKTGQVPDPSSTDNPEFQIVLQIIKDGLLVDPKKYRKMKERLVGVSEETTTGVKRLYQMQENGTLLFPAINVNDSVTKSKFDNLYGCRHSLPDGLMRATDVMIAGKVGVVCGYGDVGKGCALALKAAGARVIVTEIDPICALQALMEGFQVLTLEDVLSEADIFVTTTGNKDIIMVDHMRKMKNNAIVCNIGHFDNEIDMHGLETFPGVQRITIKPQTDRWVFPDTKTGIIVLAEGRLMNLGCATGHPSFVMSCSFTNQVIAQLELWKEKATGKYEKKVYVLPKHLDEKVAALHLGKLGARLTKLSKDQADYISVPIEGPYKPPHYRY

SEQ ID NO: 13826 - protein, 485 aa, Cleome spinosa
MALLVEKTSSGREYKVKDMSQADFGRLEIELAEVEMPGLMACRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIYEKTGQVPDPSSTDNPEFQIVLQIIKDGLQVDPKKYHKMKERLVGVSEETTTGVKRLYQMQANGSLLFPAINVNDSVTKSKFDNLYGCRHSLPDGLMRATDVMIAGKVGVVCGYGDVGKGCALALKAAGARVIVTEIDPICALQALMEGFQVLTLEDIVSEADIFVTTTGNKDIIMVDHMRKMKNNAIVCNIGHFDNEIDMHGLETFPGVKRITIKPQTDRWVFPDTNSGIIVLAEGRLMNLGCATGHPSFVMSCSFTNQVIAQLELWKEKGTGKYKKEVYVLPKHLDEKVAALHLGKLGAKLTKLSKDQADYISVPIDGPYKPPHYRY

SEQ ID NO: 13827 - protein, 485 aa, Euonymus alatus
MALLVEKTAGGREYKVKDMSLADFGRLEIELAEVEMPGLMSCRTEYGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIYEKTGTFPDPASTDNAEFQIVLTIIRDGLKTDPKKYHKMKERLVGVSEETTTGVKRLYQMQINGTLLFPAINVNDSVTKSKFDNLYGCRHSLPDGLMRATDVMIAGKVGVVCGYGDVGKGCAAALKQAGARVIVTEIDPICALQALMEGYQVLTLEDVVSEADIFVTTTGNKDIIMVDHMRKMKNNAIVCNIGHFDNEIDMLGLETFPGVKRITIKPQTDRWVFPDTNSGIIVLAEGRLMNLGCATGHPSFVMSCSFTNQVIAQLELWMEKSSGKYEKKVYVLPKHLDEKVAALHLGKLGARLTKLSKDQADYISVPVEGPYKPAHYRY

SEQ ID NO: 13828 - protein, 485 aa, Populus trichocarpa
MALLVEKTTSGREYKVKDMSQADFGRLEIELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPDGGPDLIVDDGGDATLLIHEGVKAEEIYEKTGASPDPASTDNAEFQIVLTIIRDGLKSDPKKYHKMKERLVGVSEETTTGVKRLYQMQINGTLLFPAINVNDSVTKSKFDNLYGCRHSLPDGLMRATDVMIAGKVAVVCGYGDVGKGCAAAMKQAGARVIVTEIDPICALQALMEGLQVLTLEDVISEADIFVTTTGNKDIIMVDHMRKMKNNAIVCNIGHFDNEIDMLGLETFPGVKRITIKPQTDRWVFPDTNSGIIVLAEGRLMNLGCATGHPSFVMSCSFTNQVIAQLELWNERKTGKYERKVYVLPKHLDEKVASLHLGKLGARLTKLSKDQADYINVPIEGPYKPAQYRY

SEQ ID NO: 13829 - protein, 485 aa, Cleome spinosa
MALLVEKTSSGREYKVKDMSQADFGRLEIELAEVEMPGLMACRTEFGPSQPFKGAKITGSLHMTIQTAVLIETLTALGAEVRWCSCNIFSTQDHAAAAIARDSAAVFAWKGETLREYWWCTERALDWGPGGGPDLIVDDGGDATLLIHEGVKAEELYEKTGQVPDPSCTDNPEFQIVLQIIKDGLQVDPKKYRKMRERLVGVSEETTTGVKRLYQMQANGTLLFPAINVNDSVTKSKFDNLYGCRHSLPDGLMRATDVMIAGKVGVVCGYGDVGKGCALALKAAGARVIVTEIDPICALQALMEGFQILTLEDIVSEADIFVTTTGNKDIIMVDHMRKMKNNAIVCNIGHFDNEIDMHGLETFPGVKRITIKPQTDRWVFPDTKTGIIVLAEGRLMNLGCATGHPSFVMSCSFTNQVIAQLELWKEKGTGKYEKKVYVLPKHLDEKVAALHLGKLGAKLTKLSTDQADYISVPIEGPYKPPHYRY

SEQ ID NO: 13830 - protein, 485 aa, Ambrosia trifida
MALTVEKTSTGREYKVKDMSLADFGRLELELAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFEKTGKLPDPSSTDNAEFQIVLSIIKEGLQVDPKKYHKMKERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLQVLTLEDVVSEADIFVTTTGNKDIIMVSDMKKMKNNAIVCNIGHFDNEIDMLGLETYPGVQRITIKPQTDRWVFPETKTGIIVLAEGRLMNLGCATGHPSFVMSCSFTNQVIAQLELWNEKSTGKYKKEVYVLPKHLDEKVAALHLGKLGAKLTKLTKDQADYISVPVEGPYKPAHYRY

SEQ ID NO: 13831 - protein, 485 aa, Tripterygium wilfordii
MALLVEKTAAGREYKVKDMSLADFGRLEIELAEVEMPGLMSCRTEYGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIYEKTGTLPDPASTDNAEFQIVLTIIRDGLKTDPKRYHKMKERLVGVSEETTTGVKRLYQMQINGTLLFPAINVNDSVTKSKFDNLYGCRHSLPDGLMRATDVMIAGKVGVVCGYGDVGKGCAAALKQAGARVIVTEIDPICALQALMEGYQVLTLEDVVSEADIFVTTTGNKDIIMVDHMRKMKNNAIVCNIGHFDNEIDMLGLETFPGVKRITIKPQTDRWVFPDTNSGIIVLAEGRLMNLGCATGHPSFVMSCSFTNQVIAQLELWTEKSTGKYEKKVYVLPKHLDEKVAALHLGKLGARLTKLSKDQADYISVPVEGPYKPAHYRY

SEQ ID NO: 13832 - protein, 485 aa, Tripterygium wilfordii
MALLVEKTAGGREYKVKDMSLADFGRLEIDLAEVEMPGLMSCRTEYGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIYEKTGQFPDPASTDNAEFQIVLTIIRDGLKTDPKKYHKMKERLVGVSEETTTGVKRLYQMQINGTLLFPAINVNDSVTKSKFDNLYGCRHSLPDGLMRATDVMIAGKVGVVCGYGDVGKGCAAALKQAGARVIVTEIDPICALQALMEGYQVLTLEDVVSEADIFVTTTGNKDIIMVDHMRKMKNNAIVCNIGHFDNEIDMLGLETYPGVKRITIKPQTDRWVFPDTNSGIIVLAEGRLMNLGCATGHPSFVMSCSFTNQVIAQLELWLEKSSGKYEKKVYVLPKHLDEKVAALHLGKLGAKLTKLSKDQADYISVPVEGPYKPAHYRY

SEQ ID NO: 13833 - protein, 485 aa, Ricinus communis
MALLVEKTTSGREYKVKDMSQADFGRLEIELAEVEMPGLMACRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIYEKTGQVPDPTSTDNAEFQIVLTIIRDGLKTDPKKYHKMKERLVGVSEETTTGVKRLYQMQANGTLLFPAINVNDSVTKSKFDNLYGCRHSLPDGLMRATDVMIAGKVSVVCGYGDVGKGCAAALKQAGSRVIVTEIDPICALQALMEGYQVLPLEDVVSEADIFVTTTGNKDIVMVDHMRKMKNNAIVCNIGHFDNEIDMHGLETFPGVKRITIKPQTDRWVFPDTNSGIIVLAEGRLMNLGCATGHPSFVMSCSFTNQVIAQLELWREKATGKYEKKVYVLPKHLDEKVAALHLGKLGAKLTKLSKDQADYISVPVEGPYKPAHYRY

SEQ ID NO: 13834 - protein, 485 aa, Quercus alba
MALLVEKTTSGREYKVKDMSQADFGRLEIELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEELFEKNGTLPDPASTDNAEFQIVLTIIRDGLKTDPKRYHKMKQRLVGVSEETTTGVKRLYQMQANGTLLFPAINVNDSVTKSKFDNLYGCRHSLPDGLMRATDVMIAGKVAVVAGYGDVGKGCAAAMKQAGARVIVTEIDPICALQALMEGLQVLTLEDVVSEADIFVTTTGNKDIIMVDHMRKMKNNAIVCNIGHFDNEIDMLGLENYPGVKRITIKPQTDRWVFPDTNSGIIVLAEGRLMNLGCATGHPSFVMSCSFTNQVIAQLELWKERTTGKYEKKVYVLPKHLDEKVAALHLGKLGARLTKLSKDQADYISVPVEGPYKPAHYRY

SEQ ID NO: 13835 - protein, 485 aa, Quercus alba
MALLVEKTTSGREYKVKDMSQADFGRLEIELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEELFEKNGTIPDPASTDNAEFQIVLTIIRDGLKTDPKRYHKMKQRLVGVSEETTTGVKRLYQMQANGTLLFPAINVNDSVTKSKFDNLYGCRHSLPDGLMRATDVMIAGKVAVVAGYGDVGKGCAAAMKQAGARVIVTEIDPICALQALMEGLQVLTLEDVVSEADIFVTTTGNKDIIMVDHMRKMKNNAIVCNIGHFDNEIDMLGLENYPGVKRITIKPQTDRWVFPDTNSGIIVLAEGRLMNLGCATGHPSFVMSCSFTNQVIAQLELWKERTTGKYEKKVYVLPKHLDEKVAALHLGKLGARLTKLSKDQADYISVPVEGPYKPAHYRY

SEQ ID NO: 13836 - protein, 485 aa, Populus trichocarpa
MALLVEKTTSGRAYKVKDLSQADFGRLEIELAEVEMPGLMSCRAEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIYEKTGVLPDPASTDNVEFQLVLTIIRDGLKSDPMKYHKMKERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQALMEGLQVLTLEDVVSEADIFVTTTGNKDIIMVDHMRKMKNNAIVCNIGHFDNEIDMHGLETFPGVKRITIKPQTDRWVFPDTKSGILVLAEGRLMNLGCATGHPSFVMSCSFTNQVIAQLELWNEKTSGKYEKKVYVLPKHLDEKVASLHLGKLGARLTKLSKDQADYINVPVEGPYKPAQYRY

SEQ ID NO: 13837 - protein, 485 aa, Manihot esculenta
MALLVEKTTSGREYKVKDMSQADFGRLEIELAEVEMPGLMACRAEFGPAQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIYEKTGQVPDPSSTDNAEFQIVLTIIRDGLKTDPKRYHKMKERLVGVSEETTTGVKRLYQMQANGTLLFSAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMHGLETYPGVKRVTIKPQTDRWVFPETKTGIIVLAEGRLMNLGCATGHPSFVMSCSFTNQVIAQLELWREKGTGKYEKKVYVLPKHLDEKVAALHLGKLGAHLTKLTKEQADYISVPVEGPYKPAHYRY

SEQ ID NO: 13838 - protein, 485 aa, Ambrosia trifida
MSLTVEKTSTGREYKVKDMSLADFGRLELELAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFAKTGKLPDPSSTDNAEFQIVLSIIKDGLQSDPKKYHRMKDRLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQALMEGLQVLTLEDVLSEADIFVTTTGNKDIIMVDHMKKMKNNAIVCNIGHFDNEIDMLGLETYPGVKRITIKPQTDRWVFPETNSGIIVLAEGRLMNLGCATGHPSFVMSCSFTNQVIAQLELWKEKSSGKYKKEVYVLPKHLDEKVAALHLGKLGAKLTKLTQDQADYISVPVEGPYKPAQYRY

SEQ ID NO: 13839 - protein, 485 aa, Amsonia hubrichtii
MALLVEKTSSGREYKVKDMSQADFGRLEIELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYKKSGTLPDPTSTDNAEFQIVLTIIRDGLKSDPTKYARMKERLMGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIVMVDHMRKMKNNAIVCNIGHFDNEIDMLGLETYPGVKRITIKPQTDRWVFPDTNSGIIVLAEGRLMNLGCATGHPSFVMSCSFTNQVIAQLELWNERTTGKYEKKVYVLPKHLDEKVAALHLGKLGAKLTKLSKDQADYISVPIEGPYKPPHYRY

SEQ ID NO: 13840 - protein, 485 aa, Catharanthus roseus
MALLVEKTSSGREYKVKDMSQADFGRLEIELAEVEMPGLMSCRAEFGPSQPFKGAKITGSLHMTIQTAVLIETLTALGAEVRWCSCNIFSTQDHAAAAIARDSAAVFAWKGETLQEYWWCTERALDWGPDGGPDLIVDDGGDATLLIHEGVKAEEEYKKNGALPDPSSTDNAEFQIVLTIIRDGLKSDPTKYTRMKERLVGVSEETTTGVKRLYQMQANGTLLFPAINVNDSVTKSKFDNLYGCRHSLPDGLMRATDVMIAGKVAVVAGYGDVGKGCAAALKQAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPDTNSGIIVLAEGRLMNLGCATGHPSFVMSCSFTNQVIAQLELWNERKTGKYEKKVYVLPKHLDEKVAALHLGKLGAKLTKLTKDQADYISVPIEGPYKPAHYRY

SEQ ID NO: 13841 - protein, 485 aa, Cirsium arvense
MALTVEKTSTGREFKVKDMSLADFGRLEHQLAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFAKTGKLPDPSSTDNAEFQIVLSIIKEGLQIDPKKYHKMKDRLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQALMEGLQVLTLEDVLSEADIFVTTTGNKDIIMVNHMKKMKNNAIVCNIGHFDNEIDMLGLETYPGVKRITIKPQTDRWVFPDTKSGVIVLAEGRLMNLGCATGHPSFVMSCSFTNQVIAQLELWNEKSSGKYKKEVYVLPKHLDEKVAALHLNKLGAKLTKLSKDQADYISVPVEGPYKPAHYRY

SEQ ID NO: 13842 - protein, 485 aa, Platanus occidentalis
MALLVEKTSSGREYKVKDMSQADFGRLEIELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFARSGKVPDPASTDNAEFQIVLAIIRDGLKTDPKKYHKMKDRLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGIQVLTLEDVVSEADIFVTTTGNKDIIMVDHMKKMKNNAIVCNIGHFDNEIDMLGLETYPGVKRITIKPQTDRWVFPDTKSGVIVLAEGRLMNLGCATGHPSFVMSCSFTNQVIAQLELWKEKKTGKYKKEVYVLPKHLDEKVAALHLGKLGAKLTKLSQDQADYISVPVEGPYKPAHYRY

SEQ ID NO: 13843 - protein, 485 aa, Mimulus guttatus
MALLVEKTTSGREYKVKDMTQADFGRLELELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPDGGPDLIVDDGGDATLLIHEGVKAEEEFEKTGKLPDPSSTDNAEFQIVLTIIRDGLKTDPKRYAKMKERLVGVSEETTTGVKRLYQMQLNGTLLFPAINVNDSVTKSKFDNLYGCRHSLPDGLMRATDVMIAGKVGVVCGYGDVGKGCAISLKQAGARVIVTEIDPICALQALMEGFQVLTLEDVLSEADIFVTTTGNKDIIMVDHMRKMKNNAIVCNIGHFDNEIDMHGLETFPGVKRITIKPQTDRWVFPDTKSGIIILAEGRLMNLGCATGHPSFVMSCSFTNQVIAQLELWNERKSGKYGKEVYVLPKHLDEKVAALHLGKLGAKLTKLTKDQSDYVSIPVEGPYKPPHYRY

SEQ ID NO: 13844 - protein, 485 aa, Capsicum annuum
MALLVEKTTSGREYKVKDMSQADFGRLEIELAEVEMPGLMACRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKNGTVPDPSSTDNVEFQLVLGIIKESLKVDPLRYTKMKERLVGVSEETTTGVKRLYQMQANGTLLFPAINVNDSVTKSKFDNLYGCRHSLPDGLMRATDVMIAGKVAFIAGYGDVGKGCAAAMKQAGARVIVSEIDPICALQATMEGLQVLPLEDVVSDVDIFVTTTGNKDIIMVDHMRKMKNNAIVCNIGHFDNEIDMHGLETFPGVKRITIKPQTDRWVFPDTNSGIIVLAEGRLMNLGCATGHPSFVMSCSFTNQVIAQLELWNEKSSGKYEKKVYVLPKHLDEKVAALHLGKLGAKLTKLTKEQADYISVPVEGPYKPAHYRY

SEQ ID NO: 13845 - protein, 485 aa, Castanea mollissima
MALLVEKTTSGREYKVKDMSQADFGRLEIELAEVEMPGLMSCRTEFGPSQPFKGARITGSLHMTIQTAVLIETLTALGAEVRWCSCNIFSTQDHAAAATARDSAAVFAWKGETLQEYWWCTERALDWGPGGGPDLIVDDGGDATLLIHEGVKAEELFEKNGTLPDPASTDNAEFQIVLTIIRDGLKTDPKRYHKMKQRLVGVSEETTTGVKRLYQMQFNGSLLFPAINVNDSVTKSKFDNLYGCRHSLPDGLMRATDVMIAGKVAVVAGYGDVGKGCAAALKQAGARVIVTEIDPICALQALMEGLQVLTLEDVVSEADIFVTTTGNKDIIMVDHMRKMKNNAIVCNIGHFDNEIDMLGLENYPGVKRITIKPQTDRWVFPDTNSGIIVLAEGRLMNLGCATGHPSFVMSCSFTNQVIAQLELWKERTSGKYEKKVYVLPKHLDEKVAALHLGKLGARLTKLSKDQADYISVPVEGPYKPAHYRY

SEQ ID NO: 13846 - protein, 485 aa, Cannabis sativa
MSLSVEKTTAGREYKVKDLSQADFGRLEIELAEVEMPGLVSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIYEKTGQLPDPTSTDNVEFQLVLGIIKEGLKTDPKRYHKMKDRLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSDADIFVTTTGNKDIIMVDHMRKMKNNAIVCNIGHFDNEIDMLGLETYPGVKRITIKPQTDRWVFPETNVGIIVLAEGRLMNLGCATGHPSFVMSCSFTNQVIAQLELWNEKSSGKYKKEVYVLPKHLDEKVAALHLGKLGARLTKLSKDQADYISVPVEGPYKPVHYRY

SEQ ID NO: 13847 - protein, 485 aa, Flaveria ramosissima
MSLTVEKTSTGREYKVKDMSLADFGRLELELAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFEKTGKLPDPTSTDNAEFQIVLSIIKEGLQSDPKKYHKMKERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQALMEGLQVLTLEDVLSEADIFVTTTGNKDIIMVDHMKKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYKKEVYVLPKHLDEKVAALHLGKLGAKLTKLTQDQADYISVPVEGPYKPAHYRY

SEQ ID NO: 13848 - protein, 485 aa, Tripterygium wilfordii
MALLVEKTAGGREYKVKDMSLADFGRLEIDLAEVEMPGLMSCRTEYGPSQPFKGARITGSLHMTIQTAVLIEALTALGAEVRWCSCNIFSTQDHAAAAIARDSAAVFAWKGETLQEYWWCTERALDWGPDGGPDLIVDDGGDATLLIHEGVKAEEIYEKTGQFPDPASTDNAEFQIVLTIIRDGLKTDPKKYHKMKERLVGVSEETTTGVKRLYQMQINGTLLFPAINVNDSVTKSKFDNLYGCRHSLPDGLMRATDVMIAGKVGVVCGYGDVGKGCAAALKQAGARVIVTEIDPICALQALMEGYQVLTLEDVVSEADIFVTTTGNKDIIMVGHMRKMKNNAIVCNIGHFDNEIDMLGLETYPGVKRITIKPQTDRWVFPDTNSGIIVLAEGRLMNLGCATGHPSFVMSCSFTNQVIAQLELWLEKSSGKYEKKVYVLPKHLDEKVAALHLGKLGAKLTKLSKDQADYISVPVEGPYKPAHYRY

SEQ ID NO: 13849 - protein, 485 aa, Citrullus lanatus
MSLIVEKTAGGREYKVKDMSQADFGRLEIELAEVEMPGLMACRAEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGALPDPSSTDNAEFQIVLTIIRDGLKSDPKRYHKMKERLVGVSEETTTGVKRLYQMQSSGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMLGLENYPGVKRITIKPQTDRWVFPETNTGIIVLAEGRLMNLGCATGHPSFVMSCSFTNQVIAQLELWNEKASGKYEKKVYVLPKHLDEKVAALHLGKLGAKLTKLSKDQADYINVPVEGPYKPAHYRY

SEQ ID NO: 13850 - protein, 485 aa, Vitis vinifera
MSLLVEKTSSGREYKVKDMSQADFGRLEIELAEVEMPGLMSCRTEFGPQQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYAKSGKLPDPSSTDNAEFQIVLTIIRDGLKTDPKRYHKMKGRLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGIPVQTIEDVVSEADIFVTTTGNKDIIMVDHMRKMKNNAIVCNIGHFDNEIDMLGLETYPGVKRITIKPQTDRWVFPDTNSGIIVLAEGRLMNLGCATGHPSFVMSCSFTNQVIAQLELWKEKASGKYEKKVYVLPKHLDEKVAALHLGKLGAKLTKLSKDQADYISVPIEGPYKPPHYRY

SEQ ID NO: 13851 - protein, 485 aa, Capsicum annuum
MALLVEKTTSGREYKVKDMSQADFGRLEIELAEVEMPGLMACRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKNGTVPDPSSTDNVEFQLVLGIIKESLKVDPLRYTKMKERLVGVSEETTTGVKRLYQMQANGTLLFPAINVNDSVTKSKFDNLYGCRHSLPDGLMRATDVMIAGKVAFIAGYGDVGKGCAAAMKQAGARVIVSEIDPICALQATMEGLQVLPLEDVVSDVDIFVTTTGNKDIIMVDHMRKMKNNAIVCNIGHFDNEIDMHGLETFPGVKRITIKPQTDRWVFPDTNSGVIVLAEGRLMNLGCATGHPSFVMSCSFTNQVIAQLELWNEKSSGKYEKKVYVLPKHLDEKVAALHLGKLGAKLTKLTKEQADYISVPVEGPYKPAHYRY

SEQ ID NO: 13852 - protein, 485 aa, Panax ginseng
MALLVEKTATGREYKVKDMSLADFGRLELELAEVEMPGLMSCRTEFGPSQPFKGAKITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEYAKTGAVPDPASTDNAEFQIVLTIIRDGLKTDPKKYHKMKERLVGVSEETTTGVKRLYQMQLNGTLLFPAINVNDSVTKSKFDNLYGCRHSLPDGLMRATDIMIAGKVAVVAGYGDVGKGCAAAMKQAGARVVVTEIDPICALQATMEGLQVLTLEDVVSEADIFVTTTGNKDIIMVDHMRKMKNNAIVCNIGHFDNEIDMLGLETFPGVKRITIKPQTDRWVFPDTQSGIIVLAEGRLMNLGCATGHPSFVMSCSFTNQVIAQLELWKERSTGKYEKKVYVLPKHLDEKVAALHLGKLGAKLTKLSKDQADYISVPVEGPYKPVHYRY

SEQ ID NO: 13853 - protein, 485 aa, Quercus alba
MALLVEKTTSGREYKVKDMSQADFGRLEIELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEELFEKNGTLPDPASTDNAEFQIVLTIIRDGLKTDPKRYHKMKQRLVGVSEETTTGVKRLYQMQANGTLLFSAINVNDSVTKSKFDNLYGCRHSLPDGLMRATDVMIAGKVAVVAGYGDVGKGCAAALKQAGARVIVTEIDPICALQALMEGLQVLTLEDVVSEADIFVTTTGNKDIIMVDHMRKMKNNAIVCNIGHFDNEIDMLGLENYPGVKRITIKPQTDRWVFPDTNSGIIVLAEGRLMNLGCATGHPSFVMSCSFTNQVIAQLELWKERTTGKYEKKVYVLPKHLDEKVAALHLGKLGARLTKLSKDQADYISVPVEGPYKPAHYRY

SEQ ID NO: 13854 - protein, 485 aa, Mimulus guttatus
MALVVEKTTSGREYKVKDMSQADFGRLELELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFEKSGKVPDPSSTDNAEFQIVLTIIRDGLKEDPKKYHKMKERLVGVSEETTTGVKRLYQMQLNGTLLFPAINVNDSVTKSKFDNLYGCRHSLPDGLMRATDVMIAGKVGVVCGYGDVGKGCAISLKQAGARVIVTEIDPICALQALMEGFQVLTLEDVVSEADIFVTTTGNKDIIMVDHMRKMKNNAIVCNIGHFDNEIDMHGLETYPGVKRITIKPQTDRWVFPETKTGIIILAEGRLMNLGCATGHPSFVMSCSFTNQVIAQLELWNERKSGKYGKEVYVLPKHLDEKVAALHLGKLGAKLTKLTKEQSDYISIPVEGPYKPPHYRY

SEQ ID NO: 13855 - protein, 78 aa, Ricinus communis
MAAAAWSWVLKMLHEHQRTSAPRAVRVSMRTAVWIVMWREPVILAPLNGWDGPNSVRQAIKPGISTSASSISSRPKSA

SEQ ID NO: 13856 - protein, 485 aa, Ambrosia trifida
MALTVEKTSTGREYKVKDMSLADFGRLELELAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFEKTGKLPDPSSTDNAEFQIVLSIIKEGLQVDPKKYHKMKERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLEVLTLDDVVSQADIFVTTTGNKDIIMVSDMKKMKNNAIVCNIGHFDNEIDMLGLETYPGVQRITIKPQTDRWVFPETKTGIIVLAEGRLMNLGCATGHPSFVMSCSFTNQVIAQLELWNEKSTGKYKKEVYVLPKHLDEKVAALHLGKLGAKLTKLTKDQADYISVPVEGPYKPAHYRY

SEQ ID NO: 13857 - protein, 485 aa, Ambrosia trifida
MALTVEKTSTGREYKVKDMSLADFGRLELELAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFEKTGKLPDPSSTDNAEFQIVLSIIKEGLQVDPKKYHKMKERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLEVLTLDDVVSQADIFVTTTGNKDIIMVSDMKKMKNNAIVCNIGHFDNEIDMLGLETYPGVQRITIKPQTDRWVFPETKAGIIVLAEGRLMNLGCATGHPSFVMSCSFTNQVIAQLELWNEKSTGKYKKEVYVLPKHLDEKVAALHLGKLGAKLTKLTKDQADYISVPVEGPYKPAHYRY

SEQ ID NO: 13858 - protein, 485 aa, Arnica chamissonis
MALTVEKTSTGREYKVKDMSLADFGRLELELAEVEMPGLISCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFAKTGKLPDPTSTDNAEFQIVLSIIKEGLQTDPKKYHKMKDRLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLQVLTLEDVVSEADIFVTTTGNKDIIMVSDMKKMKNNAIVCNIGHFDNEIDMLGLETYPGIQRITIKPQTDRWVFPETKTGIIVLAEGRLMNLGCATGHPSFVMSCSFTNQVIAQLELWKEKNSGKYKKEVYVLPKHLDEKVAALHLGKLGAKLTKLTKDQADYISIPVEGPYKPAHYRY

SEQ ID NO: 13859 - protein, 485 aa, Platanus occidentalis
MDLLVEKTSSGIEYKVKDMSQADFGRLEIELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFEKSGKIPDPASTDNAEFQIVLGIIRDGLKTDPKKYHKMKERLVGVSEETTTGVKRLYQMQVNGTLLFPAINVNDSVTKSKFDNLYGCRHSLPDGLMRATDVMIAGKVAVVCGYGDVGKGCAAALKQAGARVIVTEIDPICALQALMEGIPVLTLEDVVSEADIFVTTTGNKDIIMVDHMKKMKNNAIVCNIGHFDNEIDMHGLENFPGVQRITIKPQTDKWVFPETKSGIIVLAEGRLMNLGCATGHPSFVMSCSFTNQVIAQLELWKEKSTGKYEKKVYVLPKHLDEKVAALHLGKLGAKLTKLTPEQADYISVPVEGPYKPAHYRY

SEQ ID NO: 13860 - protein, 485 aa, Hordeum vulgare
MALSVEKTSSGREYKVKDLSQADFGRLELELAEVEMPGLMACRTEFGPSQPFKGARISGSLHMTIQTAVLIETLTALGAEVRWCSCNIFSTQDHAAAAIARDSAAVFAWKGETLEEYWWCTERCLDWGAGGGPDLIVDDGGDATLLIHEGVKAEEEFEKSGKVPDPESTDNPEFKIVLTIIRDGLKTDASKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSEADIFVTTTGNKDIIMVDHMRKMKNNAIVCNIGHFDNEIDMNGLETYPGVKRITIKPQTDRWVFPETKTGIIVLAEGRLMNLGCATGHPSFVMSCSFTNQVIAQLELWNEKASGKYEKKVYVLPKHLDEKVAALHLGKLGARLTKLTKSQSDYISIPIEGPYKPAAYRY

SEQ ID NO: 13861 - protein, 485 aa, Ocimum basilicum
MALLVEKTSSGREYKVKDMSQADFGRLEIDLAEVEMPGLMSCRTEFGPSQPFKGAKITGSLHMTIQTAVLIETLTALGAEVRWCSCNIFSTQDHAAAVIARDSAAVFAWKGETLQEYWWCTERALDWGPGGGPDLIVDDGGDATLLIHEGVKAEEEYAKSGKLPDPSSTDNAEFQIVLTIIRDGLKENPTKYTKMKERLVGVSEETTTGVKRLYQMQANGTLLFPAINVNDSVTKSKFDNLYGCRHSLPDGLMRATDVMIAGKVGVVFGYGDVGKGCAAALKQAGARVIVTEIDPICALQALMEGFQVLRLEDVVSEADIFVTTTGNKDIIMVSDMRKMKNNAIVCNIGHFDNEIDMHGLETYPGVKRITIKPQTDRWVFPDTKSGIIVLAEGRLMNLGCATGHPSFVMSCSFTNQVIAQLELWNERSSGKYEKKVYVLPKHLDEKVAALHLGKLGAKLTKLSKDQADYISVPIEGPYKPAHYRY

SEQ ID NO: 13862 - protein, 485 aa, Triticum aestivum
MALSVEKTSSGREYKVKDLSQADFGRLELELAEVEMPGLMACRTEFGPSQPFKGARISGSLHMTIQTAVLIETLTALGAEVRWCSCNIFSTQDHAAAAIARDSAAVFAWKGETLEEYWWCTERCLDWGVGGGPDLIVDDGGDATLLIHEGVKAEEEFEKSGKVPDPESTDNPEFKIVLTIIRDGLKTDASKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSEADIFVTTTGNKDIIMVDHMRKMKNNAIVCNIGHFDNEIDMNGLETYPGVKRITIKPQTDRWVFPETKTGIIVLAEGRLMNLGCATGHPSFVMSCSFTNQVIAQLELWNEKASGKYEKKVYVLPKHLDEKVAALHLGKLGARLTKLTKSQSDYISIPIEGPYKPAAYRY

SEQ ID NO: 13863 - protein, 485 aa, Linum usitatissimum
MALIVDKTTTGREYKVKDMSQADFGRLELELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPDGGPDLIVDDGGDATLLIHEGVKAEEEYEKSGKVPDPASTDNAEFQIVLTIIRDGLKTDPKKYRKMRDRLVGVSEETTTGVKRLYQMQENGTLLFPAINVNDSVTKSKFDNLYGCRHSLPDGLMRATDVMIAGKVAVVLGYGDVGKGCAAAMKQAGARVIVTEIDPICALQALMEGLQVLTLEDCVAEADIFVTTTGNKDIIMVDDMRKMKNNAIVCNIGHFDNEIDMNGLETFPGVKRITIKPQTDRWVFPDTKSGIIVLAEGRLMNLGCATGHPSFVMSCSFTNQVIAQLELWNERSSGKYEKKVYVLPKHLDEKVALLHLGKLGARLTKLSKDQADYISVPVEGPYKPAHYRY

SEQ ID NO: 13864 - protein, 485 aa, Setaria italica
MALSVEKTSSGREYKVKDLSQADFGRLEIELAEVEMPGLMACRTEFGPSQPFAGARISGSLHMTIQTAVLIETLTALGAEVRWCSCNIFSTQDHAAAAIARDSAAVFAWKGETLEEYWWCTERCLDWGEGGGPDLIVDDGGDATLLIHEGVKAEEEYEKSGKIPDPESTDNAEFKIVLTIIRDGLKSDPKKYRKMKERLVGVSEETTTGVKRLYQMQETGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMHGLETYPGVKRITIKPQTDRWVFPETKTGIIVLAEGRLMNLGCATGHPSFVMSCSFTNQVIAQLELWKEKSSGKYEKKVYVLPKHLDEKVAALHLGKLGARLTKLSKSQADYISVPIEGPYKPAHYRY

SEQ ID NO: 13865 - protein, 485 aa, Panicum virgatum
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEGGGPDLIVDDGGDATLLIHEGVKAEEEYEKTGKVPDPESTDNAEFKIVLTIIRDGLKSDPKKYRKMKERLVGVSEETTTGVKRLYQMQETGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETKTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 13866 - protein, 485 aa, Malus domestica
MALSVEKSSSGREYKVKDMSQADFGRLEIELAEVEMPGLVSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKSGTLPDPSSTDNQEFQLVLTIIRDGLKTDPKRYHKMKDRLVGVSEETTTGVKRLYQMQASGALLFPAINVNDSVTKSKFDNLYGCRHSLPDGLMRATDVMIAGKVSVVCGYGDVGKGCAAALKQAGSRVVVTEIDPICALQALMEGLQVLPLEDVVAEADIFVTTTGNKDIIMVDHMKKMKNNAIVCNIGHFDNEIDMHGLETYPGVKRITIKPQTDRWVFPETKSGIIVLAEGRLMNLGCATGHPSFVMSCSFTNQVIAQLELWNERKSGKYEKKVYVLPKHLDEKVAALHLGKLGAKLTKLTKEQADYISVPVEGPYKPAAYRY

SEQ ID NO: 13867 - protein, 485 aa, Manihot esculenta
MALLVEKTTSGREYKVKDMSQADFGRLEIELAEVEMPGLMACRAEFGPAQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEVYEKTGKLPDPSSTDNAEFQIVLTIIRDGLKTDPKRYHKMKERLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSAADIFVTTTGNKDIIMVDHMKKMKNNAIVCNIGHFDNEIDMHGLETYPGVKRITIKPQTDRWVFPETNSGIIVLAEGRLMNLGCATGHPSFVMSCSFTNQVIAQLELWREKGTGKYEKKVYVLPKHLDEKVAALHLGKLGAKLTKLTKDQADYISVPVEGPYKPPHYRY

SEQ ID NO: 13868 - protein, 485 aa, Actinidia deliciosa
MALLVEKTTTGREYKVKDMSQADFGRLEIELAEVEMPGLMSCRAEFGPSQPFKGARITGSLHMTIQTAVLIETLTALGAEVRWCSCNIFSTQDHAASAIARDSAAVFAWKGETLQEYWWCTERALDWGPGGGPDLIVDDGGDATLLIHEGVKAEEEYEKTGAVPDPASTDNAEFQIVLTIIRDGLKTDPKRYHKMKERLVGVSEETTTGVKRLYQMQASGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSETDIFVTTTGNKDIIMVDHMKKMKNNAIVCNIGHFDNEIDMHGLETYPGVQRITIKPQTDRWVFPDTKSGIIILAEGRLMNLGCATGHPSFVMSCSFTNQVIAQLELWKEKATGKYEKKVYVLPKHLDEKVAALHLAKLGARLTKLSKDQADYISVPVEGPYKPAHYRY

SEQ ID NO: 13869 - protein, 485 aa, Glycine max
MALLVEKTSSGREYKVKDMTQADFGRLEIELAEVEMPGLMSSRTEFGPSQPFKGARITGSLHMTIQTAVLIETLTALGAEVRWCSCNIFSTQDHAAAAIARDSASVFAWKGETLQEYWWCTERALDWGPGGGPDLIVDDGGDTTLLIHEGVKAEEIFEKTGQFPDPASSDNAEFQIVLSIIRDGLKTDPKRYHKMKDRIVGVSEETTTGVKRLYQMQANGSLLFPAINVNDSVTKSKFDNLYGCRHSLPDGLMRATDVMIAGKVAVVCGYGDVGKGCASAMKQAGARVIVTEIDPICALQALMEGLQVLTLEDVVSEADIFVTTTGNKDIIMLDHMKKMKNNAIVCNIGHFDNEIDMLGLETCPGVKRINIKPQTDRWVFPDTKRGIIVLAEGRLMNLGCATGHPSFVMSCSFTNQVIAQLELWKEKGSGKYEKKVYVLPKHLDEKVASLHLGQLGARLTKLSKDQADYISVPVEGPYKPAHYRY

SEQ ID NO: 13870 - protein, 485 aa, Cucumis melo
MSLIVEKTAAGREYKVKDMSQADFGRLEIELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIYEKTGALPDPASTDNAEFQIVLTIIRDGLKSDPKRYHKMKERLVGVSEETTTGVKRLYQMQSSGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETNVGIIVLAEGRLMNLGCATGHPSFVMSCSFTNQVIAQLELWNERASGKYEKKVYVLPKHLDEKVAALHLGKLGAKLTKLSKDQADYINVPVEGPYKPAHYRY

SEQ ID NO: 13871 - protein, 485 aa, Helianthus annuus
MSLTVEKTSTGREYKVKDMSLADFGRLELELAEVEMPGLMSCRTEFGPSQPFKGAKITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFAKTGKLPDPTSTDNAEFQIVLSIIKEGLQTDPKKYHKMKERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQALMEGLQVLTLEDVLSEADIFVTTTGNKDIIMVDHMKKMKNNAIICNIGHFDNEIDMLGLETYPGVKRITIKPQTDRWVFPETKSGVIVLAEGRLMNLGCATGHPSFVMSCSFTNQVIAQLELWNEKGKGKYKNEVYVLPKHLDEKVAALHLGKLGARLTKLTKDQADYISVPVDGPYKPAHYRY

SEQ ID NO: 13872 - protein, 485 aa, Euonymus alatus
MALLVEKTDGGREYKVKDTSLADFGRLEIDLAEVEMPGLMSCRTEYGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIYEKTGQSPDPASTDNAEFQIVLTIIRDGLKTDPKKYHKMKERLVGVSEETTTGVKRLYQMQINGTLLFPAINVNDSVTKSKFDNLYGCRHSLPDGLMRATDVMIAGKVGVVCGFGDVGKGCAAALKQAGARVIVTEIDPICALQALMEGYQVLTLEDVVSEADIFVTTTGNKDIIMVDHMRKMKNNAIVCNIGHFDNEIDMLGLETYPGVKRITIKPQTDRWVFPDTNSGIIVLAEGRLMNLGCATGHPSFVMSCSFTNQVIAQLELWLEKSSGKYEKKVYVLPKHLDEKVAALHLGKLGAKLTKLSKDQADYINVPVEGPYKPAQYRY

SEQ ID NO: 13873 - protein, 485 aa, Euonymus alatus
MALLVEKTAGGREYKVKDTSLADFGRLEIELAEVEMPGLMSCRTEYGPSQPFKGAKITGSLHMTIQTAVLIETLTALGAEVRWCSCNIFSTQDHAAAAIARDSAAVFAWKGETLQEYWWCTERALDWGPDGGPDLIVDDGGDATLLIHEGVKAEEIYEKTGTFPDPASTDNAEFQIVLTIIRDGLKTDPKRYHKMKERLVGVSEETTTGVKRLYQMQINGTLLFPAINVNDSVTKSKFDNLYGCRHSLPDGLMRATDVMIAGKVGVVCGFGDVGKGCAAALKQAGARVIVTEIDPICALQALMEGYQVLTLEDVVSDADIFVTTTGNKDIIMVDHMRKMKNNAIVCNIGHFDNEIDMLGLETFPGVKRITIKPQTDRWVFPDTNSGIIVLAEGRLMNLGCATGHPSFVMSCSFTNQVIAQLELWTEKSTGKYEKKVYVLPKHLDEKVAALHLGKLGARLTKLSKDQADYISVPVEGPYKPAHYRY

SEQ ID NO: 13874 - protein, 485 aa, Solanum lycopersicum
MALLVEKTTSGREYKVKDMSQADFGRLEIELAEVEMPGLMASRAEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKNGTVPDPTSTDNVEFQLVLTIIKESLKTDPLRYTKMKERLVGVSEETTTGVKRLYQMQANGSLLFPAINVNDSVTKSKFDNLYGCRHSLPDGLMRATDVMIAGKVALVAGYGDVGKGCAAAMKQAGARVIVTEIDPICALQATMEGLQVLPLEDVVSEVDIFVTTTGNKDIIMVDHMRKMKNNAIVCNIGHFDNEIDMHGLETFPGVKRITIKPQTDRWVFPDTNSGIIVLAEGRLMNLGCATGHPSFVMSCSFTNQVIAQLELWNERSSGKYEKKVYVLPKHLDEKVAALHLGKLGAKLTKLTKDQADYISVPVEGPYKPAHYRY

SEQ ID NO: 13875 - protein, 485 aa, Linum usitatissimum
MALIVDKTTTGREYKVKDMSQADFGRLELELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPDGGPDLIVDDGGDATLLIHEGVKAEEEYEKSGKIPDPASTDNAEFQIVLTIIRDGLKTDPKKYRKMRDRLVGVSEETTTGVKRLYQMQENGTLLFPAINVNDSVTKSKFDNLYGCRHSLPDGLMRATDVMIAGKVAVVLGYGDVGKGCAAAMKQAGARVIVTEIDPICALQALMEGLQVLTLEDCVAEADIFVTTTGNKDIIMVDDMRKMKNNAIVCNIGHFDNEIDMNGLETFPGVKRITIKPQTDRWVFPDTKSGIIVLAEGRLMNLGCATGHPSFVMSCSFTNQVIAQLELWNERSSGKYEKKVYVLPKHLDEKVALLHLGKLGARLTKLSKDQADYISVPVEGPYKPAHYRY

SEQ ID NO: 13876 - protein, 485 aa, Solanum tuberosum
MALLVEKTTSGREYKVKDMSQADFGRLEIELAEVEMPGLMASRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKNGTIPDPTSTDNVEFQLVLTIIKESLKTDPLRYTKMKERLVGVSEETTTGVKRLYQMQANGTLLFPAINVNDSVTKSKFDNLYGCRHSLPDGLMRATDVMIAGKVALVAGYGDVGKGCAAAMKQAGARVIVTEIDPICALQATMEGLQVLPLEDVVSEVDIFVTTTGNKDIIMVDHMRKMKNNAIVCNIGHFDNEIDMHGLETFPGVKRITIKPQTDRWVFPDTKSGIIVLAEGRLMNLGCATGHPSFVMSCSFTNQVIAQLELWNERTSGKYEKKVYVLPKHLDEKVAALHLGKLGAKLTKLTKDQADYISVPVEGPYKPAHYRY

SEQ ID NO: 13877 - protein, 485 aa, Solanum phureja
MALLVEKTTSGREYKVKDMSQADFGRLEIELAEVEMPGLMASRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKNGAIPDPTSTDNVEFQLVLTIIKESLKTDPLRYTKMKERLVGVSEETTTGVKRLYQMQANGTLLFPAINVNDSVTKSKFDNLYGCRHSLPDGLMRATDVMIAGKVALVAGYGDVGKGCAAAMKQAGARVIVTEIDPICALQATMEGLQVLPLEDVVSEVDIFVTTTGNKDIIMVDHMRKMKNNAIVCNIGHFDNEIDMHGLETFPGVKRITIKPQTDRWVFPDSKSGIIVLAEGRLMNLGCATGHPSFVMSCSFTNQVIAQLELWNEKKSGKYEKKVYVLPKHLDEKVAALHLGKLGAKLTKLTKDQADYISVPVEGPYKPAHYRY

SEQ ID NO: 13878 - protein, 485 aa, Nicotiana tabacum
MALLVEKTTSGREYKVKDMSQADFGRLEIELAEVEMPGLMACRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKNGTIPDPNSTDNAEFQLVLTIIKESLKTDPLKYTKMKERLVGVSEETTTGVKRLYQMQANGTLLFPAINVNDSVTKSKFDNLYGCRHSLPDGLMRATDVMIAGKVALVAGYGDVGKGCAAALKQAGARVIVTEIDPICALQATMEGLQVLTLEDVVSDVDIFVTTTGNKDIIMVDHMRKMKNNAIVCNIGHFDNEIDMLGLETYPGVKRITIKPQTDRWVFPDTNSGIIVLAEGRLMNLGCATGHPSFVMSCSFTNQVIAQLELWNEKSSGKYEKKVYVLPKHLDEKVAALHLGKLGAKLTKLSKDQADYISVPVEGPYKPAHYRY

SEQ ID NO: 13879 - protein, 485 aa, Cenchrus ciliaris
MALSVEKTSSGREYKVKDLSQADFGRLEIELAEVEMPGLMACRTEFGPSKPFAGARISGSLHMTIQTAVLIETLTALGAEVRWCSCNIFSTQDHAAAAIARDSAAVFAWKGETLEEYWWCTERCLDWGEGGGPDLIVDDGGDATLLIHEGVKAEEEYEKTGKIPDPESTDNAEFKIVLTIIRDGLKSDPKKYRKMKDRLVGVSEETTTGVKRLYQMQETGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMHGLETYPGVKRITIKPQTDRWVFPETKTGIIVLAEGRLMNLGCATGHPSFVMSCSFTNQVIAQLELWKEKSSGKYEKKVYVLPKHLDEKVAALHLGKLGARLTKLTKSQADYISVPVEGPYKPAHYRY

SEQ ID NO: 13880 - protein, 485 aa, Sorghum bicolor
MALSVEKTSSGREHKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEGGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETKTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 13881 - protein, 485 aa, Triticum aestivum
MALSVEKTSSGREYKVKDLSQADFGRLELDLAEVEMPGLMACRTEFGPSQPFKGARISGSLHMTIQTAVLIETLTALGAEVRWCSCNIFSTQDHAAAAIARDSAAVFAWKGETLEEYWWCTERCLDWGAGGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 13882 - protein, 485 aa, Gossypium hirsutum
MALSVEKTAAGREYKVKDMSQADFGRLEIELAEVEMPGLMACRTEFGPAQPFKGAKITGSLHMTIQTAVLIETLTALGAEVRWCSCNIFSTQDHAAAAIARDSAAVFAWKGETLQEYWWCTERALDWGPTGGPDLIVDDGGDATLLIHEGVKAEEVYEKTGQLPDPASTDNAEFQIVLTIIRDGLKADPKKYRRMKERLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETKTGIIVLAEGRLMNLGCATGHPSFVMSCSFTNQVIAQLELWKEKATGKYEKKVYVLPKHLDEKVAALHLGKLGAKLTKLTKDQADYISVPVEGPYKPPHYRY

SEQ ID NO: 13883 - protein, 485 aa, Actinidia deliciosa
MSLLVEKTTSGREYKVKDMSQADFGRLEIELAEVEMPGLMSCRTEFGPSQPFKGARITGSLHMTIQTAVLIETLTALGAEVRWCSCNIFSTQDHAASAIARDSAAVFAWKGETLQEYWWCTERALDWGPGGGPDLIVDDGGDATLLIHEGVKAEEEYEKSGAVPDPASTDNAEFQIVLTIIRDGLKTDPKRYHKMKARLVGVSEETTTGVKRLYQMQASGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSETDIFVTTTGNKDIIMVDHMRKMKNNAIVCNIGHFDNEIDMHGLENYPGVQRITIKPQTDRWVFPDTKSGIIILAEGRLMNLGCATGHPSFVMSCSFTNQVIAQLELWNERATGKYEKKVYVLPKHLDEKVAALHLAKLGARLTKLSKDQADYISVPVEGPYKPAHYRY

SEQ ID NO: 13884 - protein, 485 aa, Quercus alba
MALSVEKTTSGREYKVKDMSQADFGRLEIELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGAGGGPDLIVDDGGDATLLIHEGVKAEELFEKNGTLPDPASTDNAEFQIVLTIIRDGLKTDPKRYHKMKQRLVGVSEETTTGVKRLYQMQANGTLLFSAINVNDSVTKSKFDNLYGCRHSLPDGLMRATDVMIAGKVAVVAGYGDVGKGCAAALKQAGARVIVTEIDPICALQALMEGLQVLTLEDVVSEADIFVTTTGNKDIIMVDHMRKMKNNAIVCNIGHFDNEIDMLGLENYPGVKRITIKPQTDRWVFPDTNSGIIVLAEGRLMNLGCATGHPSFVMSCSFTNQVIAQLELWKERTTGKYEKKVYVLPKHLDEKVAALHLGKLGARLTKLSKDQADYISVPVEGPYKPAHYRY

SEQ ID NO: 13885 - protein, 485 aa, Oryza sativa
MALSVEKTSSGREYKVKDLSQADFGRLEIELAEVEMPGLMACRAEFGPSQPFKGARISGSLHMTIQTAVLIETLTALGAEVRWCSCNIFSTQDHAAAAIARDSAAVFAWKGETLEEYWWCTERCLDWGVGGGPDLIVDDGGDATLLIHEGVKAEEEFEKSGKVPDPESTDNAEFKIVLTIIRDGLKSDPSKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSTGKYEKKVYVLPKHLDEKVAALHLGKLGARLTKLSKSQADYISVPVEGPYKPAHYRY

SEQ ID NO: 13886 - protein, 210 aa, Nicotiana tabacum
MALLVEKTTSGREYKVKDMSQADFGRLEIELAEVEMPGLMACRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYAKSGKLPDPSSTDNVEFQLVLTIIRDGLKTDPLKYTKMKERLVGVSEETTTRC

SEQ ID NO: 13887 - protein, 74 aa, Cannabis sativa
MNQKRSITTIINNQIWTTTWTPIKSTLSTPPILLKSLTFPSKNSSRITSYGGRSVILSRENVAGAPSHLSTECG

SEQ ID NO: 13888 - protein, 134 aa, Flaveria ramosissima
MALTVEKTSTGREYKVKDMSLADFGRLELELAEVEMPGLMSCRTEFGPSQPFKGARITGSLHMTIQTDVLIETLPPWAPKSAGAPATSSRLRTTPPPPSHVTPPPCSPGRVRRCRSTGGVRSVPWIGAPVVDPI

SEQ ID NO: 13889 - protein, 485 aa, Arnica chamissonis
MALTVEKTSTGREYKVKDMSLADFGRLELELAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFEKTGKLPDPTSTDNAEFQIVLSIIKEGLQTDPKKYHKMKTRLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGIQVLTLEDVVSEADIFVTTTGNKDIIMVSDMKKMKNNAIVCNIGHFDNEIDMLGLETYPGVQRITIKPQTDRWVFPETKTGIIILAEGRLMNLGCATGHPSFVMSCSFTNQVIAQLELWNEKNTGKYKKEVYVLPKHLDEKVAALHLGKLGAKLTKLTKDQADYISIPVEGPYKPAHYRY

SEQ ID NO: 13890 - protein, 485 aa, Cucurbita pepo
MSLIVEKTAGGREYKVKDMSQADFGRLEIELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIYEKSGALPDPSSTDNAEFQIVLTIIRDGLKSDPKRYHKMKERLVGVSEETTTGVKRLYQMQASGTLLFPAINVNDSVTKSKFDNLYGCRHSLPDGLMRATDVMIAGKVAVVCGYGDVGKGCASALKQAGARVIVTEIDPICALQALMEGLPVLTLEDVLSEADIFVTTTGNKDIIMVDHMRKMKNNAIVCNIGHFDNEIDMLGLESYPGVKRITIKPQTDRWVFPETNSGIIVLAEGRLMNLGCATGHPSFVMSCSFTNQVIAQLELWNERKSGKYEKKVYVLPKHLDEKVAALHLGKLGARLTKLSKDQADYINVPVEGPYKPAHYRY
